United States Patent 11,739,335 (NUCLEIC ACIDS ENCODING CRISPR-ASSOCIATED PROTEINS AND USES THEREOF) - sequence listing, part 8

SEQ ID NO: 5875 - RNA, 5203 nt, Artificial Sequence
  Cas9 variant mRNA product
gggagagucccgcagucggcguccagcggcucugcuuguucgugugugugucguugcaggccuuauucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5876 - RNA, 3475 nt, Artificial Sequence
  Cas9 variant mRNA product
gggagagucccgcagucggcguccagcggcucugcuuguucgugugugugucguugcaggccuuauucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5877 - RNA, 4543 nt, Artificial Sequence
  Cas9 variant mRNA product
gggagagucccgcagucggcguccagcggcucugcuuguucgugugugugucguugcaggccuuauucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5878 - RNA, 3619 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5879 - RNA, 4480 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5880 - RNA, 3562 nt, Artificial Sequence
  Cas9 variant mRNA product
gggagagucccgcagucggcguccagcggcucugcuuguucgugugugugucguugcaggccuuauucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5881 - RNA, 4318 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5882 - RNA, 4351 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5883 - RNA, 3484 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5884 - RNA, 3562 nt, Artificial Sequence
  Cas9 variant mRNA product
gggagagucccgcagucggcguccagcggcucugcuuguucgugugugugucguugcaggccuuauucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5885 - RNA, 3568 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5886 - RNA, 3268 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5887 - RNA, 3679 nt, Artificial Sequence
  Cas9 variant mRNA product
gggagagucccgcagucggcguccagcggcucugcuuguucgugugugugucguugcaggccuuauucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5888 - RNA, 4237 nt, Artificial Sequence
  Cpf1 variant mRNA product
gggagagucccgcagucggcguccagcggcucugcuuguucgugugugugucguugcaggccuuauucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5889 - RNA, 4216 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5890 - RNA, 4530 nt, Artificial Sequence
  Cas9 variant mRNA product
gggagaggcgcugccuacggagguggcagccaucuccuucucggcaucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5891 - RNA, 5313 nt, Artificial Sequence
  Cas9 variant mRNA product
gggagaggcgcugccuacggagguggcagccaucuccuucucggcaucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5892 - RNA, 3585 nt, Artificial Sequence
  Cas9 variant mRNA product
gggagaggcgcugccuacggagguggcagccaucuccuucucggcaucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5893 - RNA, 4653 nt, Artificial Sequence
  Cas9 variant mRNA product
gggagaggcgcugccuacggagguggcagccaucuccuucucggcaucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5894 - RNA, 3729 nt, Artificial Sequence
  Cas9 variant mRNA product
gggagaggcgcugccuacggagguggcagccaucuccuucucggcaucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5895 - RNA, 4590 nt, Artificial Sequence
  Cas9 variant mRNA product
gggagaggcgcugccuacggagguggcagccaucuccuucucggcaucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5896 - RNA, 3672 nt, Artificial Sequence
  Cas9 variant mRNA product
gggagaggcgcugccuacggagguggcagccaucuccuucucggcaucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5897 - RNA, 4428 nt, Artificial Sequence
  Cas9 variant mRNA product
gggagaggcgcugccuacggagguggcagccaucuccuucucggcaucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5898 - RNA, 4461 nt, Artificial Sequence
  Cas9 variant mRNA product
gggagaggcgcugccuacggagguggcagccaucuccuucucggcaucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5899 - RNA, 3594 nt, Artificial Sequence
  Cas9 variant mRNA product
gggagaggcgcugccuacggagguggcagccaucuccuucucggcaucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5900 - RNA, 3672 nt, Artificial Sequence
  Cas9 variant mRNA product
gggagaggcgcugccuacggagguggcagccaucuccuucucggcaucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5901 - RNA, 3678 nt, Artificial Sequence
  Cas9 variant mRNA product
gggagaggcgcugccuacggagguggcagccaucuccuucucggcaucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5902 - RNA, 3378 nt, Artificial Sequence
  Cas9 variant mRNA product
gggagaggcgcugccuacggagguggcagccaucuccuucucggcaucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5903 - RNA, 3789 nt, Artificial Sequence
  Cas9 variant mRNA product
gggagaggcgcugccuacggagguggcagccaucuccuucucggcaucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5904 - RNA, 4347 nt, Artificial Sequence
  Cpf1 variant mRNA product
gggagaggcgcugccuacggagguggcagccaucuccuucucggcaucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5905 - RNA, 4326 nt, Artificial Sequence
  Cpf1 variant mRNA product
gggagaggcgcugccuacggagguggcagccaucuccuucucggcaucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5906 - RNA, 4582 nt, Artificial Sequence
  Cas9 variant mRNA product
ggggcgcugccuacggagguggcagccaucuccuucucggcaucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5907 - RNA, 5365 nt, Artificial Sequence
  Cas9 variant mRNA product
ggggcgcugccuacggagguggcagccaucuccuucucggcaucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5908 - RNA, 3637 nt, Artificial Sequence
  Cas9 variant mRNA product
ggggcgcugccuacggagguggcagccaucuccuucucggcaucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5909 - RNA, 4705 nt, Artificial Sequence
  Cas9 variant mRNA product
ggggcgcugccuacggagguggcagccaucuccuucucggcaucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5910 - RNA, 3781 nt, Artificial Sequence
  Cas9 variant mRNA product
ggggcgcugccuacggagguggcagccaucuccuucucggcaucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5911 - RNA, 4642 nt, Artificial Sequence
  Cas9 variant mRNA product
ggggcgcugccuacggagguggcagccaucuccuucucggcaucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5912 - RNA, 3724 nt, Artificial Sequence
  Cas9 variant mRNA product
ggggcgcugccuacggagguggcagccaucuccuucucggcaucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5913 - RNA, 4480 nt, Artificial Sequence
  Cas9 variant mRNA product
ggggcgcugccuacggagguggcagccaucuccuucucggcaucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5914 - RNA, 4513 nt, Artificial Sequence
  Cas9 variant mRNA product
ggggcgcugccuacggagguggcagccaucuccuucucggcaucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5915 - RNA, 3646 nt, Artificial Sequence
  Cas9 variant mRNA product
ggggcgcugccuacggagguggcagccaucuccuucucggcaucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5916 - RNA, 3724 nt, Artificial Sequence
  Cas9 variant mRNA product
ggggcgcugccuacggagguggcagccaucuccuucucggcaucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5917 - RNA, 3730 nt, Artificial Sequence
  Cas9 variant mRNA product
ggggcgcugccuacggagguggcagccaucuccuucucggcaucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5918 - RNA, 3430 nt, Artificial Sequence
  Cas9 variant mRNA product
ggggcgcugccuacggagguggcagccaucuccuucucggcaucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5919 - RNA, 3841 nt, Artificial Sequence
  Cas9 variant mRNA product
ggggcgcugccuacggagguggcagccaucuccuucucggcaucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5920 - RNA, 4399 nt, Artificial Sequence
  Cpf1 variant mRNA product
ggggcgcugccuacggagguggcagccaucuccuucucggcaucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5921 - RNA, 4378 nt, Artificial Sequence
  Cpf1 variant mRNA product
ggggcgcugccuacggagguggcagccaucuccuucucggcaucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5922 - RNA, 4484 nt, Artificial Sequence
  Cas9 variant mRNA product
gggagagucccgcagucggcguccagcggcucugcuuguucgugugugugucguugcaggccuuauucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5923 - RNA, 5267 nt, Artificial Sequence
  Cas9 variant mRNA product
gggagagucccgcagucggcguccagcggcucugcuuguucgugugugugucguugcaggccuuauucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5924 - RNA, 3539 nt, Artificial Sequence
  Cas9 variant mRNA product
gggagagucccgcagucggcguccagcggcucugcuuguucgugugugugucguugcaggccuuauucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5925 - RNA, 4607 nt, Artificial Sequence
  Cas9 variant mRNA product
gggagagucccgcagucggcguccagcggcucugcuuguucgugugugugucguugcaggccuuauucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5926 - RNA, 3683 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5927 - RNA, 4544 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5928 - RNA, 3626 nt, Artificial Sequence
  Cas9 variant mRNA product
gggagagucccgcagucggcguccagcggcucugcuuguucgugugugugucguugcaggccuuauucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5929 - RNA, 4382 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5930 - RNA, 4415 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5931 - RNA, 3548 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5932 - RNA, 3626 nt, Artificial Sequence
  Cas9 variant mRNA product
gggagagucccgcagucggcguccagcggcucugcuuguucgugugugugucguugcaggccuuauucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5933 - RNA, 3632 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5934 - RNA, 3332 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5935 - RNA, 3743 nt, Artificial Sequence
  Cas9 variant mRNA product
gggagagucccgcagucggcguccagcggcucugcuuguucgugugugugucguugcaggccuuauucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5936 - RNA, 4301 nt, Artificial Sequence
  Cpf1 variant mRNA product
gggagagucccgcagucggcguccagcggcucugcuuguucgugugugugucguugcaggccuuauucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5937 - RNA, 4280 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5938 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5939 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5940 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5941 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5942 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5943 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5944 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5945 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5946 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5947 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5948 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5949 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5950 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5951 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5952 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5953 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5954 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5955 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5956 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5957 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5958 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5959 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5960 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5961 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5962 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5963 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5964 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5965 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5966 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5967 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5968 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5969 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5970 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5971 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5972 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5973 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5974 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5975 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5976 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5977 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5978 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5979 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5980 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5981 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5982 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5983 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5984 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5985 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5986 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5987 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5988 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5989 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5990 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5991 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5992 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5993 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5994 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5995 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5996 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5997 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5998 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 5999 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6000 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6001 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6002 - RNA, 4433 nt, Artificial Sequence
  Cas9 variant mRNA product
gggagagucccgcagucggcguccagcggcucugcuuguucgugugugugucguugcaggccuuauucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6003 - RNA, 5216 nt, Artificial Sequence
  Cas9 variant mRNA product
gggagagucccgcagucggcguccagcggcucugcuuguucgugugugugucguugcaggccuuauucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6004 - RNA, 3488 nt, Artificial Sequence
  Cas9 variant mRNA product
gggagagucccgcagucggcguccagcggcucugcuuguucgugugugugucguugcaggccuuauucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6005 - RNA, 4556 nt, Artificial Sequence
  Cas9 variant mRNA product
gggagagucccgcagucggcguccagcggcucugcuuguucgugugugugucguugcaggccuuauucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6006 - RNA, 3632 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6007 - RNA, 4493 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6008 - RNA, 3575 nt, Artificial Sequence
  Cas9 variant mRNA product
gggagagucccgcagucggcguccagcggcucugcuuguucgugugugugucguugcaggccuuauucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6009 - RNA, 4331 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6010 - RNA, 4364 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6011 - RNA, 3497 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6012 - RNA, 3575 nt, Artificial Sequence
  Cas9 variant mRNA product
gggagagucccgcagucggcguccagcggcucugcuuguucgugugugugucguugcaggccuuauucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6013 - RNA, 3581 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6014 - RNA, 3281 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6015 - RNA, 3692 nt, Artificial Sequence
  Cas9 variant mRNA product
gggagagucccgcagucggcguccagcggcucugcuuguucgugugugugucguugcaggccuuauucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6016 - RNA, 4250 nt, Artificial Sequence
  Cpf1 variant mRNA product
gggagagucccgcagucggcguccagcggcucugcuuguucgugugugugucguugcaggccuuauucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6017 - RNA, 4229 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 6018 - RNA, 51 nt, Artificial Sequence
  NLS2 variant
auggcgccgaaaaagaaaaggaaagugggaauacacggggugccggcggcg

SEQ ID NO: 6019 - RNA, 48 nt, Artificial Sequence
  NLS4 variant
aaaaggccagcggcaacaaaaaaggccgggcaagcgaaaaaaaaaaag

SEQ ID NO: 6020 - RNA, 4107 nt, Artificial Sequence
  Cas9 variant
auggauaagaaguacagcaucggacuagacaucggaaccaacucagucggaugggccgucauaacggacgaauacaaaguaccgucgaagaaauuuaaaguacuaggaaacaccgaccgccacagcaucaagaaaaaccugaucggugcccuacuauucgacuccggagagaccgcagaagccacucgacucaaaaggaccgccagacgacgauacacacgccgcaaaaaccggaucugcuaccuccaagagaucuucucaaaugagauggccaaaguagacgacucguuuuuccacagacuagaggaaaguuuccuggucgaggaagacaagaaacacgagcgacacccaauauucggcaacauagucgacgaggucgcguaccacgaaaaauaccccacaauuuaucaccuacggaaaaagcucgucgauuccaccgacaaggcagaccucaggcugaucuaccuagcccucgcccacaugauuaaauuccgaggacacuuccucauugagggagaccucaacccugacaacucggacguagacaaacuauucauucaacugguacagacguacaaccagcuauucgaagaaaaccccauaaacgccuccggggucgacgcuaaagccauacucuccgcgagacuuucaaaaagccggcgccucgaaaaccucauagcccaacuacccggagaaaagaaaaacggccuauuuggcaaccucauagcccuaucgcuaggacuuacaccaaacuucaagucaaacuucgaucuggccgaagacgccaaacuacaacucagcaaagacaccuaugacgacgaccuagacaacuuacuagcacagaucggagaccaguaugcugaccucuucuuggccgcgaagaaccugagcgacgcaauacuucucuccgauauccuaagagucaauacggagaucaccaaggccccucuaagcgccagcaugauaaagcgcuacgacgaacaccaucaagaccucacccuccucaaagcacucguuagacagcagcuccccgagaaauacaaggagaucuuuuucgaccaauccaaaaacgguuacgccggguacauagacggaggggccucacaagaagaguucuacaaguucauuaaacccauccucgagaagauggacggaacggaagaacuacuggucaaacucaacagagaagaucuccuacgcaagcaaagaaccuucgauaacggcagcauaccccaucaaauccaccucggagaacuacaugcaauccucaggcgccaagaagacuucuacccauuccuaaaagacaaccgagaaaagauagagaaaauacucacuuuccgaauaccauacuacgucgggccacucgcacgcggcaacucaagauucgcauggaugacccgcaaauccgaagaaaccaucaccccguggaacuucgaggaagucgucgacaaaggagccucagcccaguccuucaucgaacggaugacaaacuucgauaagaaccuccccaacgaaaagguacucccgaagcacagucuccucuacgaguauuucaccguauacaaugaacugaccaaaguaaaguacgugacugaaggcaugagaaagccagcguuccuaaguggggagcaaaagaaagcaaucgucgaccuacucuucaaaaccaacagaaaggucacaguaaagcaacuuaaagaagacuacuucaagaagaucgaaugcuucgauuccguagaaauuucgggaguagaggaccgauucaacgccagccuaggcaccuaccacgaccuacuaaaaauaauuaaagacaaagacuuucuagacaacgaggaaaacgaagacauacuagaagacauaguacuaacgcucacccuuuucgaggaccgcgaaaugauagaagaaagacuaaaaaccuacgcucaccuauucgaugacaagguaaugaaacaguuaaaacggcggcgguacaccggaugggggagacucucccgaaagcucauaaauggcauccgagacaaacaaucaggaaagacaauccucgacuucuuaaagagcgacggguucgcgaauagaaacuucaugcagcuaauacacgacgacagucuaacauucaaggaagauauacaaaaagcgcaggucagcgggcagggcgacagccuccacgagcacauagccaaccucgccggauccccagccaucaaaaagggcauucuucaaacugucaaagugguggacgaacugguaaagguaaugggacgacacaaacccgaaaacauagucauugaaauggcccgagaaaaccagaccacccaaaagggacagaaaaauagccgagagcgcaugaaaagaaucgaagagggcaucaaggaacucgggucacagauccuaaaggagcaccccgucgaaaacacacaacuccaaaacgaaaaacuauaccuuuacuaucuccagaacggcagagacauguacgucgaccaagaacuugacaucaaccgccuauccgacuacgacgucgaccacauagugccacaauccuuuuuaaaagacgauagcaucgacaacaaaguccucacacgguccgauaaaaaucgaggcaaaucagauaaugucccgucggaggagguuguuaagaaaaugaaaaacuacuggcgacaacuccucaacgcgaaauugaucacacaaaggaaauucgacaaccucaccaaagcagaacgagggggucucagcgaacuagacaaggcgggcuucaucaaacgccaauuaguagagacgcgacagaucacuaagcacgucgcgcaaauccuagacucacgcaugaacacgaaauacgacgagaacgacaagcucauccgcgaagucaaaguaauaacacucaaauccaaacucguauccgacuuccgcaaagacuuccaauucuacaaggugcgagaaauaaacaacuaccaccacgcucacgacgccuaucugaacgccguuguaggcacggcccucauaaagaaauacccuaaacuugagagugaguucguauacggagacuacaaaguauacgacguccgcaaaaugauagccaaaagcgaacaggaaaucggaaaagcgaccgcuaaauacuuuuucuauuccaacaucaugaacuucuucaaaacugagaucaccuuagccaauggcgagauacgcaaacggccccuaaucgagacaaacggagaaacaggcgaaaucguaugggauaagggacgcgacuucgcuaccgugcgaaagguucucuccaugccgcaggucaacaucguuaagaagaccgaaguccagaccggcggguucagcaaggagagcauccugcccaaaagaaacucagacaagcucauagcccgcaagaaagacugggaccccaaaaaguacggcggcuucgacuccccaaccguagcuuacucaguccucgucguugcgaaaguagagaaaggaaagagcaagaaacucaaaaguguaaaagaacuacugggcauaaccauaauggagagaagcuccuucgagaaaaaucccaucgauuuccuagaagcgaaaggcuacaaagaagucaagaaagaucuaauuauaaaacuucccaaauacucccuuuuugaacuggaaaacggccgaaaacgaauguuggcaagugccggcgaacugcagaaaggcaacgaacucgcgcuccccagcaaguacgucaacuuccuauaucucgcgucgcacuacgaaaaacuuaagggcagccccgaggauaacgagcagaaacaauuguuuguagaacaacacaagcacuaccucgacgagaucauagaacagaucuccgaguucuccaaacgcgugauacucgccgacgcgaaccucgacaaagugcuguccgcguauaacaaacaccgcgauaagccgaucagagaacaagcagagaacauaauucaccuauucacccucacuaaccucggugcgcccgcggcauucaaauauuucgacaccacgaucgaccgaaaaagguacacaagcacgaaagaaguacucgacgccacccugauacaccaauccauaacaggccuauacgagacccgaaucgaucuaagccagcucggcggcgacuga

SEQ ID NO: 6021 - RNA, 4890 nt, Artificial Sequence
  Cas9 variant
augaacuucaaaauccugccaauagcaaucgaccugggcgucaaaaacacgggcguauucagcgccuuuuaccagaaaggcaccucacuggaacgccucgacaacaaaaacggcaaaguauacgagcucagcaaggauaguuacacccuacuuaugaacaaucgcaccgcgcgucggcaccaacgacgcggcaucgaccggaaacagcucgucaagcgccuauucaaacuuauauggacugagcaacuaaaccuagagugggacaaagacacgcagcaagcuaucucauuucuauuuaaccgacgaggauucuccuucaucaccgauggcuauagccccgaguacuuaaacauugucccggaacagguuaaagcaauacucauggacaucuucgaugacuacaacggagaggacgaucucgacagcuaucugaaacuugccaccgaacaagaaagcaagaucuccgaaauuuacaauaaacuuaugcaaaagauacucgaguucaaacuaaugaaacuuugcacagauaucaaagacgauaaagucuccacgaagacccucaaagaaaucacuuccuacgaguucgaacugcucgccgacuaccucgccaauuauuccgagucacuuaaaacgcagaaauucucguacaccgacaaacagggcaaccuaaaagaacuaagcuacuaccaucacgacaaguacaacauccaggaguuccucaagcgccacgcaacaauuaacgaccgcauccuagacacccugcucacugacgaucucgacaucuggaacuucaacuuugaaaaguucgacuucgacaaaaacgaggagaaacugcaaaaucaagaagauaaagaucauauucaggcacaccuccaccauuucgucuucgcggucaacaagaucaaaucggagauggcaucuggaggucgucaccgaucacaauacuuccaggagaucaccaacguccuagacgagaacaaccaucaggagggcuacuugaaaaacuucugcgagaaccugcacaauaagaaauacuccaaccuuucaguuaagaaccuaguuaaccucaucggaaaucucucuaaccuggaacuuaaaccacuccggaaguacuuuaacgacaagauccacgcgaaagccgaccauugggaugaacaaaaguucacggaaacauacugucacuggauccuaggcgaguggcgcgucgggguaaaggaccaggacaaaaaggauggagcgaaauacuccuacaaggaccuaugcaacgagcucaaacaaaagguaacaaaggcuggacucgucgauuuccuucucgagcucgacccaugccgcaccauaccaccauauuuggacaacaacaaccggaagccacccaaaugucagucacuuauccugaaccccaaguuucuagacaaucaguacccuaacuggcaacaauaccuccaggaacucaagaaacugcaaucaauacaaaacuaccuggacucauuugaaacagaccuuaaaguauugaagaguuccaaagaccagcccuacuuuguggaauacaaauccuccaaccaacagaucgcaucaggacaacgcgacuacaaagaucucgacgcucgaauacuccaguuuauauuugacagaguaaaggcaucagacgagcugcuacuaaacgagauauacuuccaggcaaagaaacucaagcaaaaggccagcuccgagcucgaaaaacuugaaagcaguaagaaacucgacgaaguaauagcaaacucgcaauuaucucagauccuaaagucacaacacacgaauggcaucuucgagcaaggcaccuuccuucaccuugucugcaaauacuacaagcagcgccaacgcgcaagagacagcagacuguacauaaugccagaguaccgcuacgacaagaaacugcacaaauauaacaacacugggagauucgacgaugauaaccaacuccucacauauugcaaccacaagcccagacagaaaagauaccaacuccugaacgaccucgcaggcguucugcaagucucgcccaacuucuugaaggacaaaauaggcuccgacgacgaccuguucaucagcaaguggcucguugagcacauccgcggcuucaagaaagcaugcgaagacagccuuaaaauacagaaagacaaccgaggccuucuaaaccacaagaucaacauugcccggaacaccaagggcaaaugcgaaaaagagaucuucaaccuuauuugcaagauagagggguccgaggacaagaaagguaacuacaaacauggacuggcauacgaacuggggguccuacucuucggcgaaccaaacgaagcaagcaaaccggaguucgaucgcaaaauaaagaaguucaacucaaucuacuccuucgcccaaauccaacaaauugcguucgccgaaagaaaaggcaacgccaacacaugcgcuguaugcagcgcagacaacgcccaccgcaugcagcagauuaaaaucacggagccaguggaagacaauaaggacaaaaucauccugucugccaaggcacaaaggcuacccgcaauccccacacgaaucguagacggcgcgguuaagaaaauggcgaccaucuuggccaagaacauuguugacgacaacuggcaaaacaucaagcaaguucucucggccaaacaccaacuacauauuccaauuauaacggagucaaacgccuucgaguucgaaccagcacuagccgaugugaaaggcaaaucuuuaaaggacaggcggaagaaagcacucgaacgcauuucccccgaaaauaucuucaaggacaaaaacaaccgcaucaaggaauuugcuaaggggauauccgcauacuccggcgcgaaccuuacagacggcgacuuugauggcgccaaggaggaacuagaccauauuaucccacgaagccacaagaaauacggcacccucaacgacgaagcaaaucucaucugugucacccgcggagacaacaaaaacaaagggaaccggauauucugccuccgcgaccuagcggacaacuauaaacucaagcaauucgagacaacggaugaccucgaaauugagaaaaagaucgccgacaccauuugggacgcaaacaaaaaggacuucaaauuuggaaacuaccggagcuucaucaaucuuacuccccaagaacaaaaggcuuuccgccacgcacucuuccuagcggacgaaaacccgaucaaacaggcaguuauaagagccaucaacaaccgcaaccgcaccuuugucaacggcacccaacgcuacuucgcggaaguacuagcaaacaauauauaccuacgcgccaaaaaggaaaaccuaaacacugacaaaauauccuucgacuacuucggcaucccaaccaucggcaacggcagaggaaucgccgaaauacgccagcuauaugaaaaaguggacagcgacauucaggccuacgccaagggcgacaagccccaggccucuuacucucaccucaucgacgccaugcucgcguucugcauagcggccgacgaacaccgaaacgacgguuccauaggccuugagauagacaaaaacuacucacuauacccacuagauaaaaacaccggcgaaguauucacuaaagacaucuucucacaaaucaaaauaaccgacaacgaguucuccgauaaaaagcucguccgcaagaaagcgauagaaggcuucaacacccaccggcagaugacucgagaugguaucuacgccgaaaacuaccucccuauccuaauucacaaggaacuuaacgaaguccgcaagggauacacuuggaagaacuccgaagaaauaaaaaucuucaagggcaaaaaguaugacauccaacagcucaacaaccucgucuacugccuaaaguucgucgacaaaccgaucagcaucgacauccaaaucagcacgcuggaagaacuccgaaacauauuaacgaccaacaacaucgccgccacggcggaauauuauuacaucaaccuuaagacucaaaaacuucacgaauacuacauugagaacuacaacacugcccucggcuacaagaaauacucuaaagagauggaguuccuccgcucccucgccuaucggucggaacgaguaaaaauuaaauccaucgacgacgucaaacaggugcucgacaaagacucgaacuucaucauaggcaagauaaccuuaccauucaaaaaggaauggcaacgccuguaucgcgaauggcagaacaccaccaucaaagacgauuacgaguuccuaaaaucauucuucaacgucaaaucuauaacuaagcuacacaagaagguacgaaaagacuucucccuacccauaucgacaaacgaaggcaaauucuuagucaaaagaaaaaccugggauaacaacuucauauaccagauuuugaacgacucagacucccgagcggacggaaccaaaccguucauuccagccuucgauaucuccaagaaugaaauugucgaagcaaucauugacuccuuuaccuccaaaaacaucuucuggcuccccaagaacaucgaacuacagaaaguagacaacaaaaacaucuuugcaauagacacguccaaaugguucgaaguggaaacccccagcgaccuccgcgauaucggcauugcuacaauccaauacaaaauugacaacaacucccgcccaaaagugcgcgucaagcucgacuaugucauagacgaugacuccaagaucaacuauuucaugaaccacagccuccuaaaauccagauaucccgacaaggucuuagaaauccucaaacaaucaaccaucauugaguucgaaagcagcgguuucaacaaaaccauaaaagagaugcucggcaugaagcuggccggcauauacaacgagacaucuaacaacuga

SEQ ID NO: 6022 - RNA, 3162 nt, Artificial Sequence
  Cas9 variant
augaaacgcaacuacauccuaggccuagacauaggcaucaccagcgucggauacggaaucauagacuacgaaacccgugacgucaucgacgccggugugagacucuucaaagaagccaacgucgaaaacaaugaggggcgccgcucaaaacgcggagcccgccgccucaagagaagacgacgucaccgcauccaacgcgugaagaaacuacuauucgacuauaaccuacucacagaccacucggaacucucaggaauaaaccccuacgaagcccgcgucaaaggacucucacaaaaacuaagcgaggaggaguucuccgccgcccugcuccaccuggccaaacgccgaggcguucacaacgucaaugaagucgaagaagacaccggaaacgaacucucaacgaaagagcagaucagccgcaacuccaaagccuuggaagagaaguacguggcagagcugcaacuggaacgacugaaaaaggacggcgaaguacgcggcuccaucaacagauucaaaacaucagacuacgucaaggaggcaaagcaacuacuaaaagugcaaaaagcguaucaccaacuagaccagagcuucaucgacaccuacaucgaccuucucgaaaccagacggaccuacuacgaaggaccaggcgagggcagccccuucggauggaaggacauaaaggaaugguacgaaaugcugaugggccacugcacguacuucccugaggaacugcggucgguaaaguacgcauacaaugccgaccuauacaacgcccucaacgaccucaacaaccucguaaucacgcgagacgaaaacgagaagcucgaauacuacgagaaguuccaaaucauagagaacgucuuuaaacaaaagaagaaaccaacucuuaaacaaaucgccaaagagauucuaguuaacgaagaagacauaaaaggauaccgggugacaucaacgggaaagcccgaguucacuaaccucaaaguguaccacgacauuaaagauaucaccgcacguaaagaaaucaucgaaaaugccgaacuccucgaccaaaucgccaagauacuaacgauauaccaauccucagaagacauccaagaggaacuaaccaaccucaacagcgaacugacacaagaagagaucgagcagaucagcaaccucaagggcuacacagguacccacaaccugucccucaaggcuaucaaccuaauccuagacgagcuguggcacacaaacgacaaccaaauagccauauucaaccgccuuaagcucguucccaagaaaguugaccuaucgcaacaaaaggagaucccaacgacccuagucgacgacuucauacucagcccaguugucaaacggaguuuuauacaaagcaucaaggucauaaacgcaaucaucaagaaauacggccucccaaacgacauaauaaucgagcuagcccgcgagaaaaacaguaaagacgcccagaaaaugaucaacgaaaugcaaaagaggaacagacaaaccaacgaacgcauagaggaaauaauaaggacaaccggcaaagaaaacgcaaaauaccuaaucgagaaaaucaaacuacacgacaugcaagaaggcaaaugccuauacucccucgaagcaaucccccuagaggaccuccucaauaacccauucaacuacgaagucgaucacauaaucccccgcagcguaucauucgacaacuccuucaacaacaagguccugguaaaacaagaggagaacuccaagaaaggaaaccgaacccccuuccaguaccucagcagcucagacaguaaaaucagcuacgaaaccuucaagaaacauauccucaaccucgccaaagggaaaggccgcauaaguaaaacuaaaaaggaauaccuacucgaagaacgagauauaaaccgcuucucaguucaaaaagacuucauaaaccgaaaccucgucgacacacgauacgcaacccgcggccugaugaaccuccuacgcuccuacuuccgugugaacaaccuagacguaaagguuaaaagcauuaauggcggcuucacgaguuuccuacgcagaaaauggaaguucaagaaagaacgcaacaaaggcuacaaacaccacgccgaggacgcccuaaucaucgcaaaugcugacuucauauucaaagaguggaagaaacucgacaaagcaaagaaaguaauggaaaaccagauguucgaagaaaaacaggccgaaucaaugccggaaauagagacagaacaagaauauaaagaaaucuucaucacaccccaccagauaaaacacaucaaagacuucaaagacuacaaauacucccaccgcgucgacaagaaaccaaaccgcgaacuaauaaacgacacccucuacuccacacgaaaagacgacaaaggcaacacacuaaucguaaacaaccuuaacggccucuacgacaaagacaacgacaaacuaaagaaacucaucaacaaaagcccagagaaacuacuaauguaccaccacgacccgcagacauaccaaaaacuaaaacucaucauggaacaauacggcgacgagaaaaacccgcucuacaaguacuacgaagaaaccggaaacuaccucaccaaauacaguaagaaagacaaugggcccgugaucaagaaaaucaaauacuacggaaauaaacucaacgcccaccuugacaucaccgacgacuaccccaacagccgaaacaaagucgucaaacuaucccuuaaaccguaccgcuucgacgucuaccucgacaauggcguauacaaauucgucacagucaagaaccuugacguuauaaagaaagaaaacuacuacgaagucaacuccaaaugcuacgaggaggcgaagaaacucaagaaaauaagcaaucaggccgaguucauagccucguucuauaacaacgaccucaucaaaaucaacggagaacucuacaggguaaucggggugaauaacgaccuccugaaucggaucgaaguaaauaugauagacaucaccuaccgagaauauuuagaaaacaugaacgacaaacgcccaccaagaauaaucaaaaccauagcaagcaaaacccaguccaucaagaaauacuccacagacauacuuggaaaccucuacgagguuaaauccaagaaacacccgcagaucaucaagaaaggcuga

SEQ ID NO: 6023 - RNA, 4230 nt, Artificial Sequence
  Cas9 variant
augcuuuucaacaaaugcauaaucauuucaaucaaccucgacuucagcaacaaagagaaaugcaugaccaagccauacuccaucggccuagauaucggcaccaauucgguagguugggcggucauaacagacaauuacaaaguaccauccaagaaaaugaaaguucuagguaacacaagcaagaaauauauaaagaaaaaccuacucgggguccuccuguucgacucuggcauaaccgcagagggccgacggcuaaaacgaacagcgcgucgcagguacacccgccgcagaaaccgcauacuguaccuacaagaaaucuucucgacggagauggccacgcuagacgacgcauucuuccaacgcuuggacgacuccuuccuagugcccgaugacaaacgggacuccaaauacccgauuuucggcaaccucguggaagagaaaguguaccacgacgaguuccccacaaucuaucaccuacgcaaauaccucgccgacuccacuaagaaagcagaccucagauuggucuaccuugcccucgcccacaugauaaaauaccggggucacuuccugauagaaggugaguucaacuccaaaaauaacgacauucagaaaaacuuucaagacuuucucgacaccuacaacgccaucuucgaaagcgauuugucccucgaaaacucaaaacaacuagaggaaaucgucaaagacaaaauuuccaaacuggagaaaaaggaccgaauccucaaacucuuuccgggugaaaagaacuccggaauauucuccgaguuccucaaacucauagucggaaaccaggcagacuuccgcaaaugcuucaaucucgacgaaaaagcaucguuacauuucaguaaagaaagcuacgacgaagaccuugaaacucucuuaggcuacaucggggaugacuacagcgacguauuccugaaagccaagaaacucuacgaugcaauacuucucuccggcuuccugaccguaaccgauaacgaaaccgaagcaccacuuuccagcgcaaugaucaagcgauauaacgaacacaaggaagaccucgcacuacugaaggaguauauaagaaacaucucgcuaaagacuuacaacgaagucuucaaggacgacaccaaaaacggguacgcuggcuacaucgacggcaaaacaaaccaggaagacuucuacgucuaccugaaaaacuugcucgcagaguucgaaggagcagacuacuuccuagagaaaaucgaccgcgaagauuuccuccgcaaacaacgaacauucgacaacggcuccaucccguaccagauucaccuacaggaaaugcgagccauacucgacaagcaggcaaaguucuaccccuucuuagccaaaaauaaggaacggaucgagaaaauccuuacuuuccguauccccuauuacgucggcccacucgcaaggggcaacuccgacuucgccugguccauccgcaagcgcaacgagaaaaucacccccuggaacuucgaagacgucaucgacaaagaauccucagccgaggcguuuauaaacaggaugacuuccuucgaccuuuaccuacccgaagaaaaaguccucccaaagcacucccuccucuacgaaacauucaacgucuacaacgagcucacaaaagugcgauucaucgccgaauccaugcgggauuaccaauuccuagacagcaaacagaaaaaggacaucgugagacucuacuucaaagacaaacgcaaagucacagacaaggauauaauagaauaccuccacgcgauauauggcuacgacgguaucgaacuaaagggcaucgaaaagcaauuuaacuccucccugucaacauaccacgaucugcuaaauaucaucaacgauaaggaguuccucgaugacaguagcaaugaagccaucaucgaagaaauaauccauacucuaaccauauucgaagaucgugagaugaucaaacaacggcucagcaaguuugagaacauauucgauaagagcguucucaagaaacugucacgccgucacuauacuggguggggcaaauugucagccaaacucaucaacggcauccgcgacgaaaaauccggcaacacaauccuugacuaucucaucgacgacgggauaaguaaccgcaacuucaugcagcuuauacacgaugaugcgcuguccuucaagaagaaaauccagaaagcacaaauaauaggcgacgaggacaaaggaaacaucaaagagguuguaaagagcuuaccaggcucccccgccaucaaaaagggcauccuacaaagcaucaaaauuguggacgaacucgugaaagugaugggaggaagaaaacccgaguccauugucguggaaauggcucgugagaaccaauauaccaaccaaggcaaguccaacucgcagcagcgccuaaaacgucuggaaaaguccuugaaagaguuaggauccaaaauccucaaagaaaacauccccgccaaacuguccaaaaucgauaacaaugcccugcagaacgaccgccuguaccucuauuaccugcaaaacggcaaggacauguacacgggggacgauuuggacauagaccgauuaucuaacuacgacaucgaucacauaaucccccaggcauuccucaaagacaacagcaucgacaacaaggugcuaguaucauccgccucaaaccgcggcaaaagcgacgacuuuccaucccuagaagucguaaagaaacgcaaaacauucugguaccaacuccucaaaagcaaacuaaucucccaacgcaaauuugacaacuuaacgaaggccgaacgggguggcuuacugccagaggacaaagcaggauucauccagcgccaacugguggaaacccgccaaaucaccaaacacguggcgcgacuccuagacgaaaaguucaacaacaagaaggacgagaacaaccgggccguucgcacggucaagauaauaacccugaaguccacccuagucucccaauucaggaaagacuucgagcuguacaaaguacgcgaaauaaacgacuuccaccacgcacacgacgcguaucucaacgccguaaucgcuagcgcguugcucaaaaaguaccccaagcucgagccagaguucgucuacggcgacuaccccaaauacaacucguuccgugaaaggaaguccgccacugaaaaagucuacuucuacucuaacaucaugaacaucuucaaaaaguccauuagcuuggccgacgggcgcguaauagaacgaccacucauagaagucaacgaagagacgggggaaagcguauggaacaaggaaagcgaccucgccacaguacgcagaguacugagcuacccccaaguaaacgucgucaaaaaggucgaagaacaaaaccacggacuagaucgcggaaaacccaagggccucuucaacgcaaaccuauccagcaagccaaagcccaauagcaacgagaaccuaguaggagcgaaagaguaccuugacccuaaaaaguacggcggcuaugccggcaucuccaacagcuucgccgugcugguaaaaggcaccauugaaaaaggcgccaagaagaaaaucacgaacguccucgaguuccaaggcauaagcauacucgaccggaucaauuaucgaaaagacaaacuaaacuuccuccuggagaaaggauacaaagacaucgaacuaauaauagaacucccgaaguauucacucuuugaacucucggacggaagccggcggaugcucgccuccauacucagcacaaacaacaaacggggagaaauccacaagggaaaccaaauauuccuaucacagaaguuuguuaaacugcuguaccacgcgaaaagaauauccaauaccaucaacgaaaaccaccguaaauacguagaaaaccacaagaaagaguucgaagaacuguucuacuacauucuggaguucaacgaaaacuacguaggcgcaaagaaaaacggcaaacuccuuaacuccgccuuccagagcuggcaaaaccauagcauagacgaacuuuguuccuccuucaucggccccaccgggagcgagagaaaaggccuguucgaacucacgucccgcggcuccgcagcugauuucgaguuccucggcguaaaaauaccgcgcuaccgcgacuacacgcccuccagccuacucaaagacgcgacucucauucaucaaucgguuaccgggcuauacgagacacgcaucgauuuggccaaacuuggagaaggauga

SEQ ID NO: 6024 - RNA, 3306 nt, Artificial Sequence
  Cas9 variant
augugguacgcuucccuuauguccgcacaccaccuacgcguaggcauagacguuggcacccacagcgugggccucgccacccuucgcgucgacgaccacggcacccccaucgagcuacucuccgcacugucccauauccacgacagcggaguaggcaaagagggcaagaaagaccacgacaccagaaagaaacucuccggaauugcccgccgagcacggcgccugcuccaccacagacggacacaacuccagcaacucgaugaagugcuacgggaccugggauuucccaucccaaccccaggggaguuccuggaccucaacgaacaaacagacccguaccguguauggagagugcgcgcccgucuagucgaagaaaaacugcccgaagaacuccgcggaccggccaucucgauggcgguacgccacaucgcaagacaccgggguuggaggaacccauacucgaaggucgaaucccuacucagcccggcagaagaaucccccuucaugaaagcacuacgugagcgcauacucgcaaccaccggagaaguacucgacgacggcauaacaccugggcaagccauggcccaaguggcacucacacacaacauuaguaugcgcggacccgaaggaauccuaggaaaacuucaccaguccgacaacgcgaacgaaauucgaaaaaucugcgcacggcagggcguaagcccagacgucugcaagcaacugcuaagagcugucuuuaaggcagauuccccgcgcggguccgcgguuagucgaguagcccccgacccacuuccgggccagggcagcuucagacgagcccccaagugcgaccccgaguuccaacgauuccgaauaaucucuauaguagcuaaccuccgaauaagcgaaaccaaaggcgaaaacagaccucuaacagcagacgaacgccgacacgucgucaccuuccucacugaagacucccaagcagaucuaaccuggguagacguagccgaaaaacuaggagugcacagacgcgaccuccgcgguaccgccguccacacagacgacggcgaaagaucagccgcaagacccccaaucgacgcgaccgacagaaucaugagacaaacaaaaauauccucccucaagacuuggugggaagaagcagacucagaacaacgaggcgcaaugauccgcuaccuuuacgaagaccccacggauuccgaaugcgcggaaauaaucgcagaacuccccgaagaagaccaagcgaagcucgacucacuacaccuccccgccggcagagcagccuacagucgggaaagucuaacagcacuaucugaccauaugcuagcaacaacagacgaccuucacgaagcccgaaagcgacucuucggagucgacgacucgugggccccaccagccgaagcaaucaacgcccccguggggaacccgagcguagacagaacccuaaaaaucgucggacgauaccucagugccguagaaagcauguggggcacaccagaggucauccacgucgaacacguccgcgauggcuucaccucagaacggauggccgacgaacgugacaaagcgaaccgacgacgauacaacgacaaucaagaggcaaugaagaaaauacaacgcgacuacggcaaagaagguuacaucagucgaggggacaucguacgcuuagacgcacucgaacuacagggcugcgccugccuguacugcggaaccaccaucggcuaccauacaugucaacucgaucacauagugccacaagccggaccaggauccaacaaccgcagaggaaaucucgucgcaguaugcgaacgauguaacagaucaaaauccaacaccccauucgcaguaugggcacaaaaaugcggcaucccacacgucggcgugaaagaggccaucggcagaguacgcgguuggcguaaacaaacgcccaacacauccucagaagaccuuacccgccuaaagaaagaaguaaucgcucgauuacgcagaacgcaagaagacccagagaucgacgagcgaagcauggagucaguagcauggauggccaacgaacugcaccacagaaucgccgccgcauacccggagacuaccgucauggucuacagaggcuccaucacggcagcagccagaaaagcugcagggaucgacagcaggaucaaccucaucggcgaaaaaggcagaaaagaccgcauagaccgacgacaccacgccguagacgccucggugguagcacucauggaggccagugucgcaaaaacacucgcagaacgcaguuccuuacguggggagcaacgacucaccggaaaggaacaaaccuggaagcaguacacagguagcaccguuggagccagggaacacuuugagauguggcgcggacacaugcuacaccucacugaacuauuuaacgaacgacucgcagaggacaaagucuacguaacacaaaacaucagacuccgucuuagcgacggcaacgcacacaccgucaacccaucgaaacuggucucacaccgacucggggacggucugacgguccagcaaaucgaccgcgccuguacaccagcgcucuggugugcccuaacaagagaaaaagacuucgacgaaaagaacgggcuccccgcacgcgaagacagggccauccgagugcacggccacgaaaucaagucauccgacuacauucaagucuucucgaaacgaaagaaaaccgacuccgaccgugacgagacaccauucggcgccaucgcggucaggggcggcuucguugaaaucggcccuuccauacaccacgcccguaucuaccgggucgaaggaaagaaaccggucuacgcgaugcuuagggucuucacccacgacuuacuaucacagcgacacggagaccuauuuagcgccgucauacccccacaauccauaucaaugaggugcgccgaacccaaacuaagaaaagcaauuaccaccggcaacgcgaccuaccuagguuggguagucguaggggacgaacuagagauaaacguugauuccuucaccaaauacgccauaggcagauucuuagaagacuuucccaacacaacccgcuggcgaaucugcggguacgacaccaacucaaaauuaacccuaaaacccaucguacuagcagccgaaggccuagagaaccccucaagcgcaguaaacgaaauugucgaacucaaaggcuggcggguagcaaucaacgucuuaacuaagguccacccaaccguagugcgccgcgacgcacucggaagaccaagauacagcucacgaagcaaccuaccgacauccuggacaauagaauga

SEQ ID NO: 6025 - RNA, 4167 nt, Artificial Sequence
  Cas9 variant
augaccaaacccuacucgaucggccuggauaucggaaccaacucggucgggugggcggucacgacagacaacuacaaagucccuuccaaaaagaugaaaguccugggaaacacgagcaagaaguacaucaagaagaaccuacuaggcguucuccuauucgauucaggaaucacugcagaggggcgccgccugaagcgcacugcgcgucggcgguauacgcgacgccgcaacagaauccucuaccuccaagagaucuucuccaccgagauggcuacucuggacgacgcauucuuccagcgacuggacgacuccuuccucgucccagacgacaagcgcgacuccaaauauccaaucuuuggcaaccucguagaagaaaaagccuaccacgacgaguuccccacgauuuaccaucucagaaaguaccuagcggauuccacgaagaaggccgaccugcgacugguauaucucgcucuggcgcacaugauaaaauaccguggacacuuccugauugaaggcgaguucaauagcaaaaauaacgacauacagaaaaacuuccaagacuuccuggacaccuacaaugcaaucuucgaauccgaucuuucacucgaaaacuccaaacaacucgaagaaauagugaaggauaaaauauccaagcucgagaaaaaggaucguauacucaagcuauuccccggggagaaaaacucgggcauuuucagcgaguuccucaaacuuaucguuggcaaccaagccgacuucagaaagugcuucaaccucgacgaaaaagcaucccuccacuucuccaaagaaucuuacgacgaggaucucgaaacccuccucggguacaucggggacgacuacucugacgucuuccucaaagcaaagaaacucuacgacgcuaucuuacuaucaggcuuccugacagucaccgacaacgaaaccgaggcgccccuauccucagcuaugaucaaacguuacaacgaacacaaagaagaccucgcacuacucaaagaguacauccgcaacauuagucucaaaaccuacaacgaagucuuuaaagacgauaccaaaaauggauaugcaggauacauugauggcaaaacuaaccaggaagacuucuacgucuaccucaagaaacuauuagcggaguucgaaggagcagacuacuuccucgagaaaaucgaccgcgaagauuuucugcgcaaacaaaggaccuucgacaaugguuccaucccguaccaaauccaucugcaggagaugcgagcuauucuggacaagcaagcaaaauucuacccguuccucgcaaagaacaaagaacggaucgagaaaauccuaacguuucgaaucccauauuauguaggacccuuagcgcgcggcaacagcgacuucgccugguccauaagaaaacgcaacgagaaaauuaccccauggaauuucgaagauguaaucgacaaagaaucaucagccgaggcuuuuauaaaccggaugaccaguuucgaccucuaccuacccgaagaaaagguccugcccaagcacaguuugcucuaugaaacguucaacguauacaacgaauuaacuaaagugcgauuuaucgccgaaaguaugcgggacuaccaauuccucgauuccaaacagaaaaaggacauuguccgccucuacuucaaagacaaacgaaagguaaccgacaaagacauaaucgaauaucuccacgccaucuacggcuacgacggcauagaacuaaaaggcaucgaaaaacaguucaacaguucccucucaaccuaccacgaccuccucaacauaaucaacgacaaggaguuccucgacgacucgucuaacgaagcgaucaucgaagaaauaauacacacacucaccauauuugaagaccgcgaaaugauaaaacaacgccucucgaaauucgaaaauaucuucgacaaaagcguucucaaaaagcuauccaggcgacauuacaccggcuggggcaaacucagugcuaaacuuauaaacggcauccgugacgagaaaagcggaaauacaauccuugacuaccucaucgacgaugggauaagcaaccguaauuuuaugcaacuuauacacgacgacgcgcuaucguucaagaagaaaauccaaaaagcccagaucaucggugacgaagacaaaggcaacaucaaagaagucgucaagagccucccgggcucucccgccauaaagaaaggcauacuccagucuauaaaaaucgucgacgagcucguaaaaguuaugggcggucgcaaacccgaauccauagucguagaaauggcacgagaaaaccaguacacaaaucaagggaaaagcaacagccaacaaagacugaaacggcucgagaagagucucaaggagcugggguccaaaauccucaaggagaacauaccagcuaaacucuccaaaaucgacaacaacgcccuccaaaacgacaggcuuuaccuguacuaccuccaaaacgggaaggauauguacacaggcgacgaucucgacauagaccgucucagcaacuacgacauagaccacaucaucccucaggccuuccuuaaagauaauucgaucgacaacaaggugcucgucuccuccgccuccaaccgcggaaaauccgacgacgucccaagccuggaggucgucaaaaagcgcaagaccuuuugguaccaacuccucaaauccaaacucaucagccaaaggaaguucgacaacuuaaccaaggcagaacgcggaggccuguccccggaggacaaagccggguuuauacagcgccaacuggucgagacccgccaaauaacgaaacacgucgcccgacuacuagacgaaaaguucaacaacaagaaagacgagaacaaccgagccguaaggacggucaaaaucaucacccuaaaaucaacgcucgucucacaguuccggaaagacuuugaacuauauaaagugcgcgaaauuaacgacuuccaucacgcccacgacgccuaccuaaacgccguugucgcaucugcccuauugaagaaauacccuaaacuagaaccggaguucguauacggagauuauccuaaauacaacaguuuccgugaacgcaaaucagcaacagagaaaguuuacuucuacaguaauaucaugaacaucuucaagaaaagcauaagccuagcagaugggcgagugaucgaacgaccccucaucgaaguaaaugaggaaaccggugaguccgucuggaauaaagaaucggaucucgcgaccgucaggcgagugcucagcuacccacaagucaacguagucaagaaaguagaggagcaaaaccauggacucgacagaggaaaaccuaaaggacucuucaacgccaaccucucaucgaaacccaaaccaaacucgaacgagaaccucgucggugcaaaagaguaccucgaucccaaaaaguacggcggcuacgccggaaucucuaacucauucacaguauuaguaaaaggaaccaucgagaaaggugcgaagaagaaaaucaccaacguccuagaguuccaaggaauaucaauacucgaccgaauuaacuacaggaaagacaaacucaacuuccuacucgaaaaaggauacaaagauauagaacuaaucaucgaacugccaaaauacucccucuucgaacucagcgacggaucucgaagaaugcucgcaucaaucuuguccaccaacaacaaacgaggagaaauacacaaaggcaaccagaucuucuuaucccagaaauuugucaaguuacucuaccacgcgaaacgaaucucaaacacaauaaaugagaaccaccggaaauacguugaaaaccacaagaaagaguucgaagaacuguuuuacuacauacucgaguucaacgaaaacuacguaggcgcgaagaaaaacggcaaacuccuaaacucugcauuccaaagcuggcaaaaccacucaauagacgaacuaugcagcuccuucaucggcccaaccgguucagaacgaaaaggccuuuucgaacucaccuccagggggucggcggcugacuucgaguuccuaggcgucaagaucccccgcuaccgagauuauacgcccagcagccucuuaaaggacgcgacgcucauacaccaaagcguaacgggacuguacgaaacccgaaucgaccucgccaaacuaggggagggcuga

SEQ ID NO: 6026 - RNA, 3249 nt, Artificial Sequence
  Cas9 variant
auggcagcguuuaaaccgaauagcaucaacuauauacucggccuagacauuggaaucgccuccgucggaugggcaaugguggaaaucgacgaagaagaaaacccaauccgacucaucgaccuaggcguccgugucuucgaacgcgcagaaguacccaaaaccggugacagucucgcaauggcgagaagacucgcccgaagcguccggcgccugacgcgacgacgagcccaccgacuccuacgcacccgacgacugcugaaacgagaaggaguccugcaagcugccaacuucgacgagaacggccuaaucaaaucacuacccaacaccccuuggcaacuacgcgccgccgcccucgaccgaaaacuaacgccccuugaaugguccgccguacuacuccaccuaaucaaacaccgcggguaccucagccaacggaaaaacgagggugaaaccgccgacaaagaacucggagcccuacucaaaggcguugccggcaacgcgcacgcccugcaaacaggcgacuuccgcacaccagcggaacucgcccucaacaaguucgagaaagaguccggccacauucgcaaccagcgcuccgauuacucccacaccuucagcagaaaggaccuccaagccgaacuaauauuacuguucgaaaaacaaaaagaguucggcaauccacacgucagcggcggccuaaaagaaggcaucgaaacccuccuaaugacccaacgacccgcccuaucgggagacgcuguacagaagaugcuaggacacuguacauucgaacccgcagagccgaaagcagccaagaacaccuacaccgccgagagauucaucuggcucacaaaacuaaacaaccuaagaauccuggaacaggggagugaacgcccgcucacggacaccgagcgggcaacccuaauggacgagccguacagaaaauccaaacuaacauacgcccaagcccgcaaacuccuaggcuuagaagacacagccuucuuuaaaggauuacgcuauggcaaagacaaugcugaagcaagcacacuuauggaaaugaaagcauaccacgccaucucccgagcccucgaaaaagaggggcugaaagacaagaaaagcccacuuaaccucagccccgaacuacaagaugaaauagggacagccuucagccucuucaaaacagacgaggauauaaccggccgauuaaaagaccgaauccaacccgaaauacuggaggcacuccucaaacacaucucguucgauaaauucguacagauaagccugaaagcccuaagacgaauaguuccgcucauggaacaaggaaaacgcuacgacgaagcgugcgcugagauauacggagaccacuauggcaaaaagaacacggaagagaaaauauaccuaccgcccauaccagcagacgaaauucgcaaccccgucgugcuccgagcgcugagccaagcccgaaagguaauuaacggaguagugcgacgcuacggaagcccagcgagaauacacauagaaaccgcacgcgaggugggcaagagcuucaaagacagaaaagaaaucgaaaaacgccaagaggaaaaccgcaaggaccgcgaaaaggccgcagccaaauuccgcgaguacuuccccaacuucgucggagaacccaaaucaaaggacauccuaaaacugcgacuguacgaacaacaacacggaaaaugccuauacagcggcaaggaaaucaaccucgggcgccucaacgagaagggcuacgucgaaaucgaccacgcacucccauucucccgcacaugggacgacucguucaacaacaaaguccuaguacugggaagcgaaaaucaaaacaagggaaaucaaaccccauacgaguauuucaauggcaaagauaacagccgagaauggcaagaguucaaagcaagaguagaaacaagccgcuucccacgcucaaagaagcaaaggauucuccugcaaaaauucgacgaagacggcuuuaaagaaagaaaccucaacgacacuagauacguaaaccgauuccuaugccaauucguagccgaccgaaugagacugaccgggaaagggaagaaacgaguguucgccuccaacggacaaaucaccaaccuacuacgaggcuucuggggccuccggaaagugcgcgcagaaaacgacagacaccacgcccuggacgccguagucguagcaugcucuacgguagccaugcaacaaaagaucacaagauucguucgguacaaagaaaugaaugccuucgacggcaaaacgauagacaaagaaacaggcgagguacuccaccagaaaacccacuucccccaaccaugggaguucuucgcacaagagguaaugaucagaguguucgggaaacccgacggcaaacccgaguuugaagaagccgacacccucgaaaaacuccgaacauuacuagcggagaaacuauccagucgacccgaagcuguccacgaauacgugacgccccuguucgucagccgcgcacccaaccgcaaaaugagcggacaaggccacauggagaccguaaaaagugcaaaaagacuagacgaggggguaagcguccuacgcgucccucuaacccaacuaaaacuaaaggacuuagagaaaaugguaaaccgugaaagagaaccaaaacuauacgaggcgcugaaggcaaggcuagaagcccacaaagacgaccccgccaaagccuucgccgaaccauucuacaaguacgacaaggcaggaaaccgcacacagcaaguaaaggccguaagagucgagcaaguacagaaaaccggggucuggguccggaaccacaacggcauagccgacaacgcaacaaugguccgaguggacgucuucgagaaaggcgacaaguacuaccucguccccauauacuccuggcaaguagcgaaaggaauccucccagaucgggcgguugugcaaggcaaagaugaagaagacuggcaacucaucgaugacagcuuuaacuucaaauucucccuacaccccaacgaucucguagaagugaucacgaagaaagcccgcauguuuggcuacuucgccaguugccaccgcggaacuggaaauaucaacaucagaauacacgaccuggaccacaaaaucggcaaaaacgguauuuuagaaggaauaggcguaaaaaccgcccucucauuccaaaaauaccaaauagacgagcugggcaaagaaauccgcccaugccgccucaagaaacgcccaccuguacgcuga

SEQ ID NO: 6027 - RNA, 4005 nt, Artificial Sequence
  Cas9 variant
augaagaaacccuacacgaucggccucgacaucgggacgaacagcguggggugggccgugcucaccgaucaauacgaccucgucaaacgaaaaaugaaaauagcgggcgacagugagaagaaacaaauaaagaaaaacuuuuggggcguacgucucuucgaugaaggacaaacggccgcagacaggcgaauggcccggacggcacgcagacgcauagaacgccgccggaaccgcaucuccuaccuccaaggcaucuucgccgaggaaaugucaaaaaccgacgccaauuucuuuugccggcucagcgacagcuucuacgucgacaacgagaaaaggaauagccgccaccccuuuuucgccaccaucgaagaagaaguggaauaucacaaaaacuacccaacaauuuaccaucuccgagaagaacuggugaacuccucggaaaaagccgauuuacgacugguauaucuagcccuggcucacaucauaaaauaccgagggaacuuccucaucgaaggggcccucgacacacaaaacacgucaguagaugggaucuacaaacaauucauccaaacguacaaccaaguguuugcuagcggcaucgaagacggcucccucaaaaagcuggaagacaacaaggacgucgccaaaauucugguagagaaaguaacccgcaaggaaaaacucgaacgcauccuaaaacucuacccgggcgaaaagucagcaggaauguucgcacaauucauaucacucaucguggggagcaaaggcaacuuccaaaagccguucgaccuuaucgaaaagagcgacaucgaaugcgcgaaagacuccuacgaagaggaccucgaaucccuacuugcccucaucggugacgaauaugcagaacuuuucguagccgccaaaaacgccuacagcgcggucgugcucucuucgaucaucacaguggcagaaacggagaccaacgcgaaguuaagugcaagcaugauagaacgcuuugacacacaugaagaagaccuaggcgaacuaaaagcguucauaaaguuacaccuccccaagcacuacgaagaaauauucucgaacacagagaaacacggcuacgccggcuacauagacggcaaaacaaaacaggcggacuucuacaaauacaugaagaugacgcucgagaacauugaaggcgcggacuacuucauugcgaaaaucgagaaggaaaacuuccucaggaagcagagaaccuuugauaauggcgccaucccccaccagcuacaccuugaggaacuagaggcgauccugcaccagcaggcaaaguacuaccccuuccuaaaagaaaacuaugacaagaucaagucgcugguaaccuuccgcaucccguacuucgucgggccccucgcaaacggccaauccgaguucgcauggcucacccggaaggcagacggggaaauucgacccuggaacaucgaagaaaaagucgacuuugggaaguccgccgucgacuuuaucgagaaaaugacuaacaaggauacauaccuuccaaaagaaaacguccuccccaagcauucgcucugcuaccagaaauaccuaguauacaacgaacucacaaagguccgcuacauuaacgaucaagggaaaacuagcuacuucagcgggcaagaaaaagaacagaucuucaacgaccucuucaagcaaaagcgaaaaguaaagaagaaggaccucgaacucuuccuacgcaacaugucccacgucgaaucccccaccauagaaggccucgaggacaguuucaacuccucauacucgacguaucacgaucuacuaaagguggggauaaagcaagaaauccucgauaacccagucaacaccgaaaugcucgagaacauaguuaaaaucuuaaccgucuucgaagacaagcgcaugauaaaagaacaacuccaacaauucagcgacgugcuagauggaguaguccucaaaaagcuagaaagaagacacuacaccggcugggguagacuaucggcaaagcuacugauggggaucagagauaagcagucacaccucacaauauuggauuaucucaugaacgacgacggccucaacaggaaccugaugcagcuuaucaacgacagcaaccuaucauuuaagagcauuauagaaaaagaacagguaaccacagcagacaaggacauacagagcauaguagcagaccuggcgggaagcccagcuaucaaaaagggcauacugcagagcuuaaaaauaguagacgagcuaguaucgguuaugggcuacccaccacaaaccauaguagucgaaauggcgcgggaaaaccaaaccaccggaaaaggcaaaaacaauucccggccaagguauaaaagccucgaaaaggccaucaaagaauuuggcagucaaauucucaaggaacaccccaccgacaaccaagaacuccgaaacaaccggcucuaccuguacuaccuucaaaacggaaaagacauguauaccggacaggaccucgacauacacaaccucucaaacuacgacaucgaccacaucgucccccaaucguuuauaaccgacaacagcaucgacaaccuaguccucaccuccagcgcaggaaaccgcgaaaagggagacgacgucccaccccuugaaaucgucagaaaacgcaaggucuucugggaaaaacucuaucaaggaaaccuaaugucaaaaagaaaauuugacuaccugacgaaagccgagcgcgguggccucaccgaggccgacaaagcccguuucauccauagacaacuugucgaaacaagacaaaucaccaaaaauguagcaaacauccuccaccagcgcuucaacuacgaaaaagacgaccacggcaacacaaugaaacaagugcgcaucgugacacuaaaaucagcacuugugagccaguuucgcaaacaauuccagcucuacaaaguacgggacguuaaugacuaccaucaugcgcacgacgcauaccugaacggcgucguggccaauacccuccucaaaguauauccccaacucgaaccggaguucgucuacggagacuaccaccaauucgacugguuuaaagcaaacaaagccacagcaaagaaacaauucuacacgaacauaaugcuauucuucgcccagaaagaccgaaucauagacgaaaacggagaaauacucugggauaagaaauaccuggacacugucaagaaagucauguccuaccgccaaaugaacaucgucaagaaaacggaaauucaaaaaggagaguucagcaaagccaccaucaaaccgaaaggcaauucaucaaaacuaauccccaggaaaaccaacugggacccgaugaaauacggagggcucgacucccccaacauggccuacgcagucgucauagaauacgcgaaagggaaaaacaagcucgucuuugaaaagaagauaauacgaguuaccaucauggaacgaaaagccuuugaaaaagacgaaaaagcauuucuagaagaacagggauaccggcaaccaaagguccuugcaaaacucccaaaguacacacuauacgaaugcgaggaagguaggaggcgaaugcucgccagugccaacgaggcccagaaaggcaaucaacaagugcugcccaaucaccucgugacccuauugcaccacgccgccaacugcgaaguuucagacggcaagucacuagacuauaucgagagcaaucgggaaauguucgcagaacuacuagcccacgucucugaguucgcaaagcgauacacccucgcggaagcaaaccuaaacaaaaucaaccaauuauucgaacagaacaaagaaggagacaucaaggcaauagcccagagcuucguggaucuuauggcauucaacgccaugggggcaccggcaucauucaaguucuuugagacaacuaucgagaggaaaagauauaacaacuuaaaagagcuccugaacuccacaaucaucuaccaauccauaacaggccuguacgaaagccggaaacgacuagacgacuga

SEQ ID NO: 6028 - RNA, 4038 nt, Artificial Sequence
  Cas9 variant
augaaaaagcccuacucaauaggacucgacaucggcacgaacagcgucgggugggcggucgucacggacgauuacaaagugcccgccaagaagaugaaaguccuaggaaauacggacaaaucccacauagagaaaaaccuucucggugcacuccuguucgacagcggaaauacggcagaagaccgacggcucaagcguacagcucggcgccgauacacccggcgcagaaacaggauccucuaccuacaagaaauauucucagaagagaugggcaaaguggaugacucauucuuucaccgcuuagaagauucauuucucguaaccgaagacaaacgcggagaacggcacccaauauuuggaaauuuagaagaggaagucaaguaccacgaaaacuuccccacaauauaccaucugcggcaauacuuagccgacaacccggaaaaaguggaucuccgucuagucuaccuggcacuugcucacauaaucaaauuccgcggacacuuccugaucgaggguaaauucgacacucggaacaacgacguccagagauuauuccaggaauuucucgccguauacgacaacaccuucgagaacagcagucuucaggagcagaacguacagguggaagaaauacucaccgacaaaaucagcaagagcgcgaagaaagaucgcguccugaaacuauucccgaacgaaaagucuaauggccgauucgcggaauuucugaaacucaucgucgguaaccaagccgacuucaagaaacacuucgaacucgaagagaaagcaccccuucaauucuccaaggacaccuacgaagaggagcucgaagugcuacucgcacaaaucggcgacaacuacgccgaacucuuuuuaucagccaagaaauuauacgacuccauccuucuaucaggcauccucaccguaacggacguaggcacaaaagcucccuugucugcuagcaugauacagcgcuacaacgaacaccaaauggaccuagcacaacugaaacaauucauccgccaaaaacugagcgacaaauacaacgaagucuucucagacguuucaaaagacggcuaugcaggcuacaucgauggcaaaacaaaccaggaggccuucuacaaauaucugaagggccuacuaaacaaaaucgaaggcuccggauacuuccuagauaaaaucgaaagagaagacuuccuccgcaagcagcgcacauucgacaacgggagcaucccacaccaaauacaccuccaagaaaugcgagcaaucauccgucgacaagcugaguucuacccuuuccucgccgacaaccaagaccgcaucgaaaaacuccucaccuuccgaauaccauauuacgucggcccccuugcaaggggaaaauccgacuuugccugguuaucaagaaaaucggcggacaaaauuacccccuggaauuuugacgaaauugucgacaaagaaaguuccgccgaagccuucauaaaccgcaugacuaacuacgaccuuuaccuuccgaaccagaaaguacuaccgaaacacagucuccucuacgaaaaauucaccgucuacaacgaacucacaaagguaaaguacaaaaccgaacaagguaagacagcauucuuugacgccaacaugaaacaagaaaucuucgacggugucuucaagguauaucgaaaaguaacaaaagacaaguugauggauuuccuggaaaaagaguucgaugaguuccgcaucguagaccucacaggccuagacaaagaaaacaaaguguucaacgcgagcuauggaacguaccacgaucuguguaagauucucgacaaagauuuccuagacaauagcaagaacgagaaaauccucgaagacaucguccuaacucuuacacuguuugaagaccgcgaaaugauccggaaacgacuagaaaacuacagcgaucugcuaacaaaagaacaagucaagaaacuugaaagaagacacuacaccggcuggggucgcuuaucagcggaacucauccauggcauucgaaacaaagaaagccgcaagaccauccucgacuaucugaucgacgacggaaacucaaaccggaacuucaugcagcuaaucaacgacgacgcacucuccuuuaaagaagaaauagccaaggcccaggucaucggcgaaacagauaaccuuaaccagguagucuccgacauugccggcucuccugcuaucaaaaagggaauccuccagagucucaaaaucgucgacgagcuaguaaaaaucaugggccaccaacccgaaaacauagugguugaaauggcacgcgagaaccaauucacaaaccaagggcgccguaacucgcagcaacggcucaaaggccuaaccgacuccauaaaagaguucggaagccagauccuaaaagaacacccaguggaaaacucccaacuccaaaacgaucgccucuuucucuacuaccuacagaacggccgggacauguacaccggagaggaacucgacauugacuaccucucgcaauacgacaucgaccacauaaucccacaggccuucaucaaagacaacuccaucgacaaccgcgugcuaacauccuccaaagaaaaccgcggaaaauccgacgacguccccucaaaagacguuguccgaaaaaugaaaagcuauuggagcaagcuacugagcgccaaauuaaucacacaacgcaaauucgacaacuugaccaaagccgaacggggcggacucacagaugacgacaaggcaggcuucaucaaaagacaacugguugagacacgacagauuaccaagcacguugcgcgaauccucgacgaacgcuucaacacagaaacugacgagaacaacaagaaaauccgucaagucaaaaucgugacccuaaagucgaaccucgucagcaacuuccguaaagaguucgaacucuacaaaguacgcgagaucaaugacuaccaccacgcccacgaugccuaccuaaacgcggucaucggcaaggcacuacuaggaguguauccccaacuggaaccggaguucguguacggcgacuacccccacuuucacggccacaaagaaaacaaagccacggccaaaaaguucuucuacucaaacaucaugaauuucuucaagaaagacgacguacgcaccgacaaaaauggagaaauaauauggaaaaaggacgaacacaucuccaacauuaagaagguccuuuccuacccacaggucaauaucguaaagaagguagaggagcaaaccggcggauucucaaaagaauccauccugcccaaaggaaacucggauaagcucauaccccgaaaaaccaaaaaguucuacugggacaccaaaaaguacggaggcuucgacagcccaaucguggccuacuccauccuagucauagcggacaucgaaaagggaaaaagcaagaaacuaaaaacagucaaagcucucgucgggguaacaauaauggagaaaaugaccuucgaacgagaccccguagcauuccucgaacggaaaggguaccgcaauguccaagaagagaacaucaucaaacuacccaaguauagccuguuuaaacucgagaacggccgcaagcgacuccuagccuccgcccgggaguuacaaaaggguaacgagauuguccucccaaaccaccucgguacucuccuauaccacgccaaaaacauccacaaaguagacgagccaaaacaccuagacuaugucgacaaacacaaagacgaauuuaaagaacuacucgacguaguaaguaauuucuccaagaaauacacccuugcagaaggaaaccucgagaaaaucaaagaacucuaugcacaaaacaauggggaggaccugaaagaacucgcauccucauucaucaacuuacuaaccuucacagccaucggggcccccgcaaccuucaaauucuucgacaagaacaucgaccggaagcgauacacgucuacuacagaaauucugaaugcuacgcucauccaccaaaguaucaccgggcuauacgaaacccgaaucgaccuuaauaaacuaggaggcgacuga

SEQ ID NO: 6029 - RNA, 3171 nt, Artificial Sequence
  Cas9 variant
augcaaacaacaaaccucuccuacaucuugggacucgaccugggcaucgcuucugucgggugggcuguuguagaaaucaacgaaaacgaagacccaauaggccucaucgacguagggguccgcaucuucgagagggcagaggucccaaaaacaggagaaucacuagcacuuuccaggcgccucgcaagguccacccggagacucaucagacgccgcgcccaccggcuccuacucgccaagcgguuccuaaaacgcgaaggcauccuauccaccauagaccucgagaaagggcuaccaaaccaagccugggaacuucgcguggcgggccucgaaaggcgacuaagcgccauagaguggggcgccguccuucuacaccucaucaagcaccgcgguuaccuaaguaaaaggaagaacgaaucccagaccaacaacaaagaacucggagcgcuccucagcggggucgcacaaaaccaccaacuccuacaauccgacgacuaccgcacccccgcggagcucgcgcucaagaaauucgccaaagaggaaggacacauucguaaccaacggggcgccuacacccacacguucaaccgacucgaccuacuugcagaacucaaccuacucuucgcgcaacagcaccaguucggcaauccacacuguaaagaacacauccagcaguauaugacagaacuccucauguggcagaagcccgcccucucaggagaggcaauacuaaagaugcugggcaaaugcacgcacgaaaagaaugaguucaaagcagcaaaacacaccuacagcgccgaacgcuucguauggcuaacaaaacucaacaaccuccgcauccuagaggacggcgcagaaagggcccuuaacgaagaggagcgacaacugcugauaaaccaccccuacgagaaaucaaaacucacguacgcucagguccgaaaacuccuaggacuauccgaacaggccauauucaagcaccucagguacaguaaggaaaacgccgaauccgcgacauucauggaacucaaggcauggcaugccauccggaaagcccucgaaaaccaagggcuaaaagacacauggcaagaccuggccaaaaagccagaccuccuggaugaaaucggcacagccuucucgcucuacaagacagacgaagacauacaacaguaccuaaccaacaaaguaccgaacucagugaucaacgcccuauuaguaucacuaaacuucgacaaauucaucgaacugucccuaaaaucccuacgcaaaauccuaccgcuaauggagcaagguaaacgguaugaccaagccugcagagagaucuacggacaucacuacggggaagccaaccagaaaacaucucaacuccucccugcuauccccgcccaagaaauccguaaccccgucguacuacgcacauuaagccaagcccgaaaggucauaaacgcaaucauccgucaauacggauccccagcacggguccauaucgaaacuggcagagaacucggcaaguccuuuaaagaacgccgcgaaauccaaaaacaacaggaagauaaccgcacaaaacgggagagcgcaguucagaaauucaaagagcuauucuccgacuucucaagugaaccaaaaucaaaagacauacuaaaguucaggcucuaugaacaacagcacgguaaaugccuuuacucaggcaaggaaaucaacauccaccggcuaaacgaaaaaggguacguagagaucgaccaugcacuaccauucucgcgcacuugggacgacucauucaacaacaaaguucuaguccuggcaucggaaaaucaaaacaaaggcaaccaaaccccauacgaguggcuacagggaaaaauaaauagcgaaagauggaagaacuucguggcccugguacucgguucacaaugcucagcagcuaagaaacaacgucuauugacccagguuaucgacgacaacaaauuuauagaucgcaaccuuaacgacacccgguacauugccagauuccuauccaacuacauccaggaaaaccuacuccucguagguaaaaacaagaaaaacgucuucacaccaaacggacagaucacagcccuucucaggucaagguggggccucauaaaagcgagggaaaacaacaaccgacaccacgcacuggacgcaauaguaguagccugcgccaccccuagcaugcaacagaaaaucacaagauucauucgauuuaaagaagugcaucccuacaaaaucgaaaaccgauacgaaaugguagaccaagaaagcggagagauaaucagcccccacuucccagaaccgugggccuauuuccgucaagaagucaacauaagaguguucgacaaccacccugacacaguccugaaagaaaugcucccagaucgcccccaagccaaccaccaauucguacaaccccucuuugucucccgcgcaccgacuaggaaaauguccggccaaggacacauggagaccauuaaauccgcgaagcgccucgcugaaggaauuaguguccuacggaucccacuaacacaacucaaacccaaccuacuagaaaacaugguaaauaaagaacgcgaacccgcccuauacgcaggacucaaagcccgccuagccgaguucaaccaagaccccgccaaggcuuucgccacuccauucuauaaacaaggcggacagcaaguaaaagcuaucagaguagaacaaguacagaaauccggcguccuaguccgggagaacaauggagucgccgacaacgcaagcauaguacgcaccgacgucuucauuaaaaacaauaaauucuuccucguccccaucuauacauggcaagucgcgaaagggauccuccccaacaaagcaaucgucgcgcacaaaaacgaggacgaaugggaagaaauggacgaaggagcaaaguucaaauucagucuauuccccaacgaccuaguagagcugaaaacuaaaaaggaguacuucuucggguacuacauaggccucgaccgcgcuacaggaaacaucucccucaaagaacacgacggggagauaagcaaaggaaaagacggcguuuaccgugugggcgucaaacuagcacuaucuuucgagaaauaccaagucgaugaacucggcaaaaaucggcaaaucugccgaccccaacagcgccaaccggucagguga

SEQ ID NO: 6030 - RNA, 3249 nt, Artificial Sequence
  Cas9 variant
auggccgccuucaaacccaacccaaucaacuacauccuaggccuggacaucggaaucgccuccguagguugggccaugguggaaaucgacgaagacgaaaacccaaucugccuaaucgaccugggaguccgcguauucgagcgagcugaaguccccaaaaccggugacucccuugccauggcucggcggcucgcgcgcagcguacgccgacugacccgccguagagcacacagacuacuacgcgcacgacgccuacucaaacgcgaaggaguccugcaagccgcagacuucgacgaaaacggacuaaucaaaucccuaccaaacacaccauggcaacuccgagcagcagcccuagauagaaaacucacgccucuggaguggagcgcgguacugcuccaccugauaaaacacagaggguaccuaucacaacgaaagaacgaaggcgagaccgccgacaaagaacucggugccuuacuaaaaggcgucgcagauaacgcacacgcucuacaaaccggggacuuccgaaccccagccgagcuggcacucaacaaauucgaaaaggagagcggacacaucagaaaccaacgaggagacuacucacacacguucucuagaaaggaccuccaggcggaauugauucuccuguucgaaaagcaaaaagaguucggcaacccgcacgucagcggaggccuaaaagaaggcauagaaacccuacucaugacccagcgaccagcgcuaagcggcgacgccgugcagaaaaugcucggccacugcacguucgaaccagcagaaccgaaggcggccaaaaacacuuacacggcagagcgauucauauggcuaacaaagcugaacaaccuacgcauacuagaacaaggcagugaaaggccucucaccgacacagaaagggccacgcuuauggacgagcccuacagaaaaagcaaacuaacauacgcacaagcacggaaacuacucgggcuggaagacacggcauucuucaaaggucuccgguacggaaaggacaacgccgaagccuccacacucauggaaaugaaagccuaucacgccaucucgagagcgcuagaaaaggaaggccucaaggacaaaaagagcccacucaaccucagcccagaacuccaagacgaaaucggcacagcauucucacucuucaagacggaugaagacauaaccgggcgccuaaaggaccggauacaaccggaaauccucgaggcccuccuaaaacacaucuccuucgacaaauucguccaaauaucacuaaaagcccuacgacgcauagucccccuuauggagcaaggcaaaagauacgacgaggcgugcgccgagaucuacggagaccauuacggcaagaaaaacacugaagagaaaauuuaucucccacccauacccgcagacgaaauaagaaacccggucgugcucagggcccucucccaagccagaaaagucaucaauggaguaguccgccgauacggcucaccagcacgcauucacauugaaaccgcccgagaaguaggaaagagcuucaaagaccggaaagaaaucgaaaaacgucaagaagaaaaucgaaaagaccgcgaaaaagcggccgcaaaauuccgcgaauacuuuccaaacuucgugggggaaccaaagucaaaggacauacuaaaacugcgacucuacgaacaacaacaugggaaaugucuguacuccggcaaagaaaucaaccucggacgacucaacgaaaaaggcuaugucgaaaucgaccacgcacugccuuucucacgaacaugggacgacagcuucaacaacaaagugcuaguacuagggucagaaaaccaaaacaaaggaaaccaaaccccauacgaauacuucaacggaaaggacaacagccgggaguggcaagaguucaaagcaaggguagaaacaucacgcuucccacgauccaagaaacaacgcauacuccuacaaaaauucgacgaagacggcuucaaagaacgcaaccuaaacgauacacgcuacgugaacagauuccuaugccaauucgucgcagauaggaugcgucucaccggcaaaggaaagaaacgcgucuucgcauccaacggacaaauaacuaaccugcuccggggauuuuggggccuccgcaaaguccgcgccgagaaugacagacaccacgcccuggacgcagucgugguagcauguucaaccgucgccaugcagcagaaaauaacgagauuugugagauacaaagagaugaaugcauucgacgggaaaaccaucgauaaagaaaccggagagguacuacaucagaaaacacacuucccccaaccaugggaguucuucgcccaagaaguaaugauccgcguguuuggcaaaccagacgggaaaccugaguucgaagaagcggacaccccagaaaaacuacgcacacugcucgcugaaaaacuaucaagcagaccagaagcagugcacgaguacguaacaccacuauucguauccagggcccccaaccgcaaaaugaguggccaaggacacauggagaccgucaaaucagccaaacgccucgacgagggugugagcgugcuccgagugccgcuuacccaacugaaacuaaaagaccucgaaaagauggucaaccgcgaacgcgagccaaagcuauaugaagcacugaaagcacgccuagaggcacacaaagaugaccccgccaaagcguucgcagaaccauucuacaaauacgauaaagccgggaaccgcacccaacaagucaaagccguucgcgucgaacaaguccaaaagacgggcguauggguacgaaaucacaacgggauagccgacaacgccacuauggugcgcgucgacgucuucgaaaaaggcgacaaauacuaccucgucccgaucuauuccuggcaaguugcaaagggaauccugccugaucgcgcugucguacaaggcaaagacgaagaagacuggcaacucaucgacgacagcuucaauuucaaguucagucuccaccccaacgaccuaguagaaguaauaacgaaaaaggcgcggauguucggcuacuucgccagcugccaccgcggcacaggaaauauaaauaucagaauacacgaccuugaccacaaaauaggcaaaaacggaauccucgagggaauuggugucaagacagcgcucuccuuccaaaaauaccaaaucgacgagcucggaaaagagauaagaccuugucgauuaaagaaaagaccgcccguaagauga

SEQ ID NO: 6031 - RNA, 3255 nt, Artificial Sequence
  Cas9 variant
augaaauaccacgucggaaucgacguaggaaccuuuucagucggacucgcggcaauugagguggacgacgccggaaugccaaucaaaacccucagccuggucucucacauccaugauagcggccuugaccccgacgaaauaaagucagcaguaacaagacucgccaguucaggaauagcccggagaacacgccgccuuuaucgacgcaaacgacgaagacuccaacaacucgacaaguucauccaacgacaaggauggccgguaauagaacuagaagacuacucagacccccuauaccccuggaaaguacgagccgaacuagcggcaagcuauaucgccgacgaaaaggaacgcggggagaaacuaucaguagcacuacgacauauagccaggcaccggggauggcguaacccauacgccaaagucagcucguuauaccuaccggacggaccaagugaugcauucaaagcaaucagagaagaaauaaaacgcgcgagcgggcaacccgucccagaaacagcaaccguaggccaaauggucacacucugugaacuggggacacuaaagcuaagaggggaaggaggaguacucucagcgcgacuucaacaaagugacuacgcaagagaaauacaagaaauaugcagaaugcaggaaauaggccaagaacuauaccgcaaaaucauagacguaguauucgcagccgaaucaccgaagggauccgcaaguucgcgaguagggaaagacccacuccaaccgggcaaaaacagagcacugaaggcgagcgacgcguuccagagguauagaauugcggcgcucauaggaaaccuacgcguacgcguggacggagaaaaacgaauacuaaguguagaagagaaaaaccugguguucgaccaccucgucaaccugacaccaaagaaggaaccagaguggguaacaauagccgaaauccucggcaucgaccggggacaacuaauaggcacagcaaccaugaccgacgauggcgaacgagcaggagccaggccaccaacacacgauacaaaccggucgaucgucaauucacgaaucgcgccacucguggacugguggaaaacggcaagcgcucuagaacagcacgccauggugaaagcacucucaaacgcagaaguagacgacuucgacucaccagagggagcaaaaguccaggcauuuuucgcggaccuggacgaugacguccacgcaaaacuagacagucuacaccuccccguggggagagcagcauacagcgaagacaccuuagugcgccucacccgaaggaugcugagcgacggagucgaucuauacacagcaagacugcaagaguucggcaucgaaccauccuggaccccacccacaccccgcaucggagaacccguuggcaauccagccguagaccgaguccuaaaaaccgucagccgauggcuggaauccgcaacaaagacauggggagcacccgaacgcgugaucaucgaacacguacgcgaaggguuuguuacagagaaacgcgcacgcgagauggacggcgauaugagacgacgcgccgcgcgaaacgcaaaacucuuccaggaaaugcaggagaaacugaacguccaaggcaaacccagccgagccgaccucuggcgauaccaaucaguacaaagacaaaacugccaaugcgccuacugcggaagcccgaucacuuucagcaacagcgaaauggaccauauaguaccccgcgcaggccaaggaucaaccaacacccgcgagaaccuaguagcgguaugucacagauguaaccaauccaaaggcaacaccccauucgccaucugggcgaagaacaccagcauagaggggguaagcgucaaggaggccguagagagaacacgccacugggucacagacaccggaaugcgaagcaccgauuucaagaaauucacaaaagccguagucgaacgauuccaacgagcaacaauggacgaggaaauagacgccagauccauggaauccguagcauggauggcaaacgaacuccgcucaagaguagcacagcacuucgcgucccauggcaccacaguaagagucuacagaggcucccuaacagcagaagcacgacgcgcuucaggcauaagugggaaacugaaauucuuugacggaguaggaaagucacgauuggaccgacggcaccaugcgaucgacgccgccguaaucgcauuuacaucagauuaugucgccgagacccuagcaguaagaucgaaccucaaacaaagccaggcacauagacaggaagcgccccaauggcgagaguucacggggaaagacgcagaacaccgagccgccuggagaguauggugccaaaagauggaaaaacugagugccuuacuaaccgaggaccuacgagacgaccgaguggucgucaugucaaacguacggcuaagacuagggaacggauccgcccacaaggaaaccauaggcaaacucagcaaagucaaacucaguagccagcugucagucagcgacauagauaaagcaagcagcgaagcguuguggugcgcacuuacgcgagaacccggcuucgacccaaaagagggacucccugcaaaccccgaacgccacauaagaguaaacggcacacacguauacgcgggagacaauaucggccuauucccagucagcgccggaucgaucgcccugcgcgggggcuacgccgaacucggaagcucauuccaccacgcccgaguauacaagaucacauccggaaagaaaccagccuucgcaaugcugagaguauacacaauugaccuccuccccuacagaaaccaagaucuauuuagcguagaauuaaaaccgcaaacaaugaguaugagacaagcagaaaagaaacuacgcgacgcacuagcgacaggcaacgcagaauaccugggcuggcuuguagucgacgacgagcuagugguggacaccucaaaaaucgcgacagaccaaguaaaagcagucgaagcagaacuaggaacuauacgccgauggcgagucgacggguucuuuagcccuucaaagcugcggcugcgcccacuccaaaugucaaaggaaggcaucaagaaagaaagugcgcccgagcuaucaaaaauaauagacagaccaggguggcucccagcagucaacaaacuauucagcgauggaaaugucaccguaguaagacgggacucacugggccgagugcgacuagaaagcacagcccaccuaccggucacauggaaaguacaguga

SEQ ID NO: 6032 - RNA, 2955 nt, Artificial Sequence
  Cas9 variant
auggcccguauccuagccuucgacaucggcaucuccagcaucggcugggccuucagcgaaaacgacgaacuaaaagacugcggcguucgcaucuucacgaaggucgagaaccccaaaaccggagaaucccucgcccuuccccgaagacucgcccgaucagcacgaaaacgucuggcgcgacgcaaagcgagacucaaucaccugaaacaccuuaucgcaaacgaguucaaacucaauuacgaagacuaucaauccuuugacgaaucacucgccaaagccuacaaagggucucucaucucaccguacgaacuacgauuucgagcccuaaacgaacuccucagcaaacaagacuucgcucgcgugauucuccacauugccaaaagacgcggcuacgacgacaucaaaaacuccgacgacaaagaaaaaggcgcaauacucaaagccauuaagcaaaacgaagaaaaacucgcaaacuaccaaucagucggcgaauaccucuacaaggaauacuuccaaaaauucaaagaaaacagcaaagaguucaccaacgucagaaacaagaaagaaagcuacgaacguugcaucgcccaauccuuccugaaagacgaacuaaaacuaaucuucaaaaagcaacgcgaguucggcuucucauucuccaagaaauucgaagaagaaguccuaagcgucgccuucuacaaacgggcacugaaagacuucucccaccucgugggcaacugcagcuucuuuaccgacgaaaagagagccccgaagaacuccccacuggcauucauguucguagcccucacccguaucaucaaccuccuaaacaacuuaaagaacaccgaaggcauacuauacacgaaagacgaccucaacgcacuccuaaacgaggugcucaaaaacggcacgcucacguacaagcaaaccaagaaacuccucggacucucggacgacuacgaguucaaaggggaaaaaggcacauacuucauugaguucaagaaguauaaagaguucauuaaagcacuaggggaacauaaccucagccaagacgaccugaaugaaauagccaaggacauaacacugaucaaagacgaaaucaagcugaagaaagcacucgccaaauacgaccuaaaccagaaccaaaucgacucccuauccaaacuggaguucaaagaccaccuaaacaucagcuucaaggcucucaaacuggucacaccacucaugcucgaaggaaagaaauacgacgaagcaugcaacgaguuaaacuugaaaguggcaaucaacgaggacaagaaagacuuccugccugcguucaacgaaaccuacuacaaagacgaagucaccaaccccguaguacuaagagcuauaaaagaguaccgaaaaguccucaacgcccucuuaaagaaauacggcaaaguccacaaaauaaacaucgaacucgcacgagaggucggcaaaaaccacagccaacgggcuaaaauagaaaaagaacaaaacgagaacuauaaagcuaagaaagaugcagaacuggagugcgaaaaacucggccugaaaaucaacuccaaaaacauacucaaacuccgccucuucaaagaacaaaaagaauuuugcgccuacagcggcgagaaaaucaaaaucucagaccuacaagacgagaaaaugcuggaaauagaccacaucuaccccuacagccgcagcuuugacgacucauacaugaacaagguucuaguauucacaaagcagaaucaagaaaaacucaaccagaccccguucgaagcauucgggaacgacucagccaaauggcaaaagaucgaaguacucgccaaaaaccucccaaccaagaaacagaaaagaauauuggacaaaaacuauaaagacaaagaacaaaagaacuucaaggaccgaaaccucaaugacacacguuacauagcgcgccucguccucaacuacaccaaagacuaccuugacuuccuaccgcuauccgaugacgaaaacaccaagcucaacgacacccaaaagggcagcaagguccacguggaagcaaagagcggcaugcuaaccagcgcccuccgacacacauggggguucucagccaaagaccgaaacaaccaccuccaccacgcaaucgacgcgguaauaaucgccuacgccaacaacucaauuguaaaggcuuucucagacuucaagaaagaacaggaaucaaacagcgcggaacucuacgcgaagaaaauaucggaacucgacuacaaaaacaaacgcaaauucuucgaacccuucucuggguuccgccagaaagucuuagacaaaaucgaugaaauauucgucagcaaacccgaacgcaagaaacccuccggagcacuacacgaagaaaccuuccgcaaagaagaagaguucuaccaauccuacggcgggaaagaaggcguacuaaaagcccucgagcucggcaaaauacgaaaagucaacggaaaaaucgucaaaaacggagacauguuccgcguagauaucuucaaacacaagaaaaccaacaaauucuacgcaguacccauauacacaauggacuucgcauugaagguccuaccuaacaaggcagucgccagaagcaagaagggagaaauaaaagacuggauccucauggaugagaacuacgaguucugcuucucccucuacaaagacagccugauccuuauccaaaccaaagacaugcaagagcccgaguucguauacuacaacgccuucacaucuagcacaguuagccugauaguguccaaacacgacaacaaauucgaaacccucuccaaaaaccagaagauccucuucaagaacgccaacgaaaaggaaguaaucgccaaaucaaucgggauccaaaaccucaaaguauucgaaaaauacauagucagcgcccucggcgaagucacgaaagccgaguucagacaacgggaagacuucaagaaauga

SEQ ID NO: 6033 - RNA, 3366 nt, Artificial Sequence
  Cas9 variant
augucggacuugguccuaggccuagacauaggcauaggcuccguaggcgucggcauacuaaacaaagucaccggcgaaaucauccacaaaaacucgcgaauuuuucccgcugcgcaggcagagaacaaccuaguccgccgcacgaaccgccaaggccgcaggcucgcccggcgaaagaaacaccgacguguccgccucaaucgccuauucgaggagucaggacuaaucaccgacuucacaaaaaucucuaucaaccugaaccccuaccaguuacgcgucaaaggucuaacagaugaacugucaaacgaggaacuguucauagcccucaaaaacauggugaaacacagaggcaucagcuaccuggacgacgcguccgacgauggcaacuccagcgucggcgacuacgcgcaaaucguaaaagagaacaguaaacaacuugagaccaaaacacccggccaaauccagcucgagcgguaucagaccuauggccaacucagaggagacuucacggucgaaaaagacggcaagaaacaccgccuaaucaacgucuuccccaccucagccuaccguucggaagcccucagaauccuacaaacucaacaagaguucaacccgcaaaucacagaugaauuuaucaaccgcuaccucgaaauccuuaccgguaaacgaaaauacuaccacgggccggggaacgaaaaaucucgcaccgauuacggucgcuaccgaaccaguggcgaaacucuagacaauauuuucggcauccuaauaggcaaaugcacauucuauccagacgaguuccgagccgcgaaagccucauacaccgcccaagaguucaaccuccucaacgaccucaacaaccuaacaguacccaccgaaaccaagaaacuaagcaaagaacagaaaaaccaaaucauaaacuacgucaaaaacgaaaaagcaaugggccccgcaaaauuauucaaauacauagccaaacuccucagcugcgacgucgccgauaucaaaggcuaccguauagauaaauccggcaaagcugaaauccacaccuucgaggcauaccgcaaaaugaaaacacuagaaacccuugacauagaacaaauggacagagaaacccuagacaaacuagccuacguacucacccuaaacacggagagagaagguauccaagaagcgcucgaacacgaguucgcagacgguucuuucagccaaaaacaaguagacgaacucguccaguuccgaaaggcaaacucguccaucuucgggaagggguggcacaacuucagcguaaagcuaaugauggaacucauacccgaauuauaugaaacaucugaggagcagaugaccauccucacccgauuaggaaaacagaaaaccaccaguucauccaacaagacaaaauacaucgacgaaaaacuccucacagaagaaaucuacaacccaguggucgcaaaaagcguacgccaagcaauaaaaaucgucaacgccgcuauaaaggaauacggagacuucgacaacauaguaaucgaaauggcccgagaaaccaacgaagacgacgagaagaaagccauccagaaaauucaaaaagccaauaaagacgaaaaagacgccgccaugcuaaaagccgccaaccaauacaacggaaaagcagagcuuccgcacagcgucuuccacgggcacaagcaacucgcaaccaaaaucagacuauggcaucagcaaggcgagcgcugccuguacacuggcaaaacaauauccauccacgaccucauaaacaacuccaaccaauucgaaguugaccacauacucccacuaagcaucacguucgacgacucccuggcaaacaaaguucuggucuacgcaaccgcaaaccaagaaaaaggccaacgcacaccauaucaagcccuagacuccauggaugaugccuggucguuccgcgaacugaaggccuucguacgcgaaucaaaaacccuaagcaacaaaaagaaagaauaccuacucacugaggaagacauuuccaaauucgacguacgaaagaaauucauagaacgcaaccugguagacacuagauacgcuucccgagucguccuuaacgcuuuacaggagcacuuccgcgcccauaaaaucgacaccaaagucucagucguccgaggccaguucaccucccaacucaggaggcacuggggcaucgagaaaacacgcgacacauaucaccaccacgccgucgaugcucuaaucaucgcagccucaagccaacuaaaccuauggaagaaacagaaaaacacacugguaagcuacuccgaggaccagcuacuagauaucgaaaccggcgagcugaucucagacgacgaauauaaagaaagcguauucaaagcgccauaccaacacuuuguugacacgcucaaaucaaaagaguucgaagacucaauccuauucucguaccagguagacucaaaauucaacagaaaaaucucggacgcaaccaucuacgccacccgccaagcgaaaguagggaaagauaaggccgacgaaacauacguccucggaaagaucaaagauaucuauacacaagacggauacgacgccuucaugaaaaucuacaagaaagacaaauccaaauuccuaauguaucgacacgacccccaaaccuuugaaaaaguaauugaaccaauccuugagaacuacccaaacaagcaaaucaacgagaagggaaaagaggucccaugcaaccccuuccucaaguauaaggaagaacacggcuacauaagaaaauauagcaaaaagggcaacggucccgagauuaaauccuuaaaauacuacgacucaaaacucggcaaccacaucgacaucacacccaaagacagcaauaauaaagucguucuacaaucggucagccccuggcgggccgacgucuacuucaacaagacaaccggaaaauaugaaauccugggccuuaaauaugccgaccuacaauucgagaagggcacgggcaccuauaaaauaucccaagaaaaguacaaugacaucaagaagaaagagggcgucgacucggacucugaguucaaauucacccucuacaagaacgaccuccugcuaguaaaagauacggaaacaaaagagcaacaacuauuucgauuucuaucccggacgaugccaaagcaaaagcauuacguagagcucaagcccuaugacaaacaaaaauuugaaggcggagaagcgcucaucaagguccuuggaaacgucgccaacucgggccagugcaagaaaggacucggcaaauccaacauaagcauauacaaaguacgcacagauguacugggcaaucaacacauuaucaaaaacgaaggcgacaaacccaaauuagacuucuga

SEQ ID NO: 6034 - RNA, 2556 nt, Artificial Sequence
  Cas9 variant
augacaaacggcaagauccuugggcuagacaucggcguagcauccgucggcguaggaauaaucgaggccaaaaccgguaagguaauccacgcaaacagccgacucuucagugcagccaacgcagaaaacaacgcagaacgacgcggcuuccggggcgcccgccgccucacgcgacgcaaaaagcaccgagucaaacgaguacgagaccuguucgaaaaauacgacauccuaacggacuuccgcaaccucaaccuaaaccccuacgaacuccgagucaaaggccuaaccgaacaacucaccaacgaggaacuauuugcagcacuacgcacaauagccaagcgacgcggcaucuccuaccucgacgacgccgaggacgacucaaccgguucguccgacuacgcuaaaucaaucgaugaaaauagacgucuucucaagagcaugaccccgggccagauccaacuagaaaggcuagagaaauacggacaacuacgcgguaacuuuaccguguacgaugaaaacggagaagcccaccgccuaauaaacguauucucaacuagcgacuacaaaaacgaagcacggaaaauacuagaaacgcaaagcaacuacaauaaacaaaucacggacgaguucauugaggacuacauagaaauacucacccagaagagaaaauacuaccacggaccaggcaacgagaagucgcgcacggacuacgggagauuccgcaccgacggcacgacuuuagagaacauauuuggaauacucauuggcaagugcagcuucuacccagaagaauaucgcgcaagcaaagccuccuacaccgcccaagaguucaacuuccucaacgaccuuaacaaccucaaaguccccacagaaacaggcaaauugagcacagaacaaaaagaauaccucguaaacuucgccaaaaacuccaaaacccucggagcaagcaaacuucuaaaagaaauagccaagcuaguagacggcgauguaaaagauaucuccggauaccgagaagacucaaagggaaaaccagaccugcauacauucgagcccuaccgaaaacuaaaguucaaccuaacgaccgucgauaucgacaaccuaagccgagacauacuggacaaacucgccgacauacuaacccuaaacaccgaacgcgaaggaauagaagacgcaaucaaccaaaaccuaccagagcaauuuaccaaagaacaaauauccgaaaucguccagauccgaaaaagccaauccuccgcauucaacaaaggauggcacagcuucagcgccaaacucaugaacgaacucauccccgaguuauacgccaccagugaggaacagaugaccauacugacccgccucgaaaaauucaaagccaccaagaaaagcuccaaaaacaccaaaaccauugacgaaaaagagauaacagacgaaaucuacaaccccguaguggccaaaagcguccgccagacgauaaaaauaaucaacgcggcagucaagaaauacggcgacuuugacaaaauaguaaucgaaaugccccgcgacaaaaacgccgacgacgaaaagaaguucaucgacaagaaaaacaaagaaaacaagaaagaaaaagacgacucccuaaaacgcgccgcauaccuguacaacgggacggacaaacuacccgacgacguauuccauggcaacaaacagcucgcaacaaaaauccgccuuugguaccaacaaggggaacggugccucuacaguggaaagccaauacucauccaggaccucguacauaacagcaacaauuucgaaauugaccacauacuccccuuaucccucagcuucgacgacagccuugccaacaaagugcucguguacgcaugggccaaccaagaaaaagagcagaaaacaccauaucaaguaaucgacagcauggacgccgccuggucauuccgcgaaaugaaagacuacguacucaagcaaaagggcaucggcaagaagaaaagggaauacuuacucaccaccgaaaacaucgauaaaauagaggucaaaaagaaauucaucgaacggaaccuagucgacacccgcuacgccuccagaguaguacucaacucacuacaaacagcgcuaaaagaacucggaaaagacaccaaggucagcguaguccgaggccaguucaccucacaacuacgcaggaaauggaaaauagacaagucccgcgaaacauaccaccaccacgccguagacgcacuaaucauagccgcuucaagccagcugaaacucuggcagaaacacgagaaccuaauguucgagaacuacggagagaaccaagucgucaacaaagaaaccggugaaauucucagcaucagcgacgacgaguacaaagagagcguauuccaaccacccuaccaagguuucgucaacacaaucucguccaaagccuucgaagaugaaauccuuuucuccuaccaagucgacuccaaauucaacagaaaaguaucugacgcgacuaucuacuccacccgaaaagcaaaacucggcaaggacaagaaggaggaaaccuacguacuaggcaaauga

SEQ ID NO: 6035 - RNA, 2598 nt, Artificial Sequence
  Cas9 variant
augcgccacaaaaucggacucgacaucggaaucaccagcgucggcugggccgucaucaaccuagacauaccccgcaucgaagaccucggaguucgcauauucgaccgagcagaaaacccgcagacgggggaaagccuagcacucccgagacgccuagcacgcuccgcacgccggcgccuacgacgacgaaagcaucggcucgaaaggauacgccgucuccuaauccgcgaagggauccucaccaaagaagaacuagacaaacuauucgaagaaaaacacgaaauagacgucuggcaacuucgcguagaggccuuagaccgcaagcucaacaacgacgaacucgcgcgcgugcugcugcaccucgccaagagacgcggauucaaauccaacagaaagagcgagcgcaacaacaaagaaaacaguaccaugcuaaagcacaucgaagaaaaccgcgcgcuacucagcggauacagaaccguagcagaaaugauaguaaaagacccaaaguucgccuuccacaaaaggaacaaaggagaaaacuacaccaauaccaucgcgcgcgaugaccuagaacgcgaaaucaaguuaaucuucaccaaacaacgagaauacggaaacaucguaugcaccgaaacguucgaaaacgaguacaucaugaucugggcuagccagcgaccauucgccagcaaaaacgacauagaaaagaaagucggauucugcacauucgaaccaaaagaaaaacgagcaccgaaagcaacauacaccuuccaauccuuuguggcaugggaacacauaaacaaacuaagacucguauacccuaccggaacucgcggacucaccgacgaggaacgccgacuacucuacaaacaagcauuccacaaaaacaaaaucacauaccacgacauccggacacuucuacaucucccagaugacacguacuucaaggggauaguauaugaccgcggcgccccacuaaagcaaagcgagaccaucagauuucuagaacucgacgccuaccaccaaauacgcaaagcaguugacaaggucuacggcaaaggaaaaaguucuucauuccucccaaucgacuucgacacauuugguuaugcucuaacccucuucaaagacgaugccgacauccgaagcuaccuucgcaacgaauacgaacaaaacggcaaacgcaugcccaaccuagcgaacaaaguauacgacaacgagcccaucgaagaacugcuuaaccucuccuucacaaaguucggucacuuaucgcucaaagcucugcgcaacauccucccauacauggaacagggugaagucuacuccgucgccugugaaagagcaggcuacacauucaccggcccuaagaagaaacagaaaacccuacugcuacccaacauucccccaaucgcaaacccaguagucaugcgcgcccuaacgcaagcacgcaaaguagucaacgcaaucaucaagaaauacggcagccccgucucaauccacauagaacucgcccgcgaccucagccagaccuucgacgaacgcagaaaaacaaaacgcgaacaagacgaaaacagaaagaaaaacgaaaccgccauucgccaacuaauggaguacggguuaacgauaaaccccaccggacacgacauaguaaaauucaaacucuggucugaacagaacggccgaugcgccuacucccugcaaccgaucgaaaucgaaagacuucuagaaccaggauacguagagguugaccauguaauacccuacagccgaagccucgacgacagcuacacgaacaaaguacucguccuaacaaaagaaaaccgcgaaaaagggaaucgcauccccgccgaguaucucggagucggaacagaacgauggcaacaauucaagacuuucguacuaacaaacaaacaauucuccaaaaagaaacgcgaccgacuccugcgccuccacuacgacgaaaacgaagaagccgaauggaaaaaccgaaaccuaaacgacacacgauacauaucccgcuucuucgccaacuucauccgagagcaccucaaauucgcagaauccgacgacaaacagaaggucuacaccgucaacggacgaguaacagcucaccucagguccagaugggacuucaacaaaaacagagaagaaagcgaccuccaccacgcaguugacgcagcaauaguagcaugcacgucccccuccgacaucgcaagaguaacagcauucuaccaacgccgugaacagugcaaagaaagcgcaaagaaagcagagccccacuucccccaacccuggccccacuucgccgacgaacugcgcgcccgacuauccaaaaaccccaaagaaagcauaaaagcgcuaaaccucggcaacuacgacgaccagaagcucgaaagucuucagccgguuuucgugucacggaugccaaaacgcucagucaccggcgccgcgcaccaggagacccuccgacgcuacaucggaaucgacgaacgaagcgggaagauccagacggucgucaaaaccaagcucucagaaaucaaacuggacgaaaccggacacuuccccauguacggaaaagaaucugacccgccagcauccgccuga

SEQ ID NO: 6036 - RNA, 2886 nt, Artificial Sequence
  Cas9 variant
auggcacggauacuggccuucgacauaggcauaagcagcaucggaugggcguucuccgaaaacgacgaacucaaggacugcggagugcggauauucaccaaagccgaaaaccccaaaacaggcgaaucacucgcccucccgcgccggcucgcccgaagcgcccgcaaacgacuggcccgcagaaaggcccgccuaaaucaccucaagcaucugaucgcuaacgaguucaaacucaauuacgaggacuaccagucauucgacgaaucccucgcuaaggcuuacaaaggcuccuuaauauccccauacgaacuucgguuccgggcccucaacgaacugcuguccaagcaagacuucgcccgugucauacuacacauugccaaaagaaggggauacgacgacaucaaaaacaacggagaugaagaaaaaggcaagauacucaaggccauaaagcaaaacgaagagaaacucgucaacuaccagucagugggagaauaccucuauaaagaguacuuccaaaaguucaaagaaaauuccaaagaguucaucaacgucagaaacaagaaggaauccuacgaaagaugcaucacccagagcuuccucaaauacgaacuuaaacugaucuuccaaaaacaacgagaguucggauucuccuucuccaagaaauucgaagaagaaguucucuccgucgcguuuuacaaacgcgcgcucaaggacuucucccaccucgucggcaacugcucauucuucagcgacgaaaaacgagccccaaagaacucaccccucgccuucauguucguagcacucacgcgcaucauaaaccuccuaaacaaccuaaagaacaccgaaggcauccuguacacaaaagacgaccugaacgcacuccugaacgaagugcugaaaaacggaacccucaccuacaagcagacgaaaaagcuacuaggacuauccgacgacuacgaauuuaaaggcgaaaaaggaaccuacuuuaucgaguucaagaaauacaaagaguucaucaaagcacucggugaacacaaccugagccaagacgaccugaacgaaaucgccaaggacaucacacugaucaaagacgaaaucaaacucaagaaagcguuggcuaaauacgaccugaaucagaaucagaucgacucucugagcaaacuagaauuuaaagaccaccuaaauaucggauucaaagccuuaaaacugaucacaccacuaaugcuggaagggaagaaauacgacgaagccugcaacgaacucaaccugaaaguggccauaaacgaagacaagaaagacuuucuccccgcauucaaugagacauacuacaaagacgaaguaaccaacccaguaguacuacgcgcaaucaaagaauaccgcaaagugcugaacgcacuacuaaagaaauacgggaaaguccacaaaaucaacaucgaacucgcacgcgaagucggcaaaaaccacucacaacgcgccaaaaucgagaaagaacagaacgaaaacuacaaagccaagaaagacgccgagcucgagugcgaaaaacugggacuaaaaaucaacagcaaaaauauacugaaacuccgacuguucaaggaacaaaaagaguucugcgccuacagcggcgaaaagauaaagcuaucagacuuacaagacgagaaaaugcuggaaaucgaccacaucuaccccuacagcagaucauucgacgacagcuacaugaauaaaguccucguuuucacaaagcaaaaccaggaaaaacucaacaaaaccccauucgaagcauucggaaacgauaacguaaaauggcagaaaauagaaguccuggccaagaacuuacccgaaaagaaacaaaaacgcauacucgacaaaaacuacaaagacaaggaacagaaagacuucaaagaccgcaaccucaacgacacccgcuacaucgcccgccucgugcucaauuacacaaaagauuaccucgacuuccucccccucuccgacgacgaaaacacaaagcucaaaggcucaaaagugcacguggaagcaaagucuggcaugcucacgagcgcacuaaggcacaccuggggguuuucuaccaaggaccguaacaaucaccuccaucacgccaucgaugcagccauaauugccuacgccaacaacuccauagucaaggacuuuagcgauuucaagaaggagcaggagucaaacagcgcggaauuguacgcuaagaaaauaucagagcucgacuacaaaaacaaaaggaaauucuucgaaccguuuucuggauucagacaaaaaguacuggacaagauagacgaaaucuucguaagcaagccagaacgcaagaaaccaucgggcgcccuacacgaagaaaccuuccgcaaagaagaagaguucuaccaauccuacggcggcaaggaaggaguccuaaaagcccucgaacucggaaagauccgcaaaguaaacggcaaaaucgugaaaaacggggacauguuccggguggacauauucaagcauaagaagacaaacaaauucuacgccgucccuauauacaccauggacuucgcccucaaaguacugccgaacaaagccguggcaagaagcaagaaaggcgaaaucaaggacuggauccuaauggacgaaaacuacgaguucugcuucucacucuauaaggacagccucauauuaauccaaaccaaagauaugcaggagccagaacucguuuauuucaacgcauuuaccaguagcaccgucagccuuaucguaagcaagcacgacaacaaauucgaaacccugagcaaaaaccuuaaaguguucgaaaaauacaucgucuccgcccucggcgaagucaccaaggcugaguuccgacaacgcgaagacuucaaaaacgagcuacgcuga

SEQ ID NO: 6037 - RNA, 2955 nt, Artificial Sequence
  Cas9 variant
auggcaaaaauucuagcauucgacaucggaaucagcagcaucggcugggcauucucugaaaacgacgaacucaaagacugcggcgugcgaaucuucaccaaggccgaaaacccaaagacaggcgaaagccuagcgcuaccacgccguaucgcccggucagcccgaaaacgccuggcacgccgcaaagcccgccugaaccaccuaaagcaccucauagccaacgaguucaaacucaacuacgaagauuaccagagcuucgacgaaauacucgcaaaagccuauaagggcucccuaauuuccccauacgaacuccgauuccgcgcacuuaacgaacuacucucaaaacaagacuucgcccgcgucauccuucacauagcgaagcgacgaggcuacgacgacaucaaaaacaauggcgacgaagaaaaggggaagauacucaaagcgauaaaacaaaacgaagaaaagcuagccaacuaccaauccguaggcgaauaccucuacaaggaauacuuccaaaaguucaaggaaaacuccaaagaauuuaucaacguccggaacaagaaagaauccuacgaacguugcauagcacaaucuuuccuaaaagacgaacugaagcuaaucuucaaaaagcaacgcgaguucggguucaguuucagcaaaaaguucgaagaagaaguccuuucagucgccuucuacaaaagagcacuaaaggacuucucccaccucgugggaaacugcuccuucuucaccgacgaaaaacgcgcccccaagaacuccccacuagcguucauguucguagcccuaacaagaauuauaaaccugcucaacaaccucaaaaacacccucuacacgaaggacgaccucaacgcccuacugaaugaaguccugaaaaacggcacacuaacauacaaacaaaccaagaaacuacucggccuaagugaugacuacgaguucaaaggagaaaaaggcaacuacuucaucgaguucaaaaaguacaaggaguucauaaaagcccucggggaacacucacuaucccaagaugaccugaacgaaaucgccaaagacaucacucuuaucaaagacgaaaucaagcuaaagaaagcgcucgcaaaauacgaccucaaugagaaccaaaucgacaaccuuuccaaacuggaguucaaagaccaccucaacaucagcuucaaggcccuuaaacucaucacaccccuaaugcuagaagguaagaaauacgacgaagcauguaaugaauugacacugaaaguggcgaucaaugaagacaaaaaggacuucuugcccgccuucaacgagacguacuauaaggacgaagucaccaaccccguuguacuacgcgcaauaaaagaguaccgaaaaguccuuaacgcccuucucaagaaauacggcaaaguacacaaaaucaacaucgaacucgcccgcgaagucgggaaaaaccacagccagcgagcgaaaaucgaaaaagagcagaacgaaaacuacaaggccaagaaagacgcagaacuagagugcgagaaacuaggccuaaaaaucaauagcaagaacauccucaaacuccggcuuuucaaagaacagaaggaauuuugcguauacucaggcgaaaagauaaaacuuuccgaccugcaggacgagaaaaugcucgagaucgaccacaucuacccauacagcagaucguucgacgacuccuacaugaacaaagugcuaguauuuaccaaacaaaaccaggagaaacucaaccaaacuccguuugaagccuucggaaacgacucugccaaauggcagaaaaucgagguccuagccaaaaaccuucccacgaagaaacaaaaacggauccucgacaaaaacuacaaagacaaggagcaaaaagacuucaaagaccgaaaccuuaacgacacccgcuacaucgcacgacucguacugaacuacacaaaagacuaccuagacuuccucccacucucagacgaugagaacaccaaguuaaacgacacccaaaaaggauccaaaguacacgucgaagcaaaauccggaaugcucaccuccgcacuccggcauacguggggcuuuuccacaaaagaccgaaacaaccaucugcaccacgccauagacgcaguaaucaucgcuuacgcgaacaacagcauagucaaagccuucuccgacuucaaaaaggaacaagaaagcaauaccgcagaacuauacgccaagaaaauuucugaacuggacuacaaaaacaaaagaaaauucuucgaacccuucagcgguuucagacaaaaaguccucgacaaaauagacgaaauauucgucucaaagcccgaacggaaaaagccaucaggagcccugcacgaagaaaccuuccgcaaggaggaagaguucuaccaauccuauggaggaaaggaagggguucuaaaagcacuggaacuaggcaaaauccggaagguaaacgggaaaaucgucaaaaacggagacauguuccgcguagacauuuucaaacacaaaaagaccaacaaauucuacgccgucccaauauauacaauggacuucgcccucaaagugcuaccgaacaaggccgucgcacgauccaaaaagggcgaaaucaaagauuggauacuaauggacgaaaacuacgaguucugcuucucauuauacaaagacucacuaauccuaauccaaacaaaggauaugcaagaaccagaguucgucuacuacaacgccuucacaucaagcacagucucccuaaucgucagcaaacacgauaacaaauuugaaacccuauccaaaaaucaaaagauccuauucaagaacgcaaacgaaaaagaaguaauagccaaauccaucggcauccaaaaccugaaaguguucgaaaaauacauagucagcgcccuuggcgaagugaccaaagccgaauuucgacaacgcgaagaguucaaaaacgaacuacgcuga

SEQ ID NO: 6038 - RNA, 2955 nt, Artificial Sequence
  Cas9 variant
auggcacgcauccucgccuucgacaucggcaucucgucaaucggcugggccuucucggaaaacgacgaacucaaagacugcggcguccgcauauucacaaaggcugaaaaccccaaaaccggcgaaucacuggcacuaccacgcaggcucgcacgcucagccagaaaacgccuagcccgccgcaaggcgcgcuuaaaccgccucaaacaccucaucgcgaaugaguucaagcuaaacuacgaagacuaccaauccuucgaugaaucacucgcgaaagccuacaaaggcucauuaaucagccccuacgaacucagauuccgagcccuaaacgagcuccucucgaagcaagacuucgcccggguaauccuacacauagcgaaaagaagaggguacgacgacauaaagaacucugacgacaaagaaaaaggagcaauccucaaggccauaaagcagaacgaagaaaaguuagccaacuaccaaucagugggggaauaccucuacaaagaauacuuccaaaaauucaaggagaacuccaaagaguucaccaauguccgaaauaagaaagaaaguuacgaacgcugcauagcacagagcuuccucaaagacgaacucaaacuaauauuuaaaaagcaaagagaguucggcuucagcuuuaguaagaaauucgaagaagaaguccucagcgucgccuucuacaaacgcgcucuaaaggacuucucacaccuaguaggcaacugcucguucuucaccgaugagaaacgcgcuccaaagaacuccccacuugcauucauguucguagcacuaacccgcauaauaaaccugcuaaacaaccugaaaaacaccgaaggcauccuauacacaaaagacgaccugaacgcgcuacucaaugaauuucucaagaacgggacgcucaccuacaagcaaacgaagaaacugcucggccuaagcgacgacuacgaguucaaaggagaaaaaggaaccuacuucaucgaguucaagaaauacaaagaguucaucaaagcgcuaggcgaacacaaccuuucucaagacgaucucaaugaaauagccaaagacauaacgcuaaucaaagacgaaauaaaauugaagaaagcccucgccaaauacgaccugaaccagaaccaaaucgacucccucagcaaacuagaguucaaagaucaccuaaacauaucguucaaagcccuaaaacuaauaacaccacuaaugcuggaaggcaagaaauacgacgaagccugcaacgaacuaaaccuaaaagucgcaaucaacgaagacaagaaagacuuccucccagcauucaacgaaaccuacuauaaagacgaaguaaccaaucccguuguccuccgagccauaaaagaauaccgcaaaguccugaaugcccuacucaaaaaguacggaaaaguccacaaaauaaacaucgaacucgcgagagaagucggcaaaaauuacucucagagggccaaaaucgaaaaggaacaaaacgaaaacuacaaggccaagaaagacgcagaacucgaaugcgaaaaacuuggacucaaaaucaacagcaaaaacauacuaaaacuaagacucuucaaggaacagaaggaguucugcgcauacucaggcgagaaaaucaagaucucggaccugcaggacgaaaagaugcuagaaaucgaccacaucuacccuuacagccgcagcuucgacgauucuuacaugaacaaaguccuagucuucaccaaacaaaaccaagaaaaacucaaccagacccccuucgaagcauucggcaaugacagcgccaaauggcagaaaaucgagguccuagcgaagaaccuucccaccaagaagcaaaaacggauacucgacaagaacuacaaagacaaagaacagaaagacuucaaagaccgaaaccucaacgacacccgcuacaucgcacggcucguacucaacuacacgaaagacuaccucgacuuccucccccucagugacgacgaaaacaccaagcucaaugacacacacaaagguuccaaaguacacguagaggccaaauccggcaugcuaacgagugcgcuacggcacacauggggguucucgacaaaagaccgcaacaaccaccuaagacacgccaucgacgcagucauaaucgccuacgcuaacaauuccauaguuaaagccuucuccgacuucaagaaagagcaagaaagcaacuccgcagaacucuacgccaagaaaaucuccgaacuggacuacaaaaacaaacguaaguucuucgagccauucuccggguuccggcaaaaaguccuagacaagaucgacgaaauauucguuagcaaacccgaacgcaaaaagccaagcggcgcauugcacgaagaaacauuccgcaaagaggaagaguucuaccaauccuacggcggcaaggaaggaguacucaaagccuuagaacuagggaaaaucagaaaaguaaacggaaaaauugugaaaaacggggacauguuccgaguagacaucuucaaacacaagaaaacuaacaaauucuacgcagugccgaucuacaccauggacuucgcauugaaaguacuacccaacaaagcggucgcgagaucgaagaaaggagaaauaaaagacuggauacuuauggaugaaaacuacgaauuuugcuucagccuauacaaagacagccucauucuaauccaaacaaaagacaugcaagaacccgaguucguguacuacaacgccuucacuucuagcaccgucuccuuaaucguaagcaaacacgacaacaaguucgaaacccucuccaaaaaccagaagauccuauucaaaaacgcaaacgaaaaagaagugauagcgaaaucaaucggcauacagaaccuaaaaguuuucgaaaaauacaucguuucggcgcucggagaagucacgaaagccgaguuccgccagcgggaagauuucaagaaauga

SEQ ID NO: 6039 - RNA, 2955 nt, Artificial Sequence
  Cas9 variant
auggcaagaauccuggcauucgacaucgggauaucaucgaucggcugggcguucagcgaaaacgacgaacuaaaagacugcggcgugcgcaucuucacaaaaguagagaacccgaagaccggcgaaucucucgcccuaccacgacgacucgccaggagcgccagaaaacggcuagcacgccggaaggcgcgucucaaccaccuaaagcaccucaucgcaaacgaguucaagcucaacuacgaagacuaccaaucuuucgacgaaucacuagcgaaggccuacaaggggucucugaucuccccauacgaacuccgauucagagcauugaaugaacuccugagcaaacaagacuucgcacggguaauacuacacaucgccaaacgacguggcuacgacgacaucaaaaauucugacgacaaagaaaagggggcaauccucaaggcaauuaaacaaaaugaggaaaagcucgcaaacuaccaauccgugggcgaauaccuguacaaagaguacuuccaaaaauucaaagaaaacuccaaagaguucaccaacguacgcaacaagaaagaaaguuacgagcgcugcaucgcgcagagcuuccugaaagacgaacuaaaacuaaucuucaagaaacagcgagaguuuggguucucguucucgaagaaauucgaagaagagguccuaagugucgccuucuauaaacgggcgcucaaagacuucagccaccucgugggcaacugcuccuucuucaccgacgaaaagcgcgcgccuaaaaauucaccccuggccuucauguuugucacccuaacgcgaauaaucaaccuacuaaacaaccucaaaaacacggaagggauccuauacaccaaagacgaccugaacgcacuccuuaacgaaguccugaaaaacgggacacuaaccuacaaacaaacgaaaaagcugcucggccucucggacgacuacgaguucaaaggcgaaaagggaaccuacuucaucgaauuuaaaaaguacaaggaguucauaaaagcccugggagaacacaaucuuucccaagacgaucuaaacgaaaucgccaaggacauaacccucauuaaggacgaaaucaaacucaagaaagcucuggccaaauacgaccucaaccaaaaucagauugauucccugagcaaacucgaguucaaagaccaccuaaacaucucguucaaggcacucaaacuaauaacccccuuaaugcuagaaggcaaaaaguacgaugaagcaugcaacgaacuaaaucugaagguagccauaaacgaagacaagaaagacuuccugcccgccuucaaugagacguacuacaaagacgaagugacaaaccccgucguccugcgcgcuauaaaagaauacagaaaaguacucaacgcucuacugaagaaauacggcaaaguccacaaaaucaacauugaacucgcacgcgaagucggcaaaaaccacucgcaacgagccaaaauagaaaaagaacaaaacgaaaacuacaaagccaagaaagacgcagaacucgaaugcgaaaaacugggauuaaaaaucaacagcaaaaacauccugaaacuacgccuauucaaagaacaaaaggaguucugcgcauacuccggcgagaaaauuaaaaucuccgaccuacaagacgagaaaaugcucgaaaucgaccacaucuaccccuacagccgcagcuucgacgauucauacaugaacaaaguacuuguguucaccaaacaaaaccaggaaaaacugaacaagacaccauucgaagccuucggcaacgacucagccaaauggcaaaagaucgaagugcuggccaagaaccuccccacaaagaaacagaaacgcauacuagacaaaaauuacaaagauaaagaacagaaagacuucaaagauaggaaccucaacgacaccagauacauagcacgacucguccuaaacuacacgaaagacuaccuugauuuccucccccucuccgacgacgaaaacaccaaauuaaaugacacccagaagggcucuaaagugcacguagaagccaaaucaggcaugcugacguccgcgcuccgccauacauggggcuucucgaccaaagaccggaacaaccaccuccaccacgcuauagaugcagucauaauagccuacgcgaacaauucgaucguaaaagcauuuuccgacuucaagaaagaacaagaaagcaauucagccgaacucuacgcaaagaaaauaagcgaacuggacuacaaaaacaaacgcaaauucuucgaacccuucuccggguucagacaaaaaguccuggacaaaaucgaugaaaucuuugugaguaagccagaacgcaaaaagccuuccggcgcccuccacgaagagaccuuccgaaaagaggaggaguucuaccaaagcuacgggggcaaggaaggaguccugaaagcccucgagcucgggaaaauacgaaaaguaaacggcaaaauagucaaaaacggcgacauguuucgaguagacaucuucaaacacaagaagaccaauaaguucuacgccguccccaucuacaccauggacuucgcacucaagguccugcccaacaaggccguggcacgcuccaagaagggcgaaaucaaggacuggaucuuaauggaugagaauuacgaguucugcuucucccuguacaaagacucccuaauacucauccaaaccaaagacaugcaagaacccgaguucgucuacuacaacgcauucaccagcucgaccgucagccucaucgugucaaaacacgacaacaaauuugaaacacuauccaagaaccagaaaauccucuucaagaacgccaacgagaaagaagugaucgcaaaaucaaucggaauccaaaaccuaaaagucuucgaaaaauacaucgucagcgcccuaggagaagugacaaaggcagaguuccgacagagggaagacuuuaagaaguga

SEQ ID NO: 6040 - RNA, 2955 nt, Artificial Sequence
  Cas9 variant
auggccagaauacucgccuucgacauaggcauuucaucgaucggcugggccuucagcgaaaacgacgaacucaaggacugcggaguccguaucuucacaaaggccgagaacccaaagacaggggagucccuugcccuaccgagaaggcuagcacgcuccgcccggaaaagacuugcacgacgcaaagcgcgucuaaaccaccucaaacaccucaucgccaacgaauuuaaauugaacuacgaagacuaccaauccuucgacgaaagccucgccaaagcauacaagggcucccuuauaucaccauacgagcuccgauuccgcgcccucaacgagcuacucucgaaacaagacuucgcaagaguaauccuccacauagcaaagaggagggguuacgacgauaucaaaaacuccgacgacaaagagaaaggcgccauacucaaggccauaaagcagaacgaagagaaacucgcaaauuaccaaucagucggagaauaccuguacaaggaguacuuccaaaaauucaaagaaaacagcaaagaauuuacaaacgugaggaacaagaaagagagcuacgaacgaugcauagcccaaucguuccugaaagacgaacuaaaauuaaucuucaagaaacaacgagaguucggauuuuccuuuuccaagaaauucgaagaagagguccucuccguggccuucuacaaaagagcgcuuaaagacuucagccaccuaguaggaaacugcucauuuuucaccgaugaaaaacgcgcgcccaaaaacagcccccuagccuucauguucguagcacuaacccgcaucauuaaucuacucaacaaccuuaaaaacacggaggggaucuuauacacaaaagacgaucucaacgcacuccucaaugagguccucaaaaauggaacacuaacauacaaacaaacaaagaaacuacuggggcucuccgacgacuacgaguucaaaggcgaaaaagguacauacuuuaucgaguucaagaaauacaaagaguucauaaaagcacucggagaccacucccucucacaagacgaccucaacgaaaucgcaaaagacauaacacuaaucaaagacgaaauaaagcucaagaaagcccuggcgaaauacgaccuaaaucagaaucaaauagacucacucuccaaacucgaguucaaagaccaccucaacaucuccuucaaggcacucaagcugaucacgccacuaaugcuggaagggaaaaaguacgacgaagccugcaacgaacugaaccucaaggucgcgaucaaugaagacaaaaaggacuuccuacccgcauucaacgagacguacuacaaagacgaggugacgaacccagugguccuucgagcaaucaaggaguaccgaaagauucucaacgcgcuccucaaaaaguacggaaagguacauaagaucaacauugaacucgcacgugaggucggcaaaaaccacagccaaagagccaagaucgaaaaagagcagaaugaaaauuacaaggccaaaaaggacgcagaaaucgaaugugaaaaacuaggccuuaaaauaaacagcaaaaacauccugaagcuacgccuguucaaagaacaaaaggaguucugugcauacagcggagaaaagaucaaacucagcgaccuccaagacgagaaaaugcucgaaauugaccacaucuacccauauucccgcagcuucgacgacuccuauaugaacaaaguccucgucuucacaaaacaaaaccaagaaaaacuaaacaaaaccccauucgaagccuucggaaacgacagcaccaaguggcagaaaaucgaaguccucgcaaagaaccugcccgaaaagaaacagaaaagaauacuagacaaaaacuacaaagacaaagaacaaaaagauuucaaagaccgaaaucuuaacgacaccagguacaucgcgcggcucguacuaaacuauacgaaagacuacuuagacuuucucccgcuuagcgacgacgaaaacaccaagcucaacgacacccaaaaaggcucgaaaguccacguagaagcuaaaucaggcaugcucacgagcgcccuacgccacaccuggggguucucggccaaggaccggaacaaccaccuccaucacgcaaucgacgcggccauaaucgccuacgcuaacaauagcauagucaaagcauucuccgacuucaagaaggagcaagaaagcaacagcguggaauuguaugcgaagaagauaucggaacuagacuacaaaaacaaaagaaaauucuucgaaccauucagcggauuucgccaaaaaguccuggauaagauagacgagauauucguaucaaaaccagaacgaaagaaaccauccggagcccugcacgaagagacauuccguaaagaggaagaguucuaccaauccuacggagggaaagaaggaguucucaaagcccuggaacuuggaaaaaucaggaaggucaacggcaagaucgucaaaaauggcgauauguuccgaguagacaucuucaagcacaagaaaacaaacaaauucuacgccguccccaucuacaccauggacuucgcacucaagguuuuacccaacaaagcagucgcgcgauccaaaaagggggaaaucaaggacuggauacucauggaugaaaacuacgaguucugcuucucgcucuacaaagacagccugauccucauccaaaccaaagacaugcaagaacccgaacuuguauacuucaacgccuucacuagcuccaccgucucucucaucguaucaaagcacgacaauaaguucgaaacccuaucuaagaaccaaaagauacuauucaaaaacgccaacgaaaaggaggucaucgcgaaaucgaucggaauacaaaacuugaagguauucgagaaauacauaguuagcgcgcucggagaggugacaaaagccgaguuccgccagagagaagacuucaaaaaguga

SEQ ID NO: 6041 - RNA, 2955 nt, Artificial Sequence
  Cas9 variant
auggcucgcauccuagcguuugacaucggaauuagcuccauuggaugggcauucucggaaaacgacgaacucaaagauugcggcgugagaaucuucaccaaagucgaaaaucccaaaacaggagaaucccuagcccuaccacgccgccuagcgcgcucagcccgcaaacgccucgcccgaagaaaagcccgacuaaaccaccucaaacaccucauagccaacgaguucaaacucaacuacgaagacuaucaguccuucgacgaaagccucgcaaaagccuacaagggcuccuugaucagcccauacgaacuccguuuccgagcccucaacgagcuccuaucgaaacaagacuucgcacgcguaaucuugcauauagccaagcggcgaggcuacgacgauaucaaaaacucagaugacaaagaaaagggcgcaauacucaaagccauaaaacagaacgaagaaaaacuugcgaacuaccagucgguaggagaguaccucuacaaagaauacuuucagaaauucaaagaaaacuccaaggaguucacaaacguccgcaacaagaaagaaucauaugaacgcugcaucgcccaaucguuccuaaaagacgaacucaagcucauauucaagaagcagcgggaauuuggauucucauucucaaagaaauucgaagaggaaguccuguccgucgccuucuacaaacgggcccucaaagauuuuagccaucucguaggaaacugcuccuucuucacagacgagaaacgcgcgccaaagaacucacccuuagcauuuauguucgucgcucucaccagaaucaucaaccuccugaacaaccucaaaaacaccgagggaauccuguacaccaaggacgaccucaaugcccuccucaacgaaguccucaaaaauggaaccuuaacauauaaacaaacaaagaaacuccuaggacugagcgacgacuaugaguucaaaggagaaaaaggaaccuacuucaucgaauuuaagaaauauaaggaauuuaucaaagcgcuaggagaacacaaccuaucacaggacgaccuaaaugaaaucgcaaaagacaucacgcucaucaaggacgagaucaaacucaaaaaggcccuagcgaaguacgaccucaaccaaaaccaaauagauucucugagcaaacucgaguucaaggaccaccucaacaucuccuucaaagcccucaagcugauaacgccccucaugcuagaaggaaagaaauacgacgaagcaugcaacgaacucaaccucaaaguggccaucaacgaagacaagaaagacuuucugccagcuuucaacgaaaccuacuacaaagacgaagucaccaacccagucguucuacgcgcgaucaaagaauaccgaaaaguccuaaacgcccugcucaagaaauacgguaagguccacaagaucaacaucgaacucgcccgggaggucgggaaaaaccacucgcaaagagcaaaaaucgaaaaagaacaaaacgagaacuacaaggcgaagaaggacgccgagcuagagugcgaaaaacugggacuuaaaauuaacuccaaaaacauccuaaaacugcggcuguucaaagagcagaaggaguucugcgccuacagcggagaaaagauuaaaaucuccgaucuacaagacgagaaaaugcucgaaaucgaccacaucuacccuuacucaagauccuuugacgacucauacaugaacaaaguccuaguguucaccaaacaaaaccaagaaaaacucaauaaaacaccauucgaagccuucggcaacgacuccgcaaaguggcagaaaauagaagucuuggcgaaaaaccugccaaccaagaaacaaaaacguauacucgacaaaaacuacaaagacaaggaacaaaaggacuucaaggaucgcaaccugaacgacaccagauacauagccagacucguccucaacuacaccaaggacuacuuagacuuucucccccuuagcgacgacgaaaacaccaaacucaacgacacccagaagggauccaagguccacguggaagccaaaucgggcaugcucacaagcgcgcuccggcauacauggggauucucuacgaaagaccgaaacaaccaccuucaccacgcaaucgacgcggucaucaucgccuacgccaauaauucaaucgucaaggccuucuccgacuucaagaaagaacaggaguccaacuccgccgaacucuacgcaaagaaaaucuccgagcuagacuacaaaaacaaacgaaaguucuucgagcccuucagcggauucagacagaaaguccuggacaaaaucgacgagauauucguauccaaaccggagcgaaagaaacccucaggugcccuccacgaagagacuuuuagaaaagaggaggaguucuaccaaucauacgguggaaaagaaggaguccuuaaagcccucgaacuagguaaaauacgcaaagucaacgggaaaaucgucaaaaacggcgacauguuccgcguagacaucuucaaacacaagaaaacuaacaaauucuacgcaguccccauauacaccauggauuucgcacucaaaguccugcccaacaaagccgucgcccgcagcaagaaaggcgaaaucaaagacuggauccucauggacgaaaacuacgaguuuugcuucucacucuacaaagacucccugaucuugauccagaccaaagacaugcaagaaccggaguucgucuacuauaaugcguucacgagcucgacagugucccucaucgucagcaaacacgacaacaaguuugaaacccugucaaagaaccagaagauccuauucaaaaacgccaacgaaaaagaggucauugccaaaucgauaggcauacaaaaccuaaaggucuucgagaaguauaucgucagcgcacuaggcgaagugaccaaagccgaguucaggcaacgcgaagacuucaagaaauga

SEQ ID NO: 6042 - RNA, 2955 nt, Artificial Sequence
  Cas9 variant
auggcccgcauccuggcauucgacauuggcaucucguccaucggcugggcauucuccgaaaacgacgagcucaaggacugcggcgugcggaucuucacgaaagcggagaacccaaagacgggcgaaucucuggcgcucccccgcagacuagccagauccgcccgaaaacgccucgcccgcaggaaggcgcgacugaaccaccucaaacaccuaaucgccaacgaauucaaacucaacuacgaggacuaccaaucauucgacgaaucccucgcaaaagccuacaagggcucacucauaucaccguacgaacuacgguuucgagcacuuaacgaacuccuaucaaaacaagacuucgcgcgagucauauuacacaucgccaagagacgaggguacgacgacauaaaaaauuccgacgacaaagagaagggagcgauacuaaaagccauaaagcaaaacgaggaaaaacucgcaaacuaccaguccgucggagaauaucuauacaaagaguacuuccaaaaauuuaaagaaaacuccaaggaauucaccaacguuaggaacaaaaaagaaucguacgagcgaugcaucgcacaaagcuuccugaaggacgagcuaaaacuuauauucaaaaaacagcgcgaauucggguucuccuucuccaaaaaauucgaggaagaaguacuaagcguggccuucuauaaacgggcacuaaaagacuucagccaccucgucggcaauugcagcuucuuuaccgacgaaaagcgcgcgcccaaaaacuccccccucgccuucauguucgucgcacucacccggaucaucaaccucuuaaacaaccucaaaaacaccgaaggaauauuauacacgaaagacgaccucaacgcacuccuaaaugaagugcugaaaaacggcacgcucacauacaaacaaaccaaaaaacuccuaggacugagcgacgacuacgaauucaagggcgaaaaaggcacauacuucaucgaauucaagaaauacaaagaauucaucaaggcgcucggugaccacagccuuucacaagacgaucuuaacgaaauagcaaaagacauaacccuaaucaaagaugagaucaagcucaagaaagcccucgcaaaguaugaccuaaaccagaaccaaaucgacucccucagcaagcucgaguucaaagaccaccucaacaucucauucaaagcccuaaaacucaucacaccccuuaugcuggagggcaaaaaguacgacgaggccugcaacgaacugaaccuaaaaguagcuauaaacgaagacaagaaagacuuccugccagcauucaacgaaacguacuacaaagacgaaguaacaaaccccguggugcuucgcgccaucaaagaauaucgaaaaguccucaacgcccugcucaagaaauacggcaaaguucacaagauaaacaucgaacuagcacgggaaguugguaagaacuacucccaacgagccaagauagagaaagaacagaacgaaaacuacaaagccaaaaaggacgccgaacuggaaugcgagaagcucggccucaaaauuaacuccaaaaacauccucaaacuccgccuuuucaaggagcaaaaagaguucugcgcuuacagcggcgaaaagauuaaaaucagcgaccuccaagaugagaagaugcucgaaaucgaucacauauauccuuacagccgguccuucgacgacuucuacaugaacaaaguccuaguauucacgaaacagaaccaagagaaacuaaaccaaacuccguucgaagcauucggcaacgacagcgccaaauggcagaaaaucgaaguacuagccaagaaccugcccacaaaaaaacaaaaaagaauucucgacaaaaacuacaaggacaaggaacagaaggacuucaaagaccgcaaccuaaacgacacaagguauauagcccgccucguacuaaacuacacaaaagacuaucucgacuuccuaccccucuccgacgacgagaacaccaaacuaaacgacacacaaaagggcuccaaagugcacgucgaagccaaaucaggcaugcuaacuagugcccugcggcacacguggggcuucuccgcaaaagaccgcaacaaccaccugcaccacgccauagacgcaguaauaaucgccuacgccaacaacagcauagugaaagccuuuagcgacuucaagaaagagcaagaaagcaacagcgccgagcucuaugccaaaaaaaucuccgaauuggacuacaaaaacaagcggaaguucuuugagccauuuuccggcuuccgacaaaagguccuagacaagaucgacgaaauauucguaagcaaaccagagcgaaaaaaaccuucaggagccuugcacgaagaaaccuuccguaaagaagaggaauuuuaccaauccuacggugggaaagaaggaguacucaaagcgcuugaacucgggaaaauccgcaaagucaauggcaagaucgugaaaaauggcgacauguuccgcguggacaucuucaaacacaagaaaaccaacaaguucuacgcaguacccauauacaccauggacuuugcccuaaaggugcuucccaacaaagccguagcacgcuccaagaaaggagaaauaaaggacuggauccuuauggaugaaaacuacgaauucugcuucucacucuacaaagacagccuaauacugauccaaaccaaagacaugcaagaaccagaguucguauacuacaacgcguucacgagcucgacaguaagccucaucguaucgaagcacgacaacaaauucgagacacuguccaaaaaccaaaagauacuauucaaaaacgcaaacgaaaaagaagucaucgcaaaaaguaucggaauccaaaaccugaagguauucgaaaaauacauagucucggcccuuggugaaguuacaaaagcagaauuccgccaacgugaagauuucaagaaauga

SEQ ID NO: 6043 - RNA, 2955 nt, Artificial Sequence
  Cas9 variant
auggcccgaauacucgcguucgacauagggauaucguccauagguugggcauucucagaaaacgacgagcucaaagacugcggcguccgaaucuuuacaaaggccgaaaacccaaagacgggggaaucgcuagcacuaccccgaaggcuagcgcgaucggcucgcaaaagacuagcccgccgcaaagcccgccugaaucaccucaagcaccugauagccaacgaguucaaacucaacuacgaggacuaccaaucguucgacgaaucccuggcgaaggccuacaagggcucacuuaucucuccauacgaacucagauuccgagcgcucaacgaacuccuaagcaaacaagacuucgcgagaguaauacuccacaucgccaagcgcagagguuacgacgacaucaagaacucggacgacaaggaaaaaggggccauccuaaaagcuaucaaacaaaaugaagaaaaacucgcuaacuaccaaagcgucggugaguaccucuacaaagaauacuuccaaaaauuuaaagaaaacagcaaggaauuuaccaacguuaggaauaagaaagaauccuacgaaagaugcauugcccagagcuuccuaaaagacgagcucaaacugaucuucaagaaacaaagagaguucggauucucguuuucgaaaaaguucgaggaggaagucuugucaguagccuucuacaagcgagcgcuaaaggacuucucccaccuagucgggaacugcucauucuucaccgacgagaaacgcgcccccaagaacucgccccucgccuucauguucgucgcacucacgcgcaucaucaaccugcuaaacaaccuuaaaaacacagagggcauucucuacaccaaagacgaucucaacgcgcuccuaaacgaguuccucaaaaacggcacccuaacauacaagcaaacaaagaaacuccucggccucucugacgacuacgaguucaaaggcgaaaaaggaaccuacuucaucgaguucaagaaauacaaagaguucaucaaagcccucggugaacacaacuuaagccaagacgaccugaacgaaaucgccaaagacauaacucuaaucaaggacgaaaucaagcucaagaaagcccuagcaaaauacgaccucaaccagaaccaaaucgacagccuaagcaaacucgaguucaaagaccaccucaacauauccuucaaggccuugaaacugaucaccccacucaugcucgaaggaaagaaauacgaugaagcaugcaacgaacuaaaccucaaaauagccaucaacgaagacaaaaaggacuuccuaccagcauucaacgaaacauacuacaaagacgaaguaacgaaccccgugguccugcgagcaauaaaagaauaccgcaaaguacuaaaugcacuccugaaaaaguacggaaaaguucacaaaauaaacauugaacucgcccgcgaagucggcaagaaccacucgcagcgagcuaaaaucgaaaaagaacaaaacgaaaacuacaaggccaaaaaggacgcagagcuagaaugcgagaaacugggacuaaaaaucaacuccaaaaacauacuaaagcuccgccucuucaaagaacagaaagaguucugcgccuacuccggagaaaagaucaagauauccgaccuccaagacgaaaagaugcucgaaauagaccacaucuacccguacucccgcuccuucgacgacuccuacaugaauaaaguccuagucuucaccaaacagaaccaagaaaaacucaaccagaccccauucgaagccuucggaaacgacuccgccaaauggcagaaaaucgaaguguuagccaaaaaccugccaaccaagaaacaaaaacgcauccucgauaaaaauuacaaagacaaagaacaaaagaauuuuaaggaccgaaacuuaaaugacacuagauacauagcccgccugguccugaacuacacaaaggacuaucuggacuuccucccacucucagaugacgaaaauaccaaacucaacgacacacagaagggcucgaaaguacacgucgaagccaaaucgggcaugcuuacguccgcucuccggcacacauggggcuucagcgccaaagacaggaacaaccaucugcaccacgccauagacgcgguaaucauugcauacgccaacaacuccauagucaaagccuucagcgacuucaagaaggaacaggaaagcaacuccgccgaacuguaugccaagaagauauccgaacuggacuacaaaaacaaacgcaaguucuucgagcccuucagcggcuuccgacaaaaaguacucgacaaaauagacgaaaucuuugucucaaagcccgaacgcaagaaaccuucgggagcacuacacgaagaaacauuucgcaaagaggaggaguucuaccaguccuacggaggcaaagaaggaguucuuaaagcccucgaacucgguaaaauacgcaaaguaaauggcaaaaucguaaagaacggagacauguucaggguggacauauucaaacacaagaaaaccaacaaauuuuacgcaguccccaucuacacgauggauuucgcgcucaagguccucccaaacaaagccguagcacgaucaaagaaaggagagauaaaagauuggauacuuauggacgaaaacuacgaguucugcuucucacuauacaaagacucccucauccuaauacaaacaaaggacaugcaggagcccgaguucguauacuacaacgccuuuaccuccucuacgguaagccucauaguaucgaagcacgacaacaaguucgaaacacucagcaagaaucagaaaauacuauucaagaacgccaacgaaaaggaagugauagcgaaaucaaucgggauccaaaaccuaaaggucuucgagaaauacaucguaagcgcauuaggagagguaacaaaagccgaguuccgccagcgcgaagacuucaagaaguga

SEQ ID NO: 6044 - RNA, 2955 nt, Artificial Sequence
  Cas9 variant
auggucagaauccuggcguucgacaucggaaucagcuccaucggaugggccuucagugaaaacgacgaacucaaggauugcggcgucagaauauucacuaaggucgaaaacccgaaaaccggggaaagccucgcccuaccacgccgccucgcgcggucggccaggaagagacuugcccgccguaaagcccgcuugaaccaccucaaacaccucauagccaacgaguucaagcuaaacuacgaggauuaccaaucauucgacgagucccucgcgaaagcauacaaagguagccuaaucagcccauacgaacuccgcuuccgggcacucaacgaacuccuaucaaaacaagacuucgcgagagucauacuccacaucgcuaaaaggcggggcuacgaugacaucaagaacucggacgacaaagaaaaaggagcgaucuugaaagccaucaaacaaaacgaggaaaagcucgcaaacuaccagucagucggagaauaccuauauaaggaguacuuccaaaaauucaaagaaaacuccaaggaguucacaaacguccgaaacaagaaagaaagcuaugaacgaugcaucgcccagagcuuccucaaagacgaacuaaagcuaaucuucaagaaacagcgcgaguucggguucuccuucucaaagaaauucgaagaagaaguccucagcgucgcuuucuacaaacgggcccucaaagacuucagccaccuugugggcaacugcucauucuucaccgacgagaaacgggcaccgaaaaacucaccacucgccuucauguucguagccuugacacgaauuaucaaccuucuaaacaaccucaaaaacaccgaaggcauccuauacacgaaagaugaccuaaacgcccuacuaaaugaagugcugaaaaacggcacccuaacguacaagcaaacaaagaaacuacugggucugagcgacgacuacgaguucaaaggcgaaaagggcacauacuucauagaguucaagaaauacaaagaguucaucaaggcgcucggcgaacacaaccucagccaagacgaccuaaaugaaauagccaaggacauaacccuaaucaaggacgaaauaaaacucaagaaagcccucgccaaauacgaccuaaaccaaaaccagauagacucccuaagcaaacuggaguucaaagaccaccuuaauauauccuucaaggcccucaaacuaaucacgccacuaaugcuagaaggcaagaaguacgacgaagcgugcaacgaacucaaccuaaagguagccauuaacgaagacaagaaagacuuccuccccgccuucaacgaaacauacuacaaagacgaagucaccaauccggucgugcugcgagcaauuaaggaauacaggaaaguacugaacgcccuccucaagaaauacggcaaaguacacaaaauaaacaucgaacucgcucgcgaggucggcaaaaaccacucacaacgagccaaaaucgagaaagaacaaaaugaaaacuacaaagccaagaaagacgccgaacuugaaugcgaaaaacucggccucaaaauaaacucuaaaaacauacuaaaauugagacucuucaaagaacaaaaagaguucugcgccuacucgggggagaaaaucaagauuagcgaccuccaagacgagaaaaugcucgaaauagaccacauauaucccuacagccgcagcuucgaugacucauacaugaacaaaguccucgucuucacaaagcagaaccaggaaaaauuaaacaaaacccccuuugaagccuucggaaacgacuccgccaaguggcagaaaaucgaaguacuggccaaaaaccuacccacaaagaagcaaaaacgaauccucgacaagaacuacaaggauaaagaacaaaaagacuucaaagacaggaaccugaacgacacgagauacauagcacgacucguccugaacuacaccaaagacuaccucgacuuccucccacucuccgacgaugaaaacacgaaauuaaaugauacacagaaaggcucgaaagugcacgucgaagcaaaaaguggaaugcucaccagcgcacuacgacacacauggggauucagcaccaaggaccgcaacaaccaccuccaccacgcaauagacgcugucauaaucgccuacgcuaacaacucgaucgucaaagcauucagcgacuucaaaaaggaacaggagagcaacucggcagaacuauacgccaagaaaaucuccgaacuugacuacaaaaacaaacgaaaauucuucgaaccauucucaggauuucgccaaaagguccucgacaaaaucgacgagauauucgucuccaagcccgagcgcaagaaacccuccggcgcuuuacacgaagaaaccuuccgcaaagaggaagaguucuaccaaucuuacggaggcaaagaaggcguccugaaagcgcuagaacucgggaaaauacgcaaagugaacgggaaaauagucaagaacggcgacauguuucgcguagauaucuucaagcacaagaaaacgaauaaauuuuacgcgguccccauauacaccauggauuucgcacugaagguacuacccaauaaagcgguagcccgcucuaaaaagggcgagauaaaggacuggauccuaauggacgagaacuacgaguucugcuuuucccuguacaaggauucccugauccugauccaaaccaaggacaugcaggaacccgaauuuguauacuacaacgccuucacaagcagcacagucucacuaaucguaagcaagcacgacaacaaauuugagacccucaguaagaaccagaaaauccuauucaaaaacgccaacgaaaaagaaguaaucgccaaaagcaucggcauccaaaaccuuaagguauuugaaaaauacaucgucuccgcccugggcgaggucacaaaagccgaguuccggcaacgcgaagacuucaagaaauga

SEQ ID NO: 6045 - RNA, 2955 nt, Artificial Sequence
  Cas9 variant
auggccaggauccucgcauuugacauagggauaagcuccaucggaugggccuucagcgagaacgacgaacuaaaagacugcggaguacgcauuuucaccaaagcggaaaauccaaaaaccggcgaaucacucgcccucccacggcggcucgcccgauccgcacguaaaagacuagcccgccggaaagcccgccugaaccaccucaaacaccuuauagcaaacgaguucaaacucaacuacgaggauuaccaguccuucgacgaaucccuagcaaaagccuacaaggguagcuuaaucuccccauacgaacuccgcuuccgcgcguuaaacgagcugcuauccaaacaagacuucgcgcgaguuauccuccacauagccaagaggcgcggauacgaugacauaaagaacuccgacgauaaagagaaaggcgccauccucaaggccaucaagcagaacgaggaaaaacuggcaaauuaccaauccgucggggaguaccucuacaaagaguacuuccaaaaauuuaaagaaaacuccaaagaguucacaaauguccgcaauaagaaagagagcuacgaaaggugcauagcacagagcuuccuaaaagacgaacucaaacucaucuucaagaaacaaagagaguucggguucucuuucuccaagaaauucgaagaagaaguccuuuccgucgccuucuacaaacgagcccuuaaagacuuuagccaucuagucggcaacugcucguucuucaccgacgaaaagcgcgcgcccaagaacucaccccucgcauucauguucguggcccuaacccgcaucaucaaccuccugaacaaccucaagaauacggaaggaauccuauacaccaaagacgaccucaacgcacuacuaaacgaaguucuaaagaacggcacccuaacauacaagcaaacuaaaaagcuccuaggacucuccgacgacuacgaauuuaaaggugaaaagggcacauacuucaucgaauuuaagaaauacaaagaguucaucaaagcacuuggcgaccauagccucucacaggacgaccucaacgagauagcaaaagacaucacccugauaaaagacgagauaaaacuuaagaaagcacuagccaaguacgaccucaaccagaaccaaaucgacucccucagcaaacuagaguucaaggaccaccucaacauaucauucaaggcacucaaauugaucacgccccuaaugcucgaagguaagaaauacgacgaagcaugcaacgaauugaaccugaaaguggccaucaacgaagacaagaaagacuuccucccggccuucaacgaaacguauuacaaagacgaagugaccaauccggucguccuacgagcgauuaaagaguaucgcaaaguccuaaacgcccuacucaagaaguauggaaaaguccauaagauaaacaucgagcucgcacgggaagucggaaagaacuacucacaacgcgccaaaauugaaaaagagcaaaaugaaaacuacaaggccaagaaagacgccgagcucgaaugcgagaaacugggccugaaaaucaacagcaaaaacauccucaaacugcggcuauucaaggaacaaaaagaguucugcgccuacucaggagaaaagaucaaaauauccgaccugcaagacgaaaagaugcuagaaauagaccacaucuaccccuacucacgcagcuucgacgacucauacaugaacaaaguccuagucuucacaaagcagaaccaagaaaaacucaaucagacgccauucgaagcguucgguaacgacucagccaaauggcagaaaauagagguccuagccaaaaaccuuccaaccaagaaacaaaaacgaauacucgacaaaaacuacaaagauaaggaacaaaaagacuucaaagaccgcaaccucaacgacacaagauacaucgccaggcucguacucaacuacacaaaggacuaccucgacuuccuuccucuaucggacgaugaaaacacaaagcucaaugacacccaaaagggaagcaaaguccacguagaagcuaaguccggaauguuaacauccgcgcuccgccacacauggggcuucagcgccaaagaccgaaacaaccacuugcaccacgcgauugacgccgucaucaucgcauacgcgaauaacuccaucgucaaggccuucuccgauuucaagaaagagcaggaguccaacagcgcggaacucuacgcuaagaaaaucuccgagcucgacuacaaaaacaaacgcaaauucuucgagccuuuuuccggauuccggcagaaaguguuagacaaaaucgacgagaucuucgucucgaagccggaacggaagaaacccagcggagcacuacacgaagaaaccuucaggaaagaggaagaguucuaccaaagcuacggcggcaaggaagggguccucaaagcgcuagaacucggaaagauccguaaggucaacggaaaaauaguaaagaacggcgacauguuucgcgucgacaucuucaaacacaaaaagaccaacaaguucuacgcaguccccaucuacaccauggacuucgcacuuaaaguccuacccaacaaagccgucgcacgaucuaagaaaggugaaaucaaagacuggauccugauggacgaaaauuacgaguucugcuucucccuguacaaagacucccuaauccuaauacaaacgaaagacaugcaagaaccagaauuugucuauuacaaugcauucacgaguucaaccgucagccucaucgugagcaaacacgauaacaaguuugagacucuaucgaaaaaccagaagauacucuucaaaaacgccaaugaaaaggaagucaucgcaaagucgauagggauccaaaacuuaaaggucuucgaaaaguacauagucuccgcccuaggagaagugacgaaggcagaauuucggcagagagaagauuucaagaaauga

SEQ ID NO: 6046 - RNA, 2958 nt, Artificial Sequence
  Cas9 variant
auggcaaaaauccuggccuucgacauuggaauaucguccauaggaugggccuucguggaaaacgacgaacucaaagacugcgggguucggaucuucaccaaagcagaaaaccccaaaaccggcgagagccucgccuugccccgccgacucgcacgaucagcacgcaagcgccucgcccguaggaaagcaagacucaaccaccucaaacaccugaucgcaaacgaauucaaacuuaacuacgaagacuaccaaagcuucgacgagagcuuggcaaaagcguacaaagguacccuaaucagcccuuacgaguuacgcuucaaagcccucaacgagcuacuguccaaacaagaccuagcacgagucauacuccacauagccaagcgccgcgguuacgacaauauaaaaaauucagacgacaaggagaaaggcgccauacuaaaggcagugaaagagaacgaagaaaagcuagcgaacuacaagucagucggcgaauaccucuacaaggaauacuuccaaaaauucaaggaaaacagcaaagaauucaucaacgugagaaauaaaaaagagagcuacgaacgcuguauugcgcaaagcuuccucaaggacgaacucaaacucaucuuccaaaaacaacgggaguuuggauucaacuucucgaagaaauucgaagaggagguccuguccguggccuucuacaaacgggcccugaaagacuucagccaucuugucggcaacugcagcuucuucguagacgaaaagcgcgcgccaaagaacucgccccucgccuucgaauucguggcgcuaaccagaaucgugaacuuacuaaacaaccuaaauaaaaacaacuccuacaucaaagacgaccuaaacgcacuccuauccgaaguacuaaaaaacggcacacucaccuacaaacaaacaaaaaagauucucggacucuccgacgacuacgaauucaaggggcaaaaaggcaacuacuucaucgaauucaagaaguacaaggaauucaucaaggcucuaugcgaacacaaccucaaccaagacgaccugaacgagaucgcaaaagacaucacccucgucaaggacgaaacaaaacucaaaaaagcgcucgccaaauacgaccucaaccaaaaucaaauagagaaccucagcaaaauagaguucaaggaccaccugaauaucucauucaaagcacucaaacugauagugccccuaaugcgagaagggaaaaaauacgacgaaguuugcaacgaacuaaaccugaagacggccauaaacgaagacaagaaagaguuccuccccgcauucaaugagaccuacuauaaagacgagguaaacaaccccgucguccuccgcgcuaucaaagaauaccgcaaagugcuaaacucccuccuaaagaaguacggcaaggugcauaaaauaaacaucgagcucgcccgagagguaggaaagaaccaccgcgagcgauccaaaauagaaaaagagcaaaacgaaaacuucaaagccaaaaaggacgccgagcucgaaugcgagaaacucggccucaaaaucaacagcaaaaacaucuugaagcuacggcuguucaaagagcagaaagaauucugcgucuacuccggcgaaaaaaucaaaaucucugaccugcaagacgaaaaaaugcuggaaaucgaccacauauaccccuacucacgguccuucgacgacagcuacaugaacaaaguccuuguauuuacgaagcagaaccaagaaaaacucaacaaaacccccuucgaagccuuuggaaaagacgacgucaaauggcaaaaaaucgaaaccuuagcaaagaaccuccccgccaaaaagcagaaacgcauccucgacaagaacuacaaagacaaggaacaaaaagacuucaaagaccggaaccucaacgacaccagauacauagcacgacuaguccuaaacuacacgaaagacuaccuggaguuccuuccgcucagcgacgacgaaaacauaaaacucaaugacacccaaaaagguagcaagguccacgucgaggccaagucagguaugcucacaucagugcuacgacacacauggggcuucagcaccaaggacaggaacaaccaucugcaccacgccauagacgcaguaaucaucgcguacgccaacgccuccguggugaaggcauucagcgacuucaagaaagagcaagaaaacuacacagccgaauuauacgcaaaaaaaaucaacgaacuggacuuuaaaaacaagagaaaauuuuucgaacccuucagcaacuuccgucaaaaaguacuugaaaagauagacgaaaucuucgucuccaaacccgaacguaagaaacccuccggugcccuacacgaggaaaccuucuacaaagaagaagaauucuacaaagaauacggcggcaaagaaggcguccuaaaggcacucgagcucggcaagauccguaaagucaacggcaaaaucgucagcaacgcaaacauguuuaggguggacauauucaaauacaaaaaaaccaacaaguucuacgccguuccuaucuacacaauggacuucgcacucgggauacuacccaacaaagcagucgucggaggcaaggacaagcaaggaaucaucaaagacuggcugcuaauggacgaaaacuacgaauucugcuucucgcucuacaaagacagccugauacugcuacagacaaaagacaugcaagaacccgagcucguauacuucaaaucauucaaaagcagcaccgccggccuaguaguauccaaacacgacaacaaauucgaaaaccugaacgaaaaccaaaaaaaacuauucaaguccgccaacgaaaaaaaagucgucgcggaagggaucggcauccaaaaccucaaaguuuuugagaaauacaucguaagcgcacuaggagagauaaccaaggccgaaauuaaagagcgagaaaacuucaaaaaaaaauga

SEQ ID NO: 6047 - RNA, 2961 nt, Artificial Sequence
  Cas9 variant
augccaucagacccugccgaggcaaaaccacuagaauugcuagaccccuacgcccuacgagcacaaggacuagaccaggcccucccgcugacacacuuuggacgcgcccuauuccaccucaaccagcgucgaggcuucaaguccaaccgcaaaacugacaggggagacaacgaaaacggaaaaauuaaagacgccucccaacgcuuggauugggccaugcacgaagcaaaagcaaggaccuauggagaguuccuacaccuacgccgccaaaaggccccagacccacggcaggucccaacaguccgcacccgucucuccgugggaaagagaggcggcccugaugccaaagaagaagcaggcuacgauuucuauccggacagacggcaccuagaagaagaguuccacgaacuguggucggcacaagcccaauuccaccccgaacucacucaagaccuaagagaccuuguuuucgagaaaauauuuuaccaaagaccacuaaaagaacccaaagucggacugugccucuucacaagcgaagaaagacuugcaaaagcacacccacuaacgcaaagacgugugcucuacgaaacuguaaaccaacuacguaucacagcagacggacgcagcgucaggccucucucgcgggaacagcgcgaccaaauaauacucgcucuagacacaaagaaaccgaccaaaucccuaaacuccauggucguaacccuacaagcacuaggcaaaguucucaagcuccgcgaaggagaacgauucacacucgaaucagggguacgagaagccauagcgugugaccccguccgugccgcgaugcuggccacuuucggaccaaggugguccgcccuagacuggccagaacaauggcaaguaauaagcagaguccggaaacuacaggacgacaaggacuucgcagaacuuguagaaugguuaaucgaacucuacggcgucgacaaagaagcagcuguaaaaaucgccaacacacaccuaccagaaggcuacggccgcuuaggacucacggccacaacaagaauccuagaccgucucaagagcaacguauucacauacgcccaagccguagcagcaugcggauggcaccacuccgaccaacgcacaggagagugccuggaccgacuaccauacuacggagccgucuuagaccgccacguaaucccgggcaccuacgaugaaaacgacgaugacaucacaagauucgggcgaaucaccaaucccacaguccauauaggccuaaaccaauuacgccgccuaguaaacaaaauaauagaaguauacggaaagccuaaccaaauuguaguagaacuggcgcgcgaacucaaacaaucagaacagcagaaaaaugacgccauaaagcugauccgagacaccacaaccgccgcaaaacaacggagcgaaaaauuagaagaacucggcauaaccgacaacggcagaaaccggaugcuccuaagacucugggaggaccuaaaccccgacgacgcaaugcgccgauucugccccuacacaggccaaagaaucucugcagcaaugaucuucgacggaucaugcgaugucgaccacauccuaccauacucacggacgcucgaugacggguucgccaaucgcacccuaugucugcgcgaggccaaccgcgagaaacggaaccaaacaccgugggaagccuggggcggcacgcccaacugggaagccauagaaacaaaccugaaaaaccuccccgagaacaaacgcuggcguuucgcccccgacgcgauggcgcgauuugaaggcgaaaaugacuuccuagacagggcccuagucgacacacaauaccuagcacgcauauccagaacuuaccuagacacacuauucaccgaaggcggccauguaugggucgugcccggcagacucacagagaugcugagacggcacuggggccuuaacagccugcucacagacaaagaccgaggcgcagucaaaucuaaaaaccgcacagaccaccgacaucauucaaucgacgcggcagucguggcugccaccgaucggucacuccugaaccgcauaucacgcgccgcugggcaaggagaaguggcgggucagagcgcggagcuuaucgcacgcgaaacacccccaccaugggaagguuuccgcaacgaccuaaaaucccaacuuggaagaauaaucgugucgcaccgcgcagaccacggcagaaucgaccgccaagccagaaaacaaggacgagacuccaccgcaggccaacuccaccaagagaccgcauacuccaucgucgacgacacccgagucgccagccgcaucgauuuucuaaguguaaagccagcccaacuccucgaccaacccggacgaucaggccagguaagggaccuacaacugcggaaagcacuacgcgucgcaacaggggaccucacaggcaaagacuacgaaaaagcacuaagagacuucgcagcaaaacccggcccauacaaaggcauccgucgcguucgaauaauaaaaccccuacaagagcaagcccgcgugcccguccccguccuugacccaauaaaagcguaccaaggagggucaaaccauguuuuugaaaucuggcaccucccugacgguaaggucgagccacaggucaucacgucauucgaggcccacgcccuggaaguugaaaaacgcccccacccagccgcaaaaaggcuacuccgaguacacaaaggagacaugguagcccucaaaagagaaggccguacggucgugggccauguccaacaaaugcacaucaaaaacggccucuuuauaguaccacacaacgaagcaaacgccgacgcccgaaacuccgacaggacagaccccuucaaauggauccaaauagcugcacaacccgcaauagccgcaggcauccgacgaguugcagucgacgagaucggacgccuccgggacggcggcgcuaaaacgaucuga

SEQ ID NO: 6048 - RNA, 2964 nt, Artificial Sequence
  Cas9 variant
auggcacggauacucgccuucgacauagggaucagcuccauaggcugggccuuuagcgaaaaugacgagcuaaaggauugcggagugcgaaucuuuacaaaggcagaaaaccccaagaccggggaaucgcuagcucugccgcgacgccuaagccgcucagccaggaagcgucucgcccgucgcaaagcacggcucaaccaccucaaacaccucaucgccaacgaguucaagcucaacuaugaagacuaccaaucuuucgacgagucccucgcaaaagcauacaaagggucacucaucagccccuacgaacugcgauuccgggcacugaacgaguuccuuagcaagcaagauuucgcgagagugauccuacacauugcuaaacgaaggggcuacgacgacauaaagaacaacggcgaugaagaaaagggcgagauucucaaggccauaaagcaaaacgaggaaaaauugguaagcuaucaauccgucggggaguaccucuacaaggaauacuuccaaaaauucaaggaaaacagcaaggaguucaucaacguccggaacaagaaggaaucauacgagagaugcauagcacaaucauuccucaaagaugaacuuaaacugaucuuccagaaacaacgcgaguucggguuuucauucuccaagaaauuugaggaagaaguccucuccgucgcauucuacaagcgcgcucucaaagacuucucgcaccucguaggcaacuguucauuuuucaccgacgagaaacgcgcacccaaaaacucaccccucgcauucauguucgucgcccucacgcgaaucaucaaucuccuaaacaaccucaaaaacaccgaaggcauccuauacacgaaggaugaccuaaauacccuacucaacgaaguacucaaaaacggaacgcucacauacaaacagaccaaaaagcuccuaggacuuagcaacgacuacgaauuuaaaggagaaaagggaacauacuucaucgaauuucagaaauacaaagaguucgucaaagcccuuggcgaacauaaccuaucccaagacgaucugaacgaaaucgccaaagacaucaccuuaaucaaggacgaaaucaaacucaaaaaggcccucgccaaauacgaucucaaccaaaaccaaaucgacucccucaguaagcucgaguucaaagaccaccucaauaucucauucaaagcccucaaacucauaacaccccuuaugcucgagggaaagaaguacgacgaagccugcaacgaacuaaaccuuaaaguagccauaaacgaggacaagaaagacuucuugcccgccuucaacgagacauacuacaaggacgaggucaccaaccccgucguacugcgggcgauaaaggaauaucgaaaaguccucaacgcgcuacucaagaaauauggaaaagugcacaagaucaacaucgaacuagcgagagaaguggggaaaaaccauagccagagagcaaaaauagagaaagagcaaaacgaaaacuacaaggccaagaaagacgccgagcucgaaugcgaaaaacucggacuaaaaauaaacagcaaaaacauccuuaaacuccgauuauucaaagaacagaaagaguucugcgucuacuccggagagaaaaucaaaauaucagaccuacaagacgagaaaaugcuggaaaucgaccacaucuacccauacagccgcagcuucgacgauagcuacaugaacaaaguacucguauucacaaaacagaaccaagaaaaacucaacaaaacaccauucgaaaccuucggaaacgaccgcguuaaauggcagaaaaucgaaguacuggccaaaaaucuaccaaccaaaaagcaaaagcgcaucuuggauaaaaauuacaaggauaaagaacaaaaagacuucaaagaccgcaaccugaacgacacccgcuacauagcacgccuagugcucaacuacaccaaggacuaccucgacuuccuaccccucagcgacgacgaaaacaccaaacugaacgauacccaaaagggcucgaaagugcacgucgaagccaaaucagggaugcuaacaagcacgcuacgccacaccuggggauucuccacaaaggaccgagacaaccaccuccaucaugccaucgacgccgccauaaucgcauacgcgaacaacuccaucgucaaggcuuucagcgacuucaagaaagaacaagagucaaacaccgcagaacuguacgccaagaaaauaucggagcuggauuacaaaaauaaacgaaaauucuucgagcccuucuccggcuuccgccaaaaacuacucgauaaaauugacgaaauauucguaagcaagccagaacgcaaaaagcccucuggcgcuuuacacgaagaaaccuucagaaaagaggaagaguuuuaccaaucauacggagguaaggaagggguccuaaaagcacuugaacucggaaagauccgcaagguaaacggcaagauggucaaaaauggcgacauguuccgaguggacaucuucaaacacaagaaaacgaacaaauuuuacgccguccccaucuacaccauggacuucgcccugaaaguacuacccaacaaagcugucguacagggcaaagacaagaaaagcggccucaucaaagauuggauccucauggaugagaacuacgaguucugcuucagccuuuacaaggacagccucauccucauccagacgaaagacaugcaagaacccgaacucgucuacuacgaacgccucgacuccaguaacgcaagccugaccgucuccaaacacgacaacaaauucgaaacccucuccaagaaccagaaaauacuguuuaagaacgcuaacgaaaaggaagucaucgcaaaaagcaucggcauacaaaacuugaaggucuucgaaaaguacaucgucagcgcacucggcgaggucacaaaagccgaguuccgccaacgagaagacuucaagaaauga

SEQ ID NO: 6049 - RNA, 2964 nt, Artificial Sequence
  Cas9 variant
auggcccgcauacuagcauucgacaucggcaucagcucaauaggaugggcauucucagaaaaugaugagcugaaagacugcggcgucagaauauucaccaaggcggaaaaccccaagaccggcgaaagccucgcacucccacgccgccuagccagguccgcacgcaagcggcucgccagacgcaaagcacgucucaaccaccuuaaacaucugaucgcgaacgaguuuaaacuaaauuacgaagacuaccaaucguucgacgagucacucgccaaagcguacaaggguucccucauaucccccuacgaacugagauuccgugcacucaaugagcuucuaaguaaacaggacuuugcacgcguaauacuccacaucgcaaaacgacgcggauacgacgacaucaaaaacuccgacgauaaggagaaaggggccauccucaaggccaucaaacaaaacgaagaaaaacuagccaacuaccagagcguaggggaauaccucuauaaagaauacuuccaaaaauucaaggagaacucaaaagaguucaccaacguccggaacaagaaagaauccuacgaacgcugcauagcccaaaguuuccucaaagacgagcucaaacuaaucuucaaaaagcaacgcgaguucggcuucuccuucuccaagaaauucgaagaagaaguccuaagcguggccuucuacaaaagagcgcucaaagacuuuucacacuuggugggcaacugcuccuucuucacugacgaaaagcgcgcacccaaaaacagcccacuugcuuuuauguucguggcacucacaagaaucaucaaucuccuaaacaaccugaaaaauacggaaggcauacuauacacaaaagacgaccuaaaugcccuccuuaacgaagugcucaaaaacggaacacugacguacaaacagacaaagaagcuccuaggccucagcgacgauuacgaguucaaaggagaaaaaggcacauacuuuaucgaauuuaagaaauacaaagaguucaucaaagcacuaggcgaccacucguuaagccaagacgaccugaacgagaucgccaaagacaucacauuaaucaaagacgagaucaaacucaagaaagcacucgcaaaguaugaccucaaucaaaaccaaaucgacagccugagcaaauuagaauuuaaggaccaccucaacaucuccuucaaggcacuaaaacuaaucacaccacugaugcuagaagggaagaaauacgacgaggccugcaacgagcuuaaccugaaaguagccaucaacgaagacaagaaagacuuccugccagccuucaacgaaacguacuauaaagacgaaguaaccaaccccgucgugcuucgagccaucaaagaauaccgcaaaguccucaacgcgcuccucaagaaauacggcaaaguccacaaaaucaacauagaauuggcgcgagaagucgggaaaaacuacagccagcgagccaaaaucgaaaaagagcaaaacgaaaauuacaaagcaaagaaagacgccgaacucgagugcgagaaacucggcuugaaaaucaacuccaaaaacauccugaagcuccgacuguucaaggaacagaaagaguucugcgcguacucaggagagaaaauaaagauaucggaccuacaagaugagaaaaugcuagaaaucgaccacaucuacccauacucccggagcuucgacgacagcuacaugaacaaaguacucgucuuuaccaaacagaaccaggaaaagcucaaccaaacacccuucgaagccuuugggaacgacuccgcaaaguggcagaaaauagaaguacucgccaaaaaccucccaacaaagaaacaaaaacgcauccucgacaaaaacuacaaagacaaagaacaaaaggacuucaaagaccgcaaucuaaacgacacccgcuacaucgcacgucuaguccuaaauuacaccaaggacuaccuagacuuccuaccgcuauccgacgacgaaaacacuaaacuuaacgacacccaaaagggcucaaaaguccauguagaggcaaaaaguggcaugcucaccagcgcccuccggcacaccuggggcuucucugcaaaggacagaaacaaccaucugcaccacgccauagacgccgucaucauagccuacgccaacaacuccaucgucaaggccuucagcgacuucaagaaagaacaagaguccaacagcgcggaauuauacgcgaagaaaaucuccgaacucgacuacaaaaacaaacgcaaauucuucgagccauucagcggguuccggcaaaaaguccucgacaaaaucgacgaaaucuucgucagcaaacccgagaggaagaaacccucaggcgcccuucacgaggagacguuccgaaaagaggaagaguucuaccagaguuacggaggaaaggagggaguccucaaagcccuagaacucggaaaaauacgcaaaguaaauggcaaaauagucaaaaacggagacauguuccgaguagacaucuucaagcacaaaaagaccaacaaguucuacgcaguaccaaucuacaccauggacuucgccuugaaaguccuuccaaacaaagcgguagcacgcucaaagaaaggagaaauaaaagacuggauccuaauggaugaaaacuacgaguucugcuucucacucuacaaagacucccugauauuaauucagaccaaagacaugcaggaacccgaacucguguacuucaaugcauucacaagcagcacaguaucacucauaguguccaagcacgacaacaaauucgagacccuaagcaagaaccagaaaauacuauucaaaaacgccaacgagaaggaagucauagccaaauccauaggcauccaaaaccuaaaaguauucgaaaaguacaucgugucggcacuaggggagguaaccaaagccgaguuccgccaaagagaagacuucaagaacgaacugcgguga

SEQ ID NO: 6050 - RNA, 2964 nt, Artificial Sequence
  Cas9 variant
auggcacgcauccucgcauucgacaucggcauaagcuccaucggcugggccuucucggaaaacgacgaacugaaagacugcggcguccgcaucuucaccaaggcggaaaaccccaagaccggcgaaucacuagcccucccccgccgucucgcccgcucggcaagaaaacgccuggcacgccgcaaagcgcgucuuaaccaccucaaacacuugauagccaacgaguucaagcucaacuacgaagacuaccagucguuugacgaaucacucgcaaaagccuacaaaggcagccuuauaucccccuacgaacuccgauuccgcgccuuaaacgagcuccuaagcaagcaagacuucgcacgcguaauccuucacaucgcuaaacgacgcggcuacgacgacauuaagaacaacggcgacgaagaaaagagcgagauccucaaagccaucaaacagaacgaggaaaagcucgucaacuaccaaagcgucggcgaguaccucuacaaagaauacuuccaaaaauucaaggaaaacuccaaggaguucauaaacguccgcaacaaaaaggaauccuacgaacgguguauagcccagucauuucucaaggacgagcucaaauuaaucuuccaaaaacagcgagaguucggauucagcuuuucuaagaaauucgaggaggagguccuaagcgucgccuucuacaaacgcgcccuaaaagacuucucccaccugguaggaaacugcaguuucuuuacggacgaaaaacgugccccaaagaacagcccccuagucuucauguucguagcccuuacgaggauaauaaaccuccugaacaaccucaaaaauacggagggaauccucuacaccaaagacgaccuuaacgcauuacucaacgaaguacugaaaaacggcacacucacauacaagcaaacgaagaaacuacuaggccugucggacgacuacgaguucaaaggugagaaaggaaccuacuucauugaguucaaaaaguacaaagaguucauaaaagcccucgacgaacacucucucagucaagacgaccuaaacgaaauagcgaaagacaucacucugaucaaagacgaaauaaaacuaaagaaagcccuagcaaaauacgaccuaaaggagaaccaaauagacagccuaaguaaacucgaguucaaagaccaccugaacauuagcuucaaggcccucaaacuaauaaccccacuaaugcucgagggaaagaaauacgacgaggccugcaacgaacuaaaccucaaaguggcgaucaacgaagauaagaaagacuuccuccccgcuuucaacgaaaccuacuacaaagacgaagucaccaauccagucguccuacgcgccauaaaagaguaccgaaagauccugaacgcccuacuaaagaaauacggcaaaguacacaaaauaaacaucgaacuagcccgagaaguaggcaaaaaccauucacaacgcgcaaaaaucgaaaaagaacaaaacgagaauuacaaagccaagaaagaugcagaacucgaaugcgaaaaacucggccuaaaaaucaacaguaaaaacauccucaaacuccgacuauucaaagaacagaaagaguucugcgucuacucaggagagaaaaucaaacucucagaccuccaagacgaaaagaugcuagaaaucgaucacaucuaccccuacucgcgcagcuucgacgacucguacaugaacaaaguccucguguucgcgaaacagaaccaagaaaaacugaacaaaacccccuucgaagccuucggaaacgacagcaccaaauggcagaaaauugagguccucaccaaaaacuugcccacgaagaagcaaaaacgcauucucgacaaaaacuacaaagacaaagaacaaaaagacuucaaagaccgaaaccucaacgacacgcgauacaucgcacgacuuguccucaacuacaccaaggacuaccucgacuuccucccacucuccgaugaugaaaacaccaagcugaacgacacacaaaaaggcuccaaagugcacguagaagcaaaaucaggcaugcuaaccuccgcccuacgccacaccuggggcuucucaaccaaggaccggaacaaccaccuucaccacgccauagacgccgucauaauagcauacgccaacaacagcauaguaaaagcauucagcgacuucaaaaaggaacaagaguccaauucggccgaacuauacgccaagaagaucuccgagcucgacuacaaaaacaagcgcaaauucuucgaacccuucaguggcuuccgacaaaaaguacuagacaaaaucgacgaaauauucgucuccaagccugaacgcaagaaacccagcggcgcacuccacgaagaaacauuucgaaaagaggaagaauuuuaccaaucauacggcggcaaagaagggguccuaaaagcccucgaacuagggaaaauaagaaaaguaaacgggaaaauuguaaagaacggcgacauguuccgagucgauauuuucaaacacaagaaaaccaacaaauucuacgccguccccauauauaccauggacuucgcgcuaaaaguccuccccaacaaagcaguagcacgauccaagaaaggcgaaauaaaagacuggauccuuauggacgaaaacuacgaguucugcuucucccucuacaaggacagcuugauacucauccaaacgaaggacaugcaagaacccgaacucgucuacuucaacgcuuucaccagcuccacaguaagucucauuguaucaaaacacgauaacaaguucgaaacacuaucgaaaaaccagaaaauucucuucaaaaaugccaacgaaaaagaaguaaucgcgaaguccaucggcauccaaaaccucaaagucuucgaaaaauacauagucagcgcacuaggugaagucaccaaggccgaguucaggcaacgagaagauuucaaaaacgaacuaagguga

SEQ ID NO: 6051 - RNA, 2964 nt, Artificial Sequence
  Cas9 variant
auggcccgcauccuggccuuugacaucggaauaucaagcauaggaugggccuucagugaaaacgaugagcucaaagacugcggcguucgcaucuucacaaaagcggaaaaccccaaaacaggggagagccucgcgcucccucgacggcucgcacgaucggcacgcaagcggcuggcccgacgaaaagcaagacucaaccaccugaaacaccuaaucgcaaacgaguucaagcugaacuaugaagauuaccagagcuucgacgagucgcucgccaaagccuacaaagggucucuaaucuccccauacgaacuucgauuucgcgcucugaacgagcucuuauccaaacaggacuuugcccgcguaauccuucacauagccaaacgacgcggcuaugacgacaucaagaacuccgacgacaaagagaaaggcgcaauccuaaaagccaucaagcaaaaugaagaaaaacuagccaacuaccaauccguaggagaauaucucuacaaggaguauuuccaaaaguucaaagaaaacagcaaagaguucaccaacgucaggaauaaaaaggaauccuaugaaagaugcauagcccaaucauuccucaaagacgaacuaaaacucaucuucaaaaagcaacgcgaguucggcuucucguucucaaagaaauucgaagaagaaguacuuagcguggccuucuacaaacgcgcacuaaaagacuucucccaccucgugggcaacugcuccuucuuuaccgacgaaaagagagcccccaaaaacuccccacuggccuucauguucgucgcccucacccgcauaauaaaccuccugaacaaccuuaaaaacacagaaggaauacucuacacuaaagaugaccuaaacacgcuccugaacgaaguccugaaaaacgggacccucaccuacaaacagaccaagaaacuucuaggccucucggacgacuacgaguucaaaggagaaaaaggcaccuacuucaucgaauuuaagaaauacaaagaguucauaaaagcacucggcgaacacaaccuuucgcaagacgaccuaaacgaaauagccaaagacauaacacugaucaaagacgaaauaaagcuaaagaaagcccuugccaaauacgaccucaaccaaaaccagauagacagccuaagcaaacuugaguucaaggaccaccuaaacaucucauucaaggcccucaagcucgucacgccacugauguuggaagggaagaaauacgacgaagccugcaaugagcuaaaccuuaaaguugccauaaacgaagacaagaaagacuuccucccagccuucaacgagaccuacuacaaagacgaggugaccaacccagucguccuucgcgcaauaaaagaauaccguaaggugcuaaacgcgcugcuaaagaaauacggaaaaguacauaaaaucaauaucgaacucgcccgcgaagucggcaaaaaccacucccaacgagcgaagaucgaaaaagaacaaaacgaaaacuacaaggcuaagaaggacgcggaacuagagugcgaaaagcuaggacucaaaauaaacagcaaaaacauacucaaacugcgccuauucaaagagcaaaaagaguucugcgcauacagcggugagaaaaucaaaaucuccgaccugcaagacgagaaaaugcucgaaauagaccacaucuauccauacuccagaucauucgacgacucauacaugaacaaaguccucgucuucacaaaacagaaccaggaaaaacugaaccaaacccccuucgaagcguucggcaacgacuccgccaaauggcagaaaauagagguccuagccaaaaaccuaccgacgaagaaacaaaaacgaauccuagacaaaaacuacaaagacaaagaacaaaagaacuucaaggaccgcaaucucaacgacacgcgcuacaucgcccggcucguccuaaauuacaccaaagacuaccuagauuuccugccccuaagcgacgacgaaaacaccaaacuuaaugacacccaaaagggcucaaaaguccacgucgaagcaaagucgggcaugcuaacgucagcccuacgccacacuugggguuucucugccaaggaccgcaacaaccaccuacaccacgccauagacgcugucaucaucgcguacgcaaacaauagcaucgucaaagccuucagugacuucaagaaagaacaagaaucaaacucugcugaacucuacgcgaagaaaaucucggagcuggacuacaaaaacaaacgaaaauucuucgagcccuucagcggcuuccgccaaaaaguacucgacaaaaucgacgaaaucuucgucuccaagccagaacggaagaaacccagcggcgcgcuacacgaagagacguuccgaaaagaagaagaguucuaccaaagcuacggaggcaaagaagguguacuuaaagcacucgaacucggaaagauccguaaaguaaacggcaaaaucguuaaaaacggcgacauguuuagaguagacauauucaagcacaagaaaacaaacaaauucuacgccguccccauauacaccauggacuucgcccucaaagugcugccaaauaaagccgucgcccgcuccaagaaaggcgaaaucaaagacuggauccuaauggacgaaaauuacgaguucugcuucagccucuacaaagacagccucauucuaauccagaccaaagacaugcaagaacccgagcuagucuacuucaacgccuucaccagcuccacuguaucccucaucgucagcaaacacgacaauaaauucgaaacccuauccaagaaccagaaaauacuguuuaaaaacgcaaacgaaaaggaagucauagccaagucuauaggaauccaaaaccugaaagucuucgaaaaauacaucgucucagcacuaggcgaagucacaaaggccgaguuccggcaacgagaagacuucaaaaacgaacuccgcuga

SEQ ID NO: 6052 - RNA, 2964 nt, Artificial Sequence
  Cas9 variant
auggcacgcauacuugccuucgacaucgguaucaguuccaucggcugggcuuucagcgagaacgacgagcuaaaagacugcggagugcgaaucuuuacaaaagcggagaaccccaagacaggagaaucgcuagcccucccccgccgacucgcgcgcuccgcccggaaacggcucgccagacggaaagcaagacuuaaucacuuaaaacaccuuauagcaaacgaguucaaacucaacuacgaagacuaucaaucauucgacgaaagccuagcaaaggcuuacaaaggcucgcuuaucagccccuacgaacuacgauuuagggcccucaacgagcuccucuccaagcaagacuucgcgaggguaauacuucauaucgccaaacgccgaggcuacgacgacauuaaaaacuccgacgacaaggaaaaaggggccauacucaaagccaucaaacagaacgaggaaaaacuagcaaacuaucagucagucggagaauaccuguacaaagaauacuuccaaaaauucaaggaaaauagcaaagaauuuacaaacgugcgcaauaagaaagagagcuacgaacgcugcauagcacaaucauuccuuaaagacgaacucaaacuaauauucaagaaacaacgcgaguucggauucagcuucucgaagaaauucgaagaggaaguccugucaguggccuucuacaaaagggcgcucaaagacuucagccaccucgucggaaacuguuccuucuucacagacgaaaaacgagcccccaaaaacucaccccucgccuucauguucguggcccucacccgcaucauuaaccuccucaacaaccucaaaaacaccgaagggauacuguacacgaaagacgaccucaacgcucuccucaacgagguguugaaaaacagcacccuaacauacaaacaaaccaagaaacuccucggccucagcgacgacuacgaguucaaaggagaaaaagggacuuacuucauagaguucaagaaauacaaagaauuuaucaaagcccuaggcgaccacucccuaucccaagacgaccuaaacgaaauagccaaagacaucacccugaucaaagacgaaauuaaacucaagaaagcccuggcaaaauacgaccugaaccaaaaccaaaucgacagccucagcaaacuagaguucaaagaccaccuaaacaucucauuuaaagcacugaaacuaauaacaccccuaaugcucgaagggaagaaauacgacgaagcaugcaaugaacucaaccugaaggucgcaaucaaugaagacaagaaagacuuccucccggcuuuuaaugaaaccuacuacaaagacgaagucaccaaccccgugguacuccgcgccaucaaagaauaccggaaaguccugaacgcccuacucaagaaauacggaaaaguccacaaaauaaauauagaacuagcccgagaaguagggaaaaacuacagccagagagccaaaauagagaaagaacagaacgaaaacuauaaggcaaagaaagacgccgagcuugagugcgaaaaacucggccucaaaauaaauuccaaaaacauccuuaaacuacgccucuucaaagaacagaaggaguucugcgccuacagcggagagaaaaucaaaaucucggauuuacaagacgaaaagauguuagaaauagaucacauauacccauacuccagguccuucgacgacucauacaugaacaaaguccucguauucacaaaacaaaaccaagagaaacucaauaagacacccuucgaagcauucgggaacgacucagcaaaguggcaaaagaucgaggugcucgccaaaaaccuaccaacuaaaaagcagaaaagaauccucgauaaaaacuacaaggacaaggagcaaaaggacuucaaagaccguaaccucaacgacacccgcuacaucgcgcgccuaguguuaaacuacaccaaggauuaccuagacuucuugccucucuccgacgacgaaaacacaaaacucaacgacacccaaaaagggucgaaaguacacgucgaagccaaaagcgggaugcuaaccagugcccuccgccacaccuggggauucucagcgaaagaccgaaacaaucaccuacaccacgcgaucgacgcagugaucaucgcauacgccaacaacagcaucgucaaagcauucucagacuucaagaaagaacaagagagcaacagcgccgagcucuacgccaaaaagaucuccgaacucgacuacaaaaacaaacgcaaauucuucgagcccuucagcggcuucagacaaaagguccuagacaaaauugacgaaaucuucguuagcaagccugagagaaagaaacccagcggagcuuuacacgaggagaccuuccggaaagaagaagaguucuaccaaucauacggcggcaaagaaggggugcuuaaagcccucgagcucggcaaaauacgcaaaguuaacgggaaaaucgucaaaaacggcgacauguuccgcguagacauauucaaacauaagaaaacaaacaaauucuacgccguacccauauacacgauggacuuugcacucaagguccuccccaacaaagccguggcccgcucaaagaaaggcgaaaucaaggacuggauccugauggacgagaacuacgaguucugcuucagccuuuauaaagacucacuaauccugauccaaaccaaagauaugcaagaaccagagcuagucuauuucaacgccuucacaagcucaacagucagccugaucgucucaaaacacgacaacaaguucgagacccuguccaaaaaccagaaaauccuauucaaaaacgccaaugagaaagaagucaucgcgaaaagcaucgguauccaaaaccugaagguauucgagaaguacaucguauccgcccucggagaagucaccaaagccgaguuccgccaaagggaagauuucaaaaacgaacucagguga

SEQ ID NO: 6053 - RNA, 2964 nt, Artificial Sequence
  Cas9 variant
auggcaagaauacuagcauucgacauaggcauaagcuccaucggcugggcauucucagagaacgacgaacucaaggacugcggcgugcgcaucuucacgaaagccgaaaacccgaagacaggagaaucacucgcacucccccgcagacuagcccgcuccgcgcgaaagcggcuagcgcgucgaaaagcacgacucaaccaccucaagcaccucaucgccaaugaguucaagcucaacuacgaagacuaucaguccuucgacgaaagccuagccaaagcauauaaaggcucgcuaauauccccauacgaacuucgguucagagcccucaacgagcuacuuagcaaacaggacuuugcacgggugauacuucacauugcaaaacgccgcggauacgacgacaucaaaaacagcgacgacaaagagaaaggagcaauucucaaagccauaaaacaaaacgaggaaaaacuugccaacuaccaauccgucggggaauaucuauacaaagaguauuuccaaaaguucaaagaaaacucaaaggaguucacgaacguccgaaacaaaaaggaaagcuaugaaaggugcauagcccagagcuuccucaaggacgaacucaaacugaucuucaagaaacaacgcgaguucgguuuuaguuucagcaaaaaguucgaagaggaaguccucucgguggcauucuacaaacgagcucucaaagacuuuucacaccuagugggcaacuguucauucuucaccgacgaaaagagggcccccaaaaacucaccacuagcguuuauguucgucgcacucacccgcaucaucaaucuacucaacaaccucaaaaauaccgaaggcauccuauacacaaaagacgaccucaacgcccuucucaacgaaguccucaaaaacggcacccucacauacaagcaaaccaagaaacuccucgggcuaagcgacgacuacgaguucaaaggggaaaaaggaaccuacuucauagaguucaaaaaguacaaagaauuuauaaaagcacugggcgaccacagccucucccaggacgaccucaaugaaauagccaaagacaucacacucauuaaggacgaaaucaaacugaagaaagcgcucgccaaauacgaucugaaccaaaaccaaaucgauucccugagcaaacucgaguuuaaagaccaccucaacaucagcuucaaggcacucaaacucaucaccccacucaugcuagaaggaaagaaauacgacgaagcgugcaaugagcucaaccugaaaguagcaaucaacgaagacaagaaagacuuccuacccgccuucaacgaaacguacuacaaagaugaggucacgaacccgguuguacuccgcgcaauaaaagaauacaggaaagugcugaacgcccuacugaagaaauacggaaaagugcacaaaaucaacaucgaacucgcacgagaagucgggaaaaacuacagccaacgcgcgaaaaucgaaaaagagcaaaacgaaaacuacaaagcaaagaaagacgccgaacucgaaugcgaaaaacuaggacugaaaaucaacuccaaaaacauccuaaaacuccgccucuuuaaggaacaaaaggaauuuugcgcuuacagcggggaaaagauaaagauaucagaccuacaggacgagaaaaugcuggaaaucgaccacaucuacccauauagccgauccuucgacgacagcuacaugaacaaggugcugguauucaccaagcagaaccaagaaaaacucaaucaaacccccuucgaggcguucggcaacgacuccgcaaaauggcaaaagaucgaaguauuagccaaaaaccuacccacgaaaaagcagaaaagaauacucgacaaaaacuauaaagacaaagagcaaaaggacuucaaagacagaaaccugaacgauacccgcuacaucgcaagauugguccucaauuacacgaaagacuaccuagacuuccuaccccucagcgacgacgaaaacacaaaacuaaacgauacccaaaaagguuccaaagugcacguggaagcgaaaucaggcaugcuuacauccgcucuccgccacaccuggggauucagcgcgaaggaccgaaacaaccaccuccaucaugcaaucgacgcagucauaaucgcauacgcaaacaauagcaucgucaaggccuuuagcgacuucaagaaagaacaagaaagcaacuccgccgaacucuacgccaagaaaauuagcgaacuggacuacaaaaacaaacgcaaauucuucgaacccuucuccggcuuccgccaaaaaguccuggauaaaaucgacgaaaucuuugucagcaaaccagagagaaagaaaccgucuggcgcccuccacgaggaaacauucagaaaagaggaagaguucuaccaaagcuauggaggcaaagaaggcguccuaaaagcacucgaacugggaaaaauccgaaaggucaacggcaagaucgugaaaaacggggacauguuccgaguagauaucuuuaaacacaagaaaacaaacaaauucuacgccgucccaaucuacacaauggauuucgcacuaaaagucuugcccaacaaagccgucgcccgcucgaagaaaggcgaaaucaaagacuggauccuaauggacgaaaacuacgaguucugcuucucccucuacaaggacagccuuauucucauccagacuaaggacaugcaagaaccggaguucgucuacuacaacgccuucaccagcucgaccgugagucuaauaguauccaaacacgacaacaaauucgaaacacuaagcaagaaccagaaaauccucuuuaaaaacgcuaacgaaaaggaagucaucgcaaaaucgaucggaauacaaaaccugaaaguauucgaaaaauacaucguuagugcccucggggaaguaaccaaagccgaguucaggcaacgggaagacuucaaaaacgagcucagguga

SEQ ID NO: 6054 - RNA, 2979 nt, Artificial Sequence
  Cas9 variant
augagaauauucuccgacggaaggaacccaaaggacggcaguucccuggcagucacgcgcagagcagcccgggcaaugagaagaagaagagacagacuacucaaaaggaaaacgcgaaugcaagcgaaacugguggaacacggauucuucccagccgacgcagggaaacgcaaggcacucgaacaacucaacccauacgcccuccgggcaaagggauuacaagaagcacuccucccaggggaauuugcccgggcacuauuccacauaaaccaaaggagaggauucaaaagcaacagaaaaaccgacaagaaagacaacgacuccggaguccuaaagaaagccauaggacagcucagacaacagauggccgaacaaggaaguaggacggugggagaauaccuauggacaaggcuacaacagggccaaggcguacgugcacgauaccgagagaaaccauacacgacagaagaagggaagaaaagaauagacaaaaguuacgacuuauacauagaccgugcgaugauagagcaagaguucgacgcgcugugggcagcccaagcagcauucaauccaacacuauuccacgaagccgcacgagcggaccugaaagacacacuacuccaucaacggccacuacgaccagucaaacccggccggugcacccuccucccagaagaagaacgggcaccacuggcacucccgagcacgcaacgguuccggauccaccaggaaguaaaccaucuacgacuccucgacgaaaaccuacgggaagucgcacucacccucgcccaacgagacgccguaguaaccgcacucgagacaaaagccaaacucaguuucgaacagauaagaaaacucuugaaacucucgggcucaguacaguucaaccucgaagacgcgaaacgaacagaacucaaaggaaacgcaacaagcgccgcgcuagcacgaaaagaauuauucggagcagcguggagcgguuucgacgaggcgcugcaggacgaaauaguauggcagcuggucaccgaagagggagaaggcgcauugaucgcauggcugcaaacccacaccggcguggacgaagccagagcccaggcgauugucgacgucucacugccagaaggauacgggaaccuaagccgcaaagcccuggcaagaaucguuccagcacugagagccgcagugauaacauaugacaaagcaguccaggcagcgggcuucgaccaccacagccaacuaggauucgaguacgacgcgagcgaaguagaagaccucguacaccccgaaacaggcgaaauaaggaguguguucaaacaacuaccauauuacggcaaggcccuacaaagacacgucgcauucggaaguggaaaacccgaagacccagacgaaaagcgguacggaaaaauagcaaaucccaccguacacauaggacugaaucaaguacgaaugguaguaaaugcauuaauacgcagguacggaagacccacagagguagucauagaacuggcgcgagaucuaaagcaaucccgcgaacaaaaaguagaagcccaacgcaggcaagcugacaaccagagacgaaaugccagaaucaggcgaucaauugcagaaguccuaggaauaggugaagaaagggugcggggaagcgauauccaaaaauggaucugcugggaagaauugagcuucgacgccgccgaccgaaggugcccauacucaggaguccaaauaagcgcggccaugcuacuaagcgacgaggucgaaguagaacacauucuacccuucagcaagacccucgacgacagucuaaacaacagaacggucgcgaugaggcaagcaaacagaaucaaaaggaaccguacgccgugggacgcgcgagccgaauuugaagcgcaaggguggagcuaugaagacauacuccaacgggcagaaagaaugccacuccgaaaacgcuaccgauuugcacccgacggauaugaaagauggcugggcgaugacaaagacuuccuagcgcgagcucucaacgacacaagauaccugagcagagucgccgccgaauaccuaaggcuaguaugccccggaacaaggguaauccccgggcagcucaccgcgcugcugagaggcaaauucggacuaaacgacgugcuagggcuagacggugagaaaaacagaaaugaccacagacaccacgcgguugacgcaugcguaaucggagugacagaccaaggucuaaugcaaagauucgcgacagcaagcgcccaagcgagaggagacggccuuacccgacuggucgacgggaugccaaugcccuggccgacauaccgcgaccacgucgaaagagcagugagacacaucuggguaucucaccgaccggaccacggguucgagggagcaaugauggaagaaacaagcuacggaauaagaaaagacgggagcaucaaacaacgacgcaaagcagacggaagcgccggcagagaaauaucuaaccucauaagaauccacgaagcaacacaaccacugcgccacggagucagcgcagacggacaaccacuagcauacaaaggcuacguggguggaaguaauuacugcaucgaaauaaccguaaacgacaaaggaaaaugggaaggcgaagugauauccacguuucgcgcguacggagucgucagagcagggggcaugggaaggcucagaaacccacacgaaggccaaaacggacgaaaauuaauaaugagacugguaauaggcgacucaguaagacucgaaguagacggggcggaacgcacaaugagaauagugaaaauaagcgggagcaacggccaaauauucauggcacccauacacgaagccaacguugacgcgagaaauacagacaaacaagacgcguuuacauacacaagcaaauacgcaggcucacugcagaaggcgaaaacgagaagagugacaauaucaccgauaggcgagguacgggacccaggcuucaaaggauga

SEQ ID NO: 6055 - RNA, 2985 nt, Artificial Sequence
  Cas9 variant
augacacucgggcuagaucucggcaccaacuccaucggaugggcacugauagacuucgacgacaaccaacagccaagaaaccugaucgcgugcggcagccgcaucuuccaagaagccguagaagccaaaacgggcacacccaaaaaccacgcgcggcggacagcaagagcagcccgcaaacuggucgcacgacgcaagcaacgccgcacaaaacuacugaaccuccuaauacgccacggccugcucccacaggacgucgccgagcgaaacgcccuucuccuagauaaccaagcaaacaacccauaucaacuccguaaacgaggccuugacgagaaacucgaaccauucgcauucgggagagcccuguaucaucucgcgcaccgcagaggauuccaaucaaacaggaaagcggccuccgacgaggauggcaaagucaagaccgcaaucucuacgcuaagagccgagaugcaaggacgaacacugggcgccuuccucgcagaccaacccacccaacgacgcagauacaccgaucgggccauguaugucgaagaguucgaacagcucugguccaaacaagccuccuucacacaagaacaacucacccaggcccuaaaaguagcaauccacaauucaaucuucuuccaacgaccccugaagucacagaaacaccucguuggcaagugcaccuucgagcccacacgcaagagggcagccaaagcgauacuccucacacaacgauuccggauccuccaagacgucaaccaccuagcgguaaagaaucccauaacacgagaguuccgcccccuaacccaggacgaacggaacaaacuagcagaagcacuagacaaacaaaaaucaaugaccuggggugcaguacgcaaggucaucggguggaacaagaaagacucccuccacgagggagagacguuuaaccucgaagagggaaagaaagacaaacucaucggaaaccgcaccgcaugcgaccuccggggcgcccucggcgaucgcugggacgcacucacagcacaacaacaagacgaccuuguaaccgaucugcuaacaauagacaacacagacggcuuucucaagaggaugaaaacccauugggaguucgacgacgccaccgcggaagugauugcgaaaaucgagcuagaacccggcuacgcccgucucucugcgaaagccaugagagcaauacugccauaccucgagcaaggcaugaucuacucagacgccugcaaagcggcgggauacgaccacagcaaccccaaccaacguaccauuacggauaagcucggccucccauccaauguccgcaaccccgucgugcaaaaagcccucuucgaaacacgcaagguaguaaacgcgaucguccgaaaauacggaaaacccgcgguaauccgaguagaaauggcacgcgacaugaaacuaucaaagcgccaaaaagaggaacuucaaaaagagcaaaacaaacagaaaaaggccaacgaacucgccgaagggauacucagaaaagaguucggcauacaacaaccagcacgcgcagauauacaaaaauauaaccuauggcuugaaugcaaggaggucugccccuacaccgggaccaccauaucccgcgaaaugcuauuuagccccgaagucgacgucgagcauauacuucccuacucacggagucuggacgacagcuacaugaacaaaacacucuguauggcaacuuucaaccgccaagugaaauuaaauaauacaccauacgaaaucggacaaggcgacccccuggccuacgcagaaaucuuccagcgaauaaagacucucccauucccgaaacgacgacgguucgaacaaaaagaaauagaaacggacaaauuuaucgaaagacagcuuaacgacacccgguauauaugcguagaaguacgggacuuccuacaacaacucggcgcaccagucgaaguaagcaaaggcgaagcaaccgcaaaacuccgcggaagguggaagcucaacacacuucuaucacccgacgguagcaaugaaaaauacagaggggaccaccgccaccaugcaauagaugccgucguaaucgcguugaccaaccgaucacuguuccacaaauuaagccgccuguccgcacaaagcauuucccucgauaaaucccgauuugacguacccccaccaugggacggcuucuacgacgacgucuaugagaaaauagacaaagugaucgucagccacgccccggcacgcaagauaggcggagcgcuacacgaagacaccgcauacggucacuucaaggaagaagucgcggacccaaaaaccgguaaagugagcauagaagaccgauucguauaccgcaagccccuggccacacugacagcaaacgaagugggcaagauccgcgaugcuaaaguacgagaguucgucgaagccaggcuagcccaauuuggcaacaacagcaaaaccgcauucggcgacccaaauaacccccuccuccacgcagacggcaaaacccccauacgaaccguccggcucguaaccaacuucaacaaggcaacgacgcacgcaauccaaaaaggacaaggcagagacuacaaauucuucaaauauggcaacaaucaucacgucgaaauaauagaacacguagaaacaggaaaacggaagggcaucuucgucacagccauggaagcggcccggagaguccgaggggucgcgaacaccgaaaagagugacaucguacaaaggaaccacggagaagaauggagauucguaaugucauugagcauuaacgaccuuguaucgauacaagaggcagaccagguaaggaucaugcgaguccaacuauucgacgcauccaacggcaacauaaucuuccgagaccaaaaguccgcuaugcucgacgauaaacuauccagauaccagacuaaagcccaccuccucgucugccagaaaauaaccacagacccacuaggaaaucuagccccgugcaacgacuga

SEQ ID NO: 6056 - RNA, 2988 nt, Artificial Sequence
  Cas9 variant
augagcaaggugcugggccuagauauaggagccaacagcauuggcugggcccucauagacgacgaagagaacgacaucaucggcgccggcguccgcgucuucaaagaggggguaaaccucaaaggcguaaaggaagaaaguaagaacgucgagcggcgggccgcccgccuagcgcgacggcaacacaaaagacgcagccaacgccgcaaccggcugguggcucuacucaagacccucgaaauguuccccgagaacaacgaggacaucagugauuacuacgcacaagacccuuacgaacucaggaagaaaggccuauacgaaaaacugaccauguacgaguucggccgcguccuucuccacaucugcaggcgacgaggcuucaaaagcagccggaaaaccgacaucagcgaagaagggaaaauauucgaaggcaaagacgggauagugggaaucaaccaaacaagagacagcauccgcgagggcggauucaaaaccaucggugaauaucucgcaagccuagacccccaugucauacgaagacgaaaccgcuucacacuacgcgacauguacgaggaagaguucaaccucaugugggaaaaacaacaaaguuucuacccccuacagcugagcaacgaguucaaggaagccauagcggaagucauccuaagucaaaggaaacuaaagagccagaaagcccucgucggcaacugcggacuagaacccaacaagaaaaccgcaccgaaauccagcccagcauuccaauacuucaggauacuugaacagcuauccagaauccuaaucuccaucccacacaccggccguuacaacgacccccucaacgaagaggagcgcaggaugcucauugacaaauuaaguguaaccgaaaaacuaaaauucucugacaugcggaaaaugcugaaucuaccaggggaguccgauauaaacaucgaagaggaaggcggaagacuccuaggcaacacaacauacgccagauuaauaaaagucuucggcaagaaacgaugggccggauucagcgaagaagaaaaagaacaaauauggcauacguuccauuucgcugacaaccacgaauggcucaaagaauacgcacucaagaaauggucaaucacaccggacgaaauaaaggaacuagguaaaguggcacuagagaaagaauacgcacguuucagcaagaagucacugaaaaagaucauaccacaguuagaagagggacugacgcuggacaaagccaaaaucgaagccgguuacacccccgaauacgaaaucgagaaaagccucagcgccuaccuaccccuccccgaaaacauccgaaacccaauaguccaacaagcccucuacgagcuccgacacguugucaaugcgguaaucaggaccuacggcaagcccgauaucgccagaguagaacucgcaagagagaugaagaagcccaaacaaaagcgcgagaaaaugcgcucggaacuacggaagagacagaugaaguucgaagaaauaaaaagcaucuuaaaggaaagacucggcuuuauagacccaaaacgcgaugaaauccacaaauacaugcucugggaggaaugcagagaaacaugcccauacaccggccgcaaaaucagccuaagugcccuguaugggggcgauuucgaaguugaacacaucauccccuacaaacgaucccuagacgacagccuauucaacaagacgguaugccuuagagaggaaaaucaaaucaaaggagaccgcaccccguacgaagcauacagcggcgaccgacaaaaauacgaagaaauaauccuccgggugcagaaaacgagcaugcccagaggcaagaaaaaccuauucgcgauaaaagaacucaaggacgacuucgcccaccggcaacuguccgauacagccuacauaucccgggaaacccgaaaauaccuggggucaaccaucaaaaagguacaagcggugaaaggaggcuccaccgccaaacuacgcuacuacuggggacucaacaguauauuagggguacgcgacauaaaaaugcgcgacgaccaccgccaccacgcaguggacgcacuggugaucgccaacacaacauacgcauuugucaacacacuuagcagguaccacuccauggacguagaaccacacgaaucgcgguucccccuaccgugggaacaauuccgaaacgacgcagaaagcguagugagaaacaucuucguaagccacagacucggcaagaaagccacuggccaacugcacgaagaaaccuacuacggaaaaauacgcaauacagacggagaaccauacuucguaguaaggaagaaacuaggcacccuaacggccaaacaaauagcgaacauagucgacccaguaguaaaaacccaagucuucgaacgccuagaagaaaaaggcaucgacauagaaucaagcaacaaaauacccgccgacgcguucguagagacacuguacaugcccgaccgaaaaacacccaucaaguccguccgcgucaagguaccuuccaccacaaugauucaacucuacaaggacaaagagcuauacguagaccccgggagcaaccaccacaucguaaucuucgaaaacgaagagggcaaaagagacggcauaguaguaagucuguucgaagccgcccaaagacuucggcgaaaugagccggucauacagaaaaccuggaagcccgaguggcacuucgugaugucacuaucaaucgacgaacuaauacuucuagacgucgacgaaaagaacauagacuggggcgacacagggcuagcccucagguacuccaaagcacuguacaggguccagaaaauggacgucaacaagaucauaacccuacgacaccaccuaguagcccgacugaaagacgacgaagggaaagaguucgggcgcgaacaccgaauaccaagcacacugaggggacuaaaagucaaaauagaccacaucggcagacugaggcgcgccuacgacuga

SEQ ID NO: 6057 - RNA, 2988 nt, Artificial Sequence
  Cas9 variant
augaaagucaucggcuucgacaucggaaucaacucgaucggcugggcguuuguugaaaacgacgaacucaaagacugcggaguacguaucuucaccaaagcggaaaaccccaaaaacaaggagucccuagcccuaccgcgucgaaacgcccgguccucacguaaacgccucaaacgcaggaagcuccgacucaucgcaaugaaacacaucuuggcgaaagagcuaaaccuaaauuacaaagacuacaucgcaaacgacggagaacuaccgaaagccuacgagggcaagcuaaucucaccauaugaacuccgcuacaaagcacucaaccaaaagcuagaggccaaagaccuaguacgugucauucugcacaucgccaaacaccgaggcuacaugaauaagaacgacaaaaagagcaacgaugcagagaaagggaagauccugagcgcucucaaaaauaacgcucuaaagcuagaaaaguaccaaucggucggggaauacuuuuacaaagaauuuuuccaaaaauacaaggaaaacaccaaggacuuuauaaagauacgaaacauaaaggacaacuacaacaacugcguucuggccagcgaccuugaaaaagaacuaaaacucauccucgaaaagcaaaaagaguucggguauagcuacuccaacgacuucaucgaagaaguaauucaggucgcguucuuucaacggccacugaaggacuucagucaccuugugggcacaugcaccuucuucgaagaagaaaagcgagccugcaaaaacagcuacagcgccugggaguucgucgcacuuaccaagauugucaacgaauuaaagagccucgaaaagaucucgggcgagcugaucuccacccaaacgaucaacgaaauccuaaacuacauacuggacaaaggguccaucaccuacaagaaauuccgaucauacauaaaccucuaugaaagcauaaaauucaaaucacucaaguacgacaaggacaacgcagagagcgccaaacuaaucgacuuccggaaacucgucgaguucaagaaagcacucggagaacacuacuuuaaccgacaagaacucgaccaaauaagcacauacaucacacuaauaaaagacaacgucaagcuaaagaccgcauuagaaaaguauaaccucuccaacgaacaaaucaacaaucuccucgaaauagaguucaaugaccacaucaaccucagcuucaaagcacuauccaugauacuaccccucaugaaggaaggcaagaaauacgacgaagcaugcgaaauugcaaaccucaaacccaaaaccacaaaccaaaaacaagacuuccuacccgccuucugcaacagcauauuuguccacgaacucagcaaccccauagucaaucgcgcgauuuccgaauaccgaaagguacucaaugcccuccuaaagaaauauggcaaaguucacaagauacaccucgaacuugcgcgagacaucggccuguccaagaaagcaagagagaaaaucgaaaaagaacaaaaagaaaaccaggccaucaacacaugggcacucaacgaaugcgaaaacaugggaaucaaagccaaugccaaaaacauccuaaaguuaaagcuauggaaagaacaaaaagaaaucugcaucuacagcggcaagaaaaucagcaucgagcaccuaaaagacgagaaagcacuagaagucgaccacauauaccccuacucccguagcuucgaugacucguacaugaacaagguccuggucuucaccaaagaaaaccaagaaaaacugaacaaaacacccuuugaggcauucgguaaaaacauagaaaaauggaacaaaauacaaacccuagcacaaauccuuccauacaagaagaagaacaaaauccuagacgaaaauuucaaggacaaccaacaacaagacuucaucuccagaaaccuaaacgacacccgguacauagccacgcuaaucgcaaaauacacaaaagaauaccuaaacuuccuaccgcuaaacgaaaaugaaaacauaaaccuaaaaagcggugagaaaggcucaaaaauccacauccagacugugaacgguaugcugaccuccguccugcgccacacauggggguuugauaagaaagaccgaaacaaccaucugcaccacgcccucgacgccaucauagucgccuacagcaccaauucgcucauaaaagccuucagcgacuucaagaaaaaccaagagcuacucaaggcaaaacucuacgcaaaagagcucacgaacgacaacuacauccaccaagcaaaauucuucgagcccuucgaaggcuuccgcgaaaagauacucaauaaaauagacgaaauuuucgucuccaaaccaccacgaaagagagcccgcggagcccuccacaaggagacguucuacuccgaaaagaagaugauaaagaaauacaacagcaaagaaggacuaaacaucgcccuagacugcggcaaaauaaggaaaauuggcaccaaguacguggaaaacgacaccaugguacgugucgacaucuucaagaaacaaaacaaauucuacgcgaucccgaucuacacgauggacuucgcgcuaggaauccuccccaacaagaucguugugauuggcaaggacaagaacaacaacccaaaacaauggcaagaaaucgacgaaucauaugaguucugcuucucgcucuacaaaaacgaccuaauacugcuccagaaaaaggacaugcaagaagccgaguucgcauacuacaacggguucgacauagacuccucacgcauaaauauuaagaaacacgacaacaaauucgaaaaccucaccuccaaccaaaaacuccucuuuaccaacaaagagaaaaacagaacaggcauccaaaaccuuaaaauauucgaaaaguacaucgucaccccacuagggaacaaaauaaaagccgacuuccaaccccgucaaaacaucucccucaaauccagcaagaaaaauggacucuga

SEQ ID NO: 6058 - RNA, 2988 nt, Artificial Sequence
  Cas9 variant
augaaaauacugggauucgacauaggcauaaacagcaucggaugggcauucguagaaaacgacgagcuaaaagacugcggcguacggaucuucacaaaagcagaaaacccuaaaaacaaggaaucccuagcucuaccacgacggaacgcgcgaagcaaccgccgacgccucaaacgucgcaaaucacgacucaucgcgaucaaacacauucucgcgaaggagcucaacuugaacuacaaagacuacaucgccaaugauggagaacuacccaaagccuacgagggcaagcucacuaacguauacgaacuucgcuacaaagcgcuaaaccaaaaauuagaggcuaaagaccucgcgagaguaauucuccacauagccaagcaccgaggcuacaugaacaagaacgaaaagaaauccaacgacuccgagaaaggcaaaauccucucagcccucaaaaacaaugcucucaaauuagaaaaauaccagucggucggggaguacuucuacaaagaguucuuccagaaguacaaggaaaauaccaaaaacuucauaaaaauacgcaacacaaaggacaacuacaacaacugcguccuagccuccgaccucgaaaaagaacucaaacucauccuagaaaaacaaaaggaguucggcuacuccuacaacgacgacuucaucaaggaaaucaucaacaucgcguucuuccaacguccccuaaaggauuucagccaccucgucggcucgugcaccuucuucgaagaagaaaaacgcgccugcaagaacucguacuccgcaugggaguucgucgcccuauccaaaaucaucaacgaacuaaaacgccuggagaaaauaagcggcgaacuaaucagcgcccagaccauaaacgaaauacucaaccauauacucgacaaaggaaacauuacauacaagaaauuucgcuccugcaucaaccuccacgaaagcaucgaguucaaaucacucaacuacgacaaagacaacgccgaauccgccaaacuugucgacuuuaaaaagcuaaucgaguucaagaaggcgcuaggagaacauucguucaacagacaagagcucgacgaaaucgcuacacacaucacucuuaucaaagacaacgacaagcugaaaacagcgcuugaaaaauacaaccucaacaacgaacagaucaacgcccucuuggaaauagaguucaacgaccacaucaacuuaucauuuaaagcacucaaucuaauacucccacucaugcgagaaggaaaaagauacgacgaagccugcgagaucgugaaccucaaauccaaaaccuccaaucagaaacaggaccuacuacccgccuucugcgauuccaucuucucacaagagcugucaaaccccgugguaaaccgagccauaagcgaauaccgaaaaguccucaacgcgcuccucaagaaauacgggaaaguccauaaaauccaccuagaacucgcacgcgacguagggcucuccaagaaggcccgcgagaaaaucgaaaaggaacagaaagagaacaaggaaaucaacgauugggcacucgacgagugcgagaaauucggccuaaaggcgaacaacaagaauauccuaaaacuaaaacuguggaaagaacaaaaggaaaucugcgcauacagcggcaagaaaaucuccauagaacaccucaaagacgagaaagcucuggagguugaucacaucuaccccuacucccggagcuucgacgacaguuacaugaacaaaguacucguauucaccaaggagaaccaggaaaaacuuaacaaaacaccguucgaagccuucgggaaaaacaucgaacgcuggaacaaaauccaagcccuugcccaaaaucuucccuacaagaaaaagaacaaaauccuagacgaaaacuuuaaagacaaacagcaacaagauuucauaagccggaaccucaaugauacucgcuacaucgcaacccucaucgcgaaguacacaaaagaauacuuaaauuuccuaccccucaacgagaacgaaaacaccaaucucaagagcggcgaaaagggauccaagauucauguucagaccauaaacggaaugcugacaagcgugcuaagacacaccuggggauucgacaagaaagaccguaacaaccaccuucaccacgcauuggaugcaaucauagucgccuacuccacaaacagcaucaucaaagcguucucagauuucaagaaaaaccaagaacuacuaaaagcaaaacucuacgcaaaagaacucaccagugacaacuacaaacaccaagcuaaauucuucgaaccguucgaaggcuuccgagagaaaauccuaaacaaaauugacgagauauucguguccaagccaccacgaaaacgcgcgaggggcacguugcacaaggaaacuuucuauccagaagagacuaugaucaagaaauacaacuccaaagagggccucaacaucgcccugaacugcgguaagauucggaaaauaggaaccaaauacgucgagaacgacacgaugguccgacucgacaucuucaagaaacaaaacaaauucuacgccauccccauauacacuauggacuuugcgcucgguauccuacccaacaaaaucgucaucgcaggcaaagacaaaaauaacaacccaaaacaauggcaggagaucgaugaauccuacgaguucugcuucuccuuauacaaaaacgaucucauccugcuccaaaagaaagacaugcaggaagccgaauuugccuacuacaauagcuucgacaucgacuccucccgcaucaacaucaagaaacacgacaacaaauucgaaaaucuaaccgacaaccaaaaacucuuauucacaaaccaagagaaaaaccguaccgggauccagaaccucaaaaucuucgaaaaauacaucgucacgccccugggugacaaaaucaaagccgacuuccagccgagacagaauaucucccucaaaaccagcaagaaauacggccuauga

SEQ ID NO: 6059 - RNA, 2991 nt, Artificial Sequence
  Cas9 variant
augaugggcaacuucacccucggacucgaucucgguaccaauagcaucggcugggcgcuaauagacuucgaugacaaccaacaaccucaaaaccugaucgccugcggaucccgcauauuccaagaggcgguagaagcaaagacaggcacacccaaaaaccaugcacggcgcgccgcaagagcagcacgcaagcuagucgcgcggcggaaacagcgccgaaccaaacucuuaaaccuccuggugugccacgaccuccucccacaagacgaagccgagagaaacgcccuacuccuggacaaccaggcgaacaaccccuaucagcuaagaaagcgcggccuagacgagaaacuagaacccuucgcauuuggcagagcucuauaucaccuagcccaccgacgaggauuccaaagcaaccgaaaagcggcaagcgacgaagacggaaaaguaaaaaccgccauuucagcgcuccgagcagaaaugcaaggacacacccucggagccuuucuagcggaccaaccaacacagcgccgccgguacacagaccgagcaauguacgccgaagaguucgaacaacucuggagcaaacaaaccauauucgcuccagaacaacuaacgcaagcacucaaaguagaaauuaaaaacagcauauucuuccagagaccacuaaagucucaaaagcaccuagucggaaagugcaccuucgaacccacacgcaaacgagcagcaaaagcaauccucuuagcacaacacuuucgcauucuccaagacgucaaccaccucgccgucaaaaacccaaucacucgcgaguuccgaccacuaacccaggacgaacgaaauaaacuggccgaggcacucgacaaacaaaaaggcaugaacuggagcgcaguacgcaaggucauaggauggaauaagaaagacucccuccacgaaggagaaacauucaaccuugaagaggggaaaaaggacaaacugaucggcaauagaacagcaugcgaccuucgaggcgcccucggcgaccgaugggacgcauucaccgccccgcaacaagacgaccuggucacagaccuauugaccauagacaaucccgacggcuuccucaaacgaaugaaaacccacuggggauucgacgacgcaaccgccgaagcacuagcaacaacagagcucgagcccggcuacgcacgccuauccucaaaagccaugcgcgccauccucccucaccuagaacaaggcaugauuuauagcgacgcaugcaaagcagccggauacgaccacucaaaccccaaccagcgaacgaucaccgacaaacugggccuccccagcaacgucagaaaccccgucguacaaaaagcgcuauucgaaaccagaaaggucguaaacgcaaucguccgaaaauauggaaagcccgcaguaauacgagucgaaauggcacgagacaugaaacugagcaaacggcaaaaagaagaacuccaaaaggaacagaauaaacaaaagaaagcaaacgaacucgcggaaggaauccuccgcaaagaguucgggauacaacaacccgccagaaccgacauacaaaaguacaaccuaugguuggaaugcaaagaggucugccccuacaccggcaccgucaucucccgggagaugcuguauucuccagaaguagacguggaacacauccuacccuacucccgcucccuagaugacuccuacaugaacaaaacacucuguauggcaaccuacaaccgacaaacaaaacuaaacaacacacccuacgaaaucgggcaaggagacccaguggccuacgcagaaaucuuccagcgaaucaaaacccugccguucccaaaacgacgccgcuucgaacaaaaagaaaucgaaacagacaaauucauagaacggcagcuuaaugacacgcgcuacauaugcguagaaguccgugacuuccugcagcagcugggagccccaguggagguaucgaaaggagaggcgacggccaaauuaagaggccgguggaagcugaacacacuacucucccccggcggaggcaacgagaaaaaccgggcggaccaccgccaccacgcaauagacgcagucguaauagcauuaaccaacagauccuuguuccacaaacuaucccgacucucugcccaaagcaucucguucgauaaaagccguuuugacguaccacccccaugggacgacuucuacgacgacgucuacgagaaaauagacaagguuauagucucccacgcacccacucgaaagauauccggugcgcuccacgaagccaccgcauacggccacuucaaagaagaaauagcggacccgaaaacagguaaauucagcauagaagaccgcuucguauacagaaaaccccuaaccacacucacagcgaacgaaguagggaaaauucgcgaugccaaaguucgcgagcuaguagaagcaagacuggcccaguucggaaacaacucgaaagccgccuucggggaccccaacgaaccccuccuacacgccgacggcaaaaccccaaucaggaccauccgccuaaccaccaacuucaacaagacaacuacccacgccauccagaaaggacaagaccgcgacuacaaauucuucaaguacggaaacaaucaucacgucgaaaucaucgaacacgucgaaacgggcaaaagaaaagggaucuucgucaccgcgauggaagcagcacgacgcgcgcgcggcgucgcaaauaccgaaaagagcaauaucguccaaagaaaccacggagauggcuggaaauucguuaugucccucgcgguaaacgacaugguacgaaccgaagacacacaggccaucuacagaguucaaaaacucgacggaagcaacaaccgcuucacccugagaucgcacaacgcagcgacacucgacgacaagcaaacgggcgucgacaagacccccaaccucuucaaaggaacaaagaucaucguagacccacucgggaaccuaacacagugcaacgacuga

SEQ ID NO: 6060 - RNA, 2994 nt, Artificial Sequence
  Cas9 variant
augaaggugcucgucgacgcagggcuaaugccaucagacccggccgcagccaaggcacuagaaacgcuagacccauacgaacuacgagcgaccggacuagacgugaugcucccacuaacacaccuuggccgcgccguauuccaccucaaccaacgaagaggauucaaaucaaaccguaaaacagaccgcggagauaacgaauccgggaaaauaaaagacgccacgaagcgccucacgugggccaugcaagaagcgggagcaagaacauacggggaauuucuacacaugcgacgagcacgcgcguccgacccccgucaaguaccaucaguacgaaccaggcuuuccguugcaagccgggguggaccggacucaaaggaagaagcaggauacgacuucuaccccgaaagggcacaccuagaagacgaauuucacgcacucugguccgcccaagcugccuuccauccagaccuuaccugcgaacucagagacguagucuucgagaaaauauucuaccagcggccguuaaaagaaccaaaagucggacugugucucuucacagccgaggaaagauuaccaaaagcccacccacugacagggcgcagaguacuauacgagacagucaaccaacugagaguaacggcagacggccgcaccacucgcccucucacucuggaagaacgcgauaugauaguuuacgcacuagauaacaagaaacccgucaaaucauuaucaagcaugcaccucaaacucguagcccuaggcaaacucgugaaacucaaagacggcgagagauucacccucgagagcggaguccgagacgcaauagcuugcgauccaaucagagccacaaugggccaccccgacggauucggccccgcauggagcagacuagacuggcaggcgcaaugggcgcugauagaaaaacuacgacaaguccaaagcgacgacgacuucgccagucuagucgccuggcuaggggcaacucauaaccuauccgaagaccacgcaaaaagaguagcaaaccuacaucugccggaaggauacggacgccuaggccuaaccgcaacagaggcgauccucugcaaccucaaagcagaaguaugcaccuacucgcaggcagucgagcgguggggaaagcaccacagcaaccaaagaacaggagaaugucuagaggcacuucccuacuacggagaaguccuggaccgccacgucauacccggcaccuacaacgaagacgacgaugacguaaccagauacggcagaaucacuaaccccacagugcacauaggccuaaaccagcuccggcggcucguaaaucgcauaauagccacauacggcaagccggaucaaaucgucguagaacucgccagggaacuaaaacaauccgaggcacagaaaagugaagcacucaagaaaauucgagacacaacagccgacgcaauacgacgaggcagacaacuggaagaaauagggcagaaaaacaccggcgcaaacagacuacuccucagacucugggaggaucugggcccggccgucggcccacgaugcugccccuacacagggaagccgaucucagucacaaugcuauucgauggcgcaugcgacgucgaccacauacuaccguacucgcgcacccucgaugacuccuucgcaaacagaacuauaugccuacgcgaagccaaccggcaaaaaggcgaccgcaccccaugggaagcauggggcgguagcgaccaaugggaugcaauagaagccaaccuaaaagaccuucccgaaaauaagcggaaacgguucgcaccagacgcaauggagcgauucgaaggcgaacgcgacuuccucgauagggcacucgucgacacccaauaccucgcgcgcauaagcagggcauaucucgacaccuuauucacagaaggcggccacgucugggucgucccaggcagaaugaccgaaaugcuucgcagacauuggggacucaaugcgcuguuaagcgacaaggaccgaggcgcgggaaaagucaaaaaccgcacagaccacagacaucaugccauagaugcagccgucaucgccgcaaccgaccacucccucguuaacaggaucucaaaagccgcgggacaaggcgaauccgccggacaaagugccgaacuuaucgcaagagacacgcccgagccaugggaaggauucagaaacgacauaucagcucaaauagcccggauaguagucucccacagagccgaccacggccgcauagacgucgaaggccgcaaacacggcaaagacagcacugcaggacgccuccacaacgacacagccuacggaaucguagacgaccacacagugguguccagaacaccucuccuuagccucaaaccuggugacaucgaagucacaaccaaaggcaaaaauauaagagacacgcaacugcaaaaagcacucucggucgcaacaacaggaaaagacggcaaaggguucgaagaagcccuccgaaacuucgcggaaaaagaaggcccauaccaaggaauaagacgcguacgccucauagaaaccuuacaaucaagcgcacgagucgaaguaggcagcgacgaagacggacagccacuaaaagcauacaaaggcgacuccaaccacuguuacgaccucuggaaacucccagacggaaaaguagucccccacguagucagcacguacgaagcccacgcgggaaccgauaaacgcccccacccagcagccaaaagaauccuacgggucuucaagaaggacaugguugcgauagaacaagaugaccaaaccgccauauucuacguacaaaagcucgaccgcgccaacggacuauuccucgcaccucaccuagaagccaacgccgacgcgcgacaccgcaacccgaacgacgcauucaaauuccuacaaaugggagcgggcuccguaguccgaaacaaacuuagaagggucuacguagaugagaucggccgcauaaaagacccaggcccuccaaaacauuga

SEQ ID NO: 6061 - RNA, 2994 nt, Artificial Sequence
  Cas9 variant
augaagauccucggcuucgacauuggcaucaacagcauaggaugggccuucguugaaaacgacgaacucaaggacugcggaguacguaucuucacugaagcugaaaaccccuccaacaaggaaucccuagcccucccccgucgcaacgcccgauccucacgccgacggcuuaaacgacgaaaagccaggcucguagcaauuaaaagaauacuagccaaagaacucaagcucaacuucaaagacuacguugcagcagacggcgagcugccaaaagcauacgagggcaaacucaccucaaucuacgaacucagauacaaagcucucauacaacaauuggaaaccaaagaccuagcacgugucauccuccacaucgcaaagcaccggggguacaugaacaaaaacgaaaagaaaucaaacgacaccaagaaaggaaaaauucucucggccuugaaaaacaacgcccugaaacucgagaacuaccaaagcguuggcgaauacuucuacaaagaguucuuccagaaauacaaagaaaacaccaaaaacuucauaaaaaucagaaacacaaaggacaacuacaauaacugcguccuuucuagcgaccuugaaaaagaacuuaaacucauccucgaaaagcaaaaagaguucggcuacaacuacagugaagacuucauuaacgaaauacucaaaguagccuucuuccaaaggccccuuaaggacuucucgcaccucgucggagccugcaccuucuuugaggaggaaaaacgagcuugcaagaacucauacagcgccugggaguucgucgccuugacgaaaaucaucaacgaaaucaaauccuuagaaaagaucagcggagaaaucguccccacccaaacaaucaacgaaauacucaaccugauccucgacaaaggcagcauaacauacaagaaauuucgauccugcaucaacuuacacgaaagcaucagcuucaaaucgcuaaaguacgacaaagaaaacgccgagaacgccaaacucauagacuuccgaaaacucguagaguucaaaaaggcacucgguguccacucccugagccgucaagaacucgaccagaucucaacacauauuacccuaaucaaagacaacgugaaacucaaaaccguucucgagaaguacaaccuaagcaacgaacaaauaaacaaccuacucgaaaucgaguucaacgacuacauaaaccugagcuucaaggcccuaggaaugauucuaccccuaaugcgcgaaggaaagcgauacuacgaagccugcgaaaucaccaacuuaaaaccaaagacagucgacgaaaaagaagacuuccugcccgccuucugcgacuccaucuucgcucaugaacucucaaaccccgucgugaaccgagcaaucucagaauaucgcaaaguacucaacgcccuucucaagaaauacggcaaaguacacaaaauccaccuggagcuagcccgagacgucggacucucuaaaaaggcccgcgagaagauagaggaucaacagaaaaacaacaaagccaucaacgacugggcccucaaggaaugcgaaaauaucggcaucaaagcgucggccaaaaacauucugaagcucaaacuauggaaagagcaaaaggaaauaugcaucuacucagggaacaagaucuccauagaacaccucaaagacgagaaagcccucgaggucgaccacauauauccauauagccgcagcuuugacgauagcuucaucaacaaaguccuugucuucacaaaagaaaaccaagaaaagcuaaauaaaacaccauucgaagcauucggcaagaacauagagaaauggagcaagauccaaacccucgcccaaaaccucccauacaaaaagaagaacaaaauucuagacgaaaacuuuaaggacaaacaacaacaggacuucauuucccgcaaccucaacgauacgcgcuacauaaccacacucaucgcaaaauacacaaaagaguaccucaacuuccucccgcucuccgaaaacgaaaacaccaaccucaaguccggcgaaaaaggcuccaaaauccacauccaaaccauaucgggcaugcucaccucaguacuccgccacaccuggggauucgacaagaaagaccgaaacaaccaccuccaccacgcgcuagacgccaucauagucgccuacucgaccucuucuauaaucaaagccuucagcgacuuuaagaaaaaccaagagcuccugaaagccagauucuacgccaaagaacuaaccagcgacaacuacaaacaccaaguaaaguucuucgaaccauucaaaggguuccgagagaaaauccucuccaaaauagacgaaauauucgucaguaccccaccccgaaagagagcccgaggggcccuccacgaagaaacuuucuauuccgaagacaaaaugaucaagaaguacaacagcaaggaaggucuccaaaucgcacuguccugcgggcgaguccgcaagauaggaaccaaauacguugagaacgacacuauggugcgaguggacaucuucaagaaacaaaauaaguucuaugcgauccccaucuacgucauggacuucgcccuaggaauacuccccaacaagaucguaauaaccggcaaagacaagaacaacaauccaaaacaguggcaaaccaucgacgagagcuacgaguucugcuuuucacucuacaaaaaugaccucauccuccuccagaagaaaaacaugcaagaaccagaguuugcuuacuacaacagcuucgacaucgaccgcuccagaauaaaaauuaagaaacaugacaacaaauucgaaaaccuaaccuccaaccaaaaacuccuauucaccaacaaagacaaagggaaaaacagaaccggcauacagaaccucaagauauuugaaaaguacauagucacaccccucggcgacaagauaaaggcagacuuccagccgcgcgaaaacaucagccucaaaacaucgaagaagcauggacucuga

SEQ ID NO: 6062 - RNA, 2994 nt, Artificial Sequence
  Cas9 variant
augggcaacuacacacucggccuggacaucgggagcaacucuaucgggugggcccugguagaagacgccguagaagcgccaagaauaguagacaugggagugcgagucuucccagaggggguagacagagacacgaaaggacuggaaaagagcaaaaacgccacgcgccgcgaagcacggggagcacgacgaacccaucaacgcaggcgccagcguaagcagcgacugguacgagcacugagacagguaggccugcucccaugcgacaaggcggagguaagguccuuauuccaaaccgacccguacgaaauacgaaaaaggggucuagaccaccgacuagaacuauacgaaaucgggcgagcuuucuaucaccuaagccaaagaagaggauucaaaagcaacaggaaaucaggagcccuaaaagaagacgggacggugaagaaagaagcaggcgaacuacaacggaaaauagacgaagcaggaugccggaccauaggggaguacuucgccggacuggaccccgaacaacagagaauuagagggcgguacacauucaggagcauguaccagaaagaguucgaccuacuaugggcuaaacagguggaauuuuaccccaagguacuaaccgaggaccuacggucaaaaguccgcgacgagauaauauucuuccaacgaccccuaaagagcgcgaaagaccugauaggcgacugcgagcuagaaccgacggaaaagcggugcccaagagccgauugguacgcacggagauuccgacuacugcaggacauaaacaaccuaauaauacaaaacccagacggcacggaacagaaacucuccccagaccagagagcagcccuacuaggggagcuaggccaacgggagaaacucacauucgauaacauacgcgccaagcuaggacuacuggaaacacaaaaauucaacgcggaauaccgaaucggcagaaagggaaagaaaguagaagcaauaaaaggagacgucuucgucuggacgaugagaggcaaaaguguauucggacccaaagcaugggaugccauggcagacgagcgcaaaguaagccuaaacgaacuguucgucgaauuagaagacgacgaccucgcaagaaaacucgagacggaguacggacucacagauaaacaaguacaagcggcaaugaaagcaagccucccucaaggauacaugaguuuuaguagaaaagccguacuaaaacucuuacccuucauggaggcgggcgcacuaacgcaugaagcaaucgaccaagcaggcuacagaaaagaggagcccacgcagacagacgcgaucgcgagggucuccuucccaccagaccuaaggaacccaaucgugcaaaaagcacucuucgaagugcggaaggucguaaacgcgcuuguccgagaguacggaaaacccacacgaauuaagaucgaaauggcaagagacgugcagggauccaagagacaacgagaagaacuacauuggaggaacgaagacaauagaaagaaaaacgaggaagugcgcgacaggcuacgcacagacauacacaucgacgacccgucacgagacgauguaaucaaauacaagcuauggcaagagucaggaaaaaugugcccauacaccggacgccaaaucugccaggaagcucucuucggacccaacccagaguuccagguagaacacauccuaccauacgacaggagucuagacgacagcuauaugaaccuaacgcucugcgaaguccaugaaaacauacacggcaagcgaaaccaaacaccauucgaagccuacggcagcggagcagaaagauacgaacagauaaaacaaagaauaaaaguccuacccuggcccaaaagacaaaaauuccuacaacaagagauaaaccuagacagccacauaucuagagaauuaaacgacaccagguacauaugccgcgaaaccgucgcauaccucaaacagcuaggaguacacgugcgaggaacacgaggaaagauaaccgcagagcugagacaccaauggggccucgacgggauauucagcgaacucggaguccggagagacgacgaccacagacgacacgcuguagacgcccuaguuguggcaguaacggacaacgaacaccuacgacgacucgccguaaguaaguacguauuagccggaccgagguucgaaacgcccuggucagcguucagggacgaagccagggggaacgucaagagaaugaacgugagccacagggucugccgcaaggugagcggcgcacugcacgaagaaacgaacuacggccccacaggagugcgagaccaggcaggacaggacaucuacgcguauagaaagaaauuagaagacuuaaccacaccgaugguggagaaaaucguggaccccgucguacgggacauagucagacaaagguuguuaaugaagggaaucgacccggcggccgccgacagaaaaauaccaaaggacgucuggaaagaaccacucuauaugcggagaacaaagagcgacaaaaugauccaaauacgaaggguacgaauacacgacgucaagaacagcauaauaguacucaccgaugagagcggaagaccauaccgagcaguagaaccagggggcaaccaccaugucgaagucuuugaauacguccacggaacaaagacaggaaccagggaagcagaagucgucacgauguucgaggcagugaggaggucacgagcaagggcaccagucguuaggagggaccacgggccagggacacgcuucgucugcagccuugcaauaaacgacauggugaugaugcccgauaaaagcggcaaaauggaccuauucagaauccagaaaaugagcgcauccaagcaagucuacuucagacaccacacggcggcacgaauagacucagaaagaacacugauacggaaacaggcacaccuguucaacggguacaaggugagcguggaucccacaggagcaauaugucgggcaaacgauuga

SEQ ID NO: 6063 - RNA, 3000 nt, Artificial Sequence
  Cas9 variant
augaagauacucggauucgacauuggcauaaacagcauuggaugggccuucgucgaagacaaccaacuccaagacugcggaguccgccuauucacaaaggcggaagacccaaaaacuaaagagucccuugcacucccgcgacgcaacgcgagaucaaaccggcgacgacucggacgaaggcgaucgaggcucauagcccuuaaacauaucaucucuaaaggccuaaaacuaaacuaccaagacuacaucgccaaugacggggagcucccaaaggccuaugaaggcaggcucauaucacccuacgagcuccgauauaaggcccucaacgagaaaaucgaaccaaaggaccucgcccgaguaauccuacacaucgcaaaacaccgcggcuacaugaacaaaaacgaaaagaaaagcuccgacaacgaaaaaggaaagauccuguccgcacucaagaccaacgcauugaaacuugaaaaguaccagagcgucggggaguacuucuacaaagaguucuuccagaaauaccgcgaaaauaccaaagacuucauuaacauccgcaacaaagaaggcagcuaugaaaacugcguucuagcuucggaucucgaaaaggaacuaaaacugauccuagaaaagcaaaaggaauggggguacagcuacaacgacaacuucauaaaagagauccugaaagucgcauucuuccagcgaccacuuaaagacuucuccuaccucgucggggccugcacguucuucgaagacgaaaaacgcgccugcaaaaacuccuauagcgcgugggaguucguagcacuuacaaaaaucauaaaugaacucaagagccuggaaaaagaguccggugaacucgucuccagccaaauuaucaacgaaauacuaaaccacauucucgacaaaggcagcaucacauacaagaaguuccgagaguacaucaaacuccacgaauccaugaaguucaaaucccugaaguacgacaaagacaaugucgaaucaaccaagcucaucgaguuccgaaaacucgucgaguucaaaaaggcgcucggcgaacacucacucagccgcgaggaacucgaccagauagccaccuacauaacacuaaucaaagauaacgaaaagcucaagaucaccuuagaaaaauacagccucaacaacgaacaaaucaaaaacuuacucgagauagacuucaacgaccacaucaaccucuccuucaaagcccucaaucugauccucccccucaugaaggaaggaaagcgguacgacgaagcaugcaaacuccuaaaccucaaaaccaaguccaacaaucaaaaguucgacuuucuacccgccuucugcgacagcaucuucgcccaagaacucacuaaccccauaguaaacagagccauuucagaauaccggaaagugcucaacgcgcuacucaagaaauacggaaagaugcacaaaauccacauagaacucgcccgagacaucggacuguccaaaaagcuccgagccaagauugaaaaggaacaaaaagaaaacuaugaaaauaauaucugggcccugaacgaaugcgaaaaguucggccuaaaagcaaacgccaaaaacauacugaaguugaaacuguggaaagagcaaaaagaguucuguaucuacagcggcaagaaaauaagcauagaacaccuccgcgacgaaaaggcacuagaagucgaccauaucuacccauacucccgcagcuucgacgauucauuccucaauaaaguccucgucuucacaaaagaaaaucaggaaaagcucaacaagaccccauucgaggcauucggagcgaacgaagaaagguggagcaaaauccaggcucucgcccaaaaccuccccuacaagaagaaaaauaaaauacucgacgaggccuucaaaggcaagcagcagcaagauuucaucucacguaaucuaaacgacacacgcuacauaagcacacucaucgucaaauacacaaaagaguaccucgacuuccuaccccuggacgaaaaggaggacguuaaccucaaguccggcgaaaaaggcuccaaaauccacguccaaaccauuaacggcaugcuaaccuccgugcucaggcacacauggggcuucgcacaaaaggaccggaacaaucaccuccaccacgcacucgacgccaccaucguagcauacucaacgaacgcaauaaucaaagccuuuucggacuucaagaaagaacaagaacuacuaaaagccaaacucuacgcgaaagaacucaccuccgacagcuacaagcaccaagcgaaauucuuugaacccuucgaaggcuuccgcgaacagauacugaaccagaucaacaaacucuucguauccaaacccccgcgcaaaagggcccggggcgccuugcacaaggaaaccuucuacagcaaagaugagaugaucaagaaauacaacucacaagagggcguggaaaucgcgcucaauugcggaaaaauccgcaaaauugggaccaaguacguggagaacgacacaaugguaaggaucgauaucuucaagaaacagaacaaauuuuacgcgauaccaaucuacacaauggacuucgcgcucgguguacuccccaauaaaauaguuauaaucggcaaggacaagaaagggaaucccaaacaauggcaagagaucgacgaauccuacgaguucugcuuuucgcuacacaaagacgaccucguccucauccaaaagaaagacaugcaagaaccugaguucgcauacuacaacggguucgacaucuccaacucaagcaucugcguagaaaaacacgacaacaaguucgaaaaccugacagauaaccagcgccuccucuucaccaacgccgaaggcaacguaaaggcaaagaaaaucggaauccaaggccuaagaaucuucgaaaaauacauaauaacaccccuuggcgagaaaauaaaagcggacuuuaaaccacgggaagacaucgcacuaaaaaccagcaagaaacacggccuuuga

SEQ ID NO: 6064 - RNA, 3003 nt, Artificial Sequence
  Cas9 variant
augaagauccucggcuuugacauaggcaucaacuccaucggcugggcauuugucgagaacgacgagcucaaggacuguggaguacgaaucuucacaaaagcagagaacccgaaaaacaaagaaucgcucgcccucccgcggagaaaugccagaucgucgagacgccgguuaaaacgccgcaaagcgcggcuaaucgccauaaagcgcauucucgccaaagaacucaagcucaacuucaaggacuacgucgcugccgacggagagcugcccaaggcuuacgaaggcagccucgcaagcguauacgaacuacgauacaaagcacucacucagaaacuagagacgaaagaccucgcccgaguaauucuacauauagccaaacaccgaggcuacaugaacaagaacgagaaaaagucgaacgaugcgaagaaaggaaaaauccucucagcccucaaaaacaacgcguuaaaacucgaaaauuaccaguccguaggcgaauacuucuacaaagaauuuuuccagaaauacaaggaaaacaccaaaaacuucauaaaaauccguaacaccaaagacaacuacaacaacuguguauuaucuuccgaccuagaaaaagaacucaaauucauccuggaaaaacaaaaagaguucggguacaaauacagcgagggguucaucaacgaaauccuuaaggucgcauucuuccaacgcccccuaaaagacuucagccaccugguuggcgcauguaccuucuucgaagaagaaaaucgcgcgugcaagaacucauacuccgcaugggaguucgucgcccucaccaagauuauaaacgaaaucaagucccuagagaaaaucagcggggaaaucguaucgacccagacuaucaacgaaguccucaacuuaauccuagacaaaggcuccauaaccuacaagaaguuccggucgugcauaaaccuccacgaaagcauuagcuucaaaucacuaaaguacgacaaggaaaacgccgaaaaugcgaagcucauagacuucagaaagcucgucgaguucaaaaaggcccugggcguacacucccuaagcagacaagaacucgaccaaauaagcacccacguaacacucauuaaagauaacgucaaacugaagacgguacucgaaaaauacaaccucucaaaugaacaaaucaacaaccuacuagaaaucgaguucaacgacuacauaaaccugucguucaaagcgcuuggcaugauccuaccccuaaugcgggaagggaaacgauacgacgaagccugcgaaaucaccaaccucaaaccaaaaacggucgacgaaaagaaagacuuccuccccgccuucugcgacuccaucuucgcgcaugaacucuccaacccgguagucaacagagccaucucagaauaccggaaaguacugaacgcacuacucaagaaauacgacaaaguucacaaaauccaccucgaacucgccagagacgucgggcucuccaaaaaggcacgggagaaaaucgaaaaagagcaaaaagagaaccaggccgucaacgcaugggcccuuaaggagugcgaaaacaucgggcucaaggcaucugcuaagaacauccuuaagcucaaacuuuggaaagaacaaaaagaaauaugcauuuacaguggcaauaaaaucuccaucgagcaccuaaaggacgaaaaggcacucgaagucgaccacaucuaccccuacagccgguccuuugacgauucauucaugaacaaaguacuugucuucaccaaggaaaaccaagagaaacucaacaagacaccguucgaggcauucgguaaaaacauagagaaauggucuaaaauccaaacccucgcgcaaaaccucccguauaagaaaaagaauaagauacucgaugaaaacuucaaagacaaacaacaagaggacuucauaucucgcaacuuaaaugacacccgguacaucgcgacacucauaacaaaauacacgaaagaguaccucaacuuccugccccucaacgagaacgaaaacaccaaucugaagucaggagaaaaaggaagcaaaauccacguacaaacugucaacggcaugcuaacauccgugcuucggcacacauggggguuugacaaaaaggaccgcaacaaccaucuccaccacgcccucgacgccaucaucgucgccuacucuaccaacucuaucauaaaagccuucucggacuucaagaaaaaccaggaacuccuuaaagcgagauucuacgccaaagaacuaacaucagacaacuacaagcaccaagucaaguucuuugaacccuucaaaggcuuccgagaaaagauccuauccaagaucgacgaaauuuucguaagcaagccaccacggaaaagggcccgcggcgcauuacacaaagaaaccuucuacagcgaagacgagaugaucaaaaaguacaacuccaaagaaggccuucaaaucgcccucagcugcggacgcgugagaaaaauaggaacaaaauacguugaaaacgacacgaugguacggguggacauauucaagaaacagaacaaauucuacgcaauacccaucuacgcaauggacuuugcacucggcauccuccccaacaagaucgucguagucggcaaggacaagaauaauaacccgaagcaguggcaaaccauagacgaaagcuacgaguucugcuucucccuauacaagaacgaccuaaucaugcuccagaagaaagacaugcaggaagcggaguucgcuuauuacaacggcuucgauauauccacaucgagcaucugcguugaaaaacacgacucgaaauucgaaaaccuaaccucaaaccaaaagcuccucuucuccaacgcaaaagagggguccgucaaagucgagaaccuggggauacaaaaccuaaaaaucuucgaaaaauacaucaucaccccacuuggagauaaaauuaaagccgacuuccaaccaagagaaaacauaucccugaaaaccucaaagaaaaacggacuguga

SEQ ID NO: 6065 - RNA, 3003 nt, Artificial Sequence
  Cas9 variant
auggcaagagcccaacgacgccucaucuccagacgagccaaccgcaugaacaaacuacgucgccugcucaaacaggaaaacguccuacaagccaacgacuacgacgaaaaaggccuaaucaucgggcucccaaaccaggcaugggaacuaagggcccaagggcuagaucgaaaacuagagcccaaagagugggcagccguccucaucaaccucgucaagcaucgaggauauuuaucccagcgcaaaaacgaaagccaaaccgcagacaaagaacuaggcgcacuacuaucagggaugaaccacaaccaccaacuccuccagucacaaagcaaccaauacagaaccccagcagaacuagcaaucaaacaauuugccacccaggacgggcauauacgaaaccagagaggagccuacacacacacauucaacaggcuagaccuacaaaaugaacucaaccaacuauucgaugcccaaacccgccucgguaacccacacguguccgggagccuaaagaccgccaucaacgaccuacucaugaaccagaaagcggcgcuaucaggagacgccauccucgaaaugcucggccgcugcacuuucgagcccagcgaauacaaagcagccaaaaauaccuacuccgccgagcgcuucgucuggcucggaaaacucacaaaccuacgaauacaggacaacggccuagaaagcgcacucucucgcgaacaacgcgaauuacuccuaaacgaacccuacaacaagaccaagcucacauaccaacaaguccgcaagcuccuccgccuacccgaaacagccuuuuucaaaggccucagauacggcaaagacaaugccgaaucggcaacauucauggaaaugaaaagcuaccacgcaauccgaaagucacucgaaaacaaaagccucaaaagcgaaugggaaaaacucaaaacccaaccgaagcuccucgaccucaucggcacagcauucucaaucuacaaaacagaugaugagaucgcaggaugccucaaaaaccaacuaccagaaaacgucauaaucgccuuacaagagcaacucaacuuuagcaacuuuauggaacuaucccucaaagcccuagagaagcuccucccacucauggaacaaggacuacgcuacgacgaagccugcacgcagaucuacggaaaccgacaugagaaaaucgccgacaaaaccgaaaaauuccuaccuaacauccccgccgacaaacuacgcaauccagucguccucagaacccucacacaggcgcgcaaggugaucaacgccaucauucgacgcuauggcagcccagcgcgcguacacauagagacaggccgagagguagggaaaucauucucagaucgcgacaaacugaagaaacagcaagaggaaaaccaagaacaacgcagacgagcgauagacgaauggaaacaauucuuuccuaacgcggcucacgaacccaaggcaguugacauccucaaacuccgccuauaccagcuccaacagggcaaaugccucuacagugggcugcccauagacgugcgccgccucccagaaaaaggguacguagaaaucgaccacgcgcuaccauucagcagaacaugggacgacucguucaauaauaaaauccugguacuagcuucggaaaaccaaaacaagggcaaccaaacgccauaugaauaccuacguggagcagacaacagcgaaucuuggcgacuauucgucgagaacgugcaaaacugccaauucucacccaauaagaagcagaaaaucauggcuaaacaacuagaugaaaaaggcuuccucgagaggaaccucaacgacacccgguacguuucaagauuccuaugccaauucaucucagagcaccuacaccuaacgggcaaaggaaagaagcgcgucuucgcguccaauggccaaaucacugcccuucuacguggcagauggggacuaagcaaaaaccgagaggaaaaugacagacaccacgccguggacgccgucgucguagcgugcucgacagucgcaaugcaacagaaaaucacccaauucguccgguaucaaaaaggaaaugucuucacgggcgaacgcaucgacaaagagaccggagaagucaucucaauccacuuucccacgccuugggagcacuuccgcgaagaaguaaugauccgaguauucgaugacaacccccucaggacccuacccgaaaaacuacccaaccgcccagaagcacuccacgaauacgucaugccgcuauucguaucccgcaugccgacucgaaagaugacaggccaaggccacaaggaaacaaucaagagcgccaagagacuagacgagaaaaucucuguccuacgagugccccucacacaacucaaacuuaacgaccucgaaaacaugguaaaccgcgaacgcgaacccgcauuauaugaagcgcuaaaagcccgccuggaacaauuuaaaaacgaccccgccaaagcguucgcggaacccuuuuucaaacaaggaggccaacaaguuaaagcaguccgcgucgaaauuguucaaaaaucaggcaugcuucuaagaaaaauaaacggagucgccgacaacggaagcaugguccgaguagacgucuucgaaaaaucagguaaauucuaccuagucccgaucuacgcauggcaagucgccgaaggcauucucccaaauuacgccguggucgcucauaaagacgagucagacuggaucuuaauggacgaauccuaccacuucaaguucgcacucuacaaaaacgaccuauuagaggugcaaaccaagaaaggaggcauaaugggcuacuucgcaagccuagauagagccacgggcgccaucacaauacgagaacacgaccgcgacaaaaagaaaugcaaagauggggaacaucgcagcauuggcgugaaaauggccucgucauucaagaaacugcaggucgacgaacucgguaaaaacauacaugaaacgcgaucgcgcaaaaggcccaacaucggauga

SEQ ID NO: 6066 - RNA, 3012 nt, Artificial Sequence
  Cas9 variant
augcgcauucuuggcuucgacaucggcaucaacucaauaggaugggcguucgucgagaacgacgagcugaaagacugugggguccgaauuuucacgaaggccgaaaaccccaagaacaaggaaucccuagcccucccaagacgaaacgcgcgcucaaguaggcgccgacuuaagcgccggaaagcgcgccugaucgcgauuaaacgcauccucgccaaagagcuaaaacucaacuacaaggacuacgucgccgcagauggcgaacuuccgaaggcauacgaaggcucacuugccucagucuacgagcuacguuacaaggcccucacccaaaaccuagagacgaaagaccucgcgcgcgugauccugcacaucgccaaacaccgaggauacaugaacaagaacgaaaagaagucgaacgacgcaaagaaaggaaaaauccucuccgcccucaaaaacaacgcgcuaaaacuagagaacuaucagucggugggugaauacuucuacaaagaguucuuccaaaaauacaagaaaaacaccaagaacuucaucaaaaucagaaacacaaaagacaacuacaacaacugcguacuaagcuccgaccucgaaaaagaacugaaacuaauccucgaaaaacaaaaagaguucggcuacaacuauagcgaagacuucaucaacgaaauccuaaaagucgccuucuuccaaaggccacugaaggacuucucacaccuugucggcgcaugcaccuucuuugaagaagaaaagagggccugcaaaaacucauacagcgcaugggaauuuguagcccuaacaaaaaucaucaacgaaauuaaaagccucgagaaaauaagcggagaaauagucccaacgcaaaccaucaacgagguccuaaaccuaauccucgacaagggcagcaucaccuacaagaaguuccggagcugcauuaaccugcaugagucuaucagcuucaaaucucuuaaguacgacaaagaaaaugcugaaaacgccaaacucaucgacuuccgcaaacucguagaauuuaagaaagcccuaggcguacacucacucucccgccaggaacuagaucaaauaucaacgcacaucacgcuaaucaaagacaacgucaagcucaaaaccguucuagaaaaauacaaucucucaaacgaacaaaucaacaaccuacucgaaauagaguucaaugauuacaucaaccucagcuucaaggcccucggaaugauccuuccccucaugcgagagggcaagcgcuaugacgaggcuugcgaaauugcgaaccucaagcccaaaacaguugacgagaagaaagacuuccugccggcguucugcgacucaauauucgcccaugaauuaucaaacccagucgucaaccgggccaucagcgaauacagaaaaguacuuaacgcucuccucaagaaauacggaaaaguccacaaaauacaccucgaacucgcccgcgacgucggccucucuaagaaagcgcgugagaaaaucgaaaaggaacaaaaggaaaaccaggcuguaaacgcgugggcccucaaagaaugcgaaaacauuggacuuaaagccucagccaaaaauauucuaaaacucaagcuguggaaagaacagaaagaaaucugcaucuacucuggcaacaaaaucuccaucgaacaccuaaaagacgaaaaagcacuugaagucgaccacauauaccccuacagccgcagcuucgaugacucauucauuaacaaaguccuaguauucaccaaggaaaaccaagagaaacuaaacaaaaccccuuucgaggcguucgggaagaacaucgaaaagugguccaaaauucagacccuagcccaaaaccuccccuacaagaagaaaaacaaaauacucgacgaaaacuucaaagacaaacaacaagaggacuucauaucacgaaaccucaacgacacccgcuauauagcgacccuuauagcgaaguacacuaaagaauaccuuaauuucuuacuccucucagaaaacgagaacgccaaccuaaagagcggggaaaaggguuccaagauccauguccagacaauuucgggcaugcucacaucagucuuaagacauaccuggggcuucgacaagaaagaccguaacaaccaucugcaccacgcacucgacgcgaucaucguugcguacuccacaaacucgauaauaaaagccuuuucggacuuccggaaaaaccaggaauugcucaaagcacgauucuacgcaaaagaacucaccagcgacaacuauaaacaccaggugaaauucuuugaacccuucaaaucauucagagagaagauccuauccaaaaucgacgaaaucuucgucucuaaacccccgcgcaaacgagcgcgccgagcccuccacaaagacacauuccacagcgaaaauaaaaucaucgacaaaugcuccuacaacucgaaagaaggccuacaaaucgcccugaguugcggccgaguacggaaaaucggcaccaaauacgucgagaacgacaccauuguccgagucgacauauucaagaaacaaaacaaauucuacgcaaucccaauuuacgcuauggacuucgcccuaggcauccuaccgaacaaaaucgucaucaccggaaaagacaaaaacaacaacccaaaacaguggcaaaccauagacgaaucauacgaauuuugcuuuucacucuauaagaacgaccucauccuacuccaaaagaagaacaugcaagagcccgaguucgccuacuacaacgacuucuccaucucgaccuccucuaucugcguagaaaaacacgauaacaaauuugaaaaccuaacguccaaucaaaaacuccuguucucaaacgcuaaagagggcagcgucaaaguagagucccugggcauccagaaucugaaaguauucgaaaaauacaucauaaccccucucggcgacaagauaaaagcggacuuccaaccgcgcgagaacauuucccuaaagaccuccaagaaguacggccugcgguga

SEQ ID NO: 6067 - RNA, 3012 nt, Artificial Sequence
  Cas9 variant
augauagacgagagccucacauucggaaucgaccucggcaucggauccugcgggugggccgugcucaggagacccagcgcguucggaagaaaaggaguaaucgagggcaugggcagcuggugcuucgacgucccagaaaccucgaaggaacguacacccacgaaccaaauaaggcgaagcaaccgacuacuacgacgagucauacggcgaagacgaaacagaauggcugcgauccgacggcuauuacaugcagccgggcuucugccauccacagacucagacgcacucaaacgcccaggccacgacccaugggaacuccgcgcgagaggacuggacaagccucuuaaaccaguagaguucgcagucguccucggccacauagcgaaacgacgagguuucaagagcgccgcgaaacgaaaagcaaccaauauaaguagcgacgacaagaagaugcuuacagcccuggaagcgacgcgggaaagacuaggcagauaccgcaccgucggagaaauguucgcgcgagaccccgacuucgccagucgaagacgcaacagagaagggaaauacgaccgaaccacagccagagacgaccucgaacacgaaguccacgcacuauucgcagcccagcgccgccucggccagggguucgcaucaccagaacuagaagaggccuucaccgccagcgcauuucaccaacgucccaugcaggacagcgaaagacucguaggauucugccccuucgaacgcacggaaaaacgagcggccaaacuaaccccaucguucgagagauuccgacugcuggcccggcugcucaaccuccguauaaccacaccagacggagaacgaccccucacagucgacgaaauagcccuaguuacacgugaccucggaaaaacagcgaaacuaagcauaaaacguguaagaacacucauagggcuugaagacaaccaaagauucaccacaauaagaccagaagacgaggacagagacaucguagcacguaccggcggagcaaugacgggcaccgcaacacuacgcaaggcacuaggcgaagcacuauggacagacaugcaagaaaggcccgaacaacucgacgcaauaguccaaguacugagcuucuucgaagccaacgaaacaaucaccgaaaaacuccgagaaaucggccucacacuugcaguacuggacguccuacuaaccgcacuggaugcaggcguauuugcaaaauucaaaggagcagcgcacauauccaccaaagcggcacgaaaccuacucccacaccucgagcagggacgcagauaugacgaagccugcaccauggccggauacgaucaugcggccucacggcugucgcaccacggccaaauagucgcuaaaacgcaguucaacgcccuaguaacagaaaucggagaauccauagccaaccccauugcaagaaaagcccucaucgaaggacuaaaacaaauaugggcaaugcggaaccauugggggcuccccggaucaauacacguggagcuagcccgagacguuggcaacuccauagaaaagcgacgcgaaauagaaaaacacauagagaaaaacaccgcccucagagcccgcgaacgcagagaaguccaugaccuccuggaccucgaagacguaaacggcgacacccuccuucgguacagacuguggaaagaacaagggggcaaaugccuguauacaggaaaagccauacauauacggcagaucgcggccacggacaacagugugcaaguggaucacauacuacccuggagcagauuuggggacgacucuuucaacaacaaaacacuaugcuuagccagugcgaaccaacaaaagaaacgcuccacgccauacgaauggcucagcggacaaacaggggacgcauggaacgcguucguccaaagaauagaaacaaacaaagaacuacgcggguuuaagaagagaaacuaccuccuaaagaacgcaaaagaagccgaggaaaaauucagaucccgaaaccuaaacgacacacgcuaugcggcacgacucuucgcugaagcugucaaacuucucuacgcauucggcgaaagacaagaaaaaggagggaacaggagagucuucacaagaccaggcgcgcuaacagcagcccuccgccaagccuggggaguagaaucacucaagaaacaagaugggaaaagaauaaaugacgaccgccaccacgcgcuagacgcacucacaguagccgccguggacgaagccgagauccagcggcuuacuaaaucauuccacgaaugggaacaacagggccucgggagaccccuccggagagucgaaccacccugggagagcuucagagcagacguggaagcgacauacccagaaguauucgucgcacggcccgaaagaagacgagcccgcggcgagggccacgcagcgacaaucaggcaaguaaaagagcgcgaaugcaccccaauaguguucgagcgaaaggccguaucaagccuaaaagaggccgaccuggaacgcaucaaagacggagagcgaaaugaagcaauaguagaggcaauuagaaguuggaucgcgaccggacggcccgccgacgcacccccgagaagcccgagaggggauaucauuaccaaaauccgacuagccacgacgauaaaagccgcggucccggugagaggcggaacagcaggccgcggagaaaugguccgcgcagacgucuucagcaaaccaaacagacguggaaaggacgaaugguaucucguaccaguguauccgcaccaaaucaugaaccgaaaagcauggccaaaaccaccaaugcgaagcaucguggccaacaaagaugaagacgaauggacagaaguaggcccagaacaccaauuucgauucagccucuaccccaggagcaacauagaaaucauccgcccgagcggagaaguaauagaaggauacuuugugggucuucauagaaacacaggagcccucauaccaacacccgucggcccagacucauacgugauagcguga

SEQ ID NO: 6068 - RNA, 3024 nt, Artificial Sequence
  Cas9 variant
augaaaguacucggauucgacaucggaaucaacagcauuggcugggccuucguagaaaacaacgaacucaaagacugcggcgucagacuuuucacaaaagcagagaacccaaaaaccaaagagucgcuugcccucccccgccgcaacgcgagguccucccggguccgccucagacgacgccggagcaggcuacugucccucaagcacauaaucagcaaagaguucggccugcauuacgaagacuacauagcacucgacggcaacuuacccaaagccuacacaggcaaaaucgaaagcaucuacaaacuccgcuacgaggcccuuucacaagcgaucucgaaggaggaucuggcgcgcguaauacuacacauagcaaagcaucgaggauacaugaauaagaaccagaaaacaagccaagacagcgagaaaggggccauccucagcgcgaucaaggaaaacucgaacaaaauaaagcacuaccaaaccgcaggcgaauacuucuauaaggagcuauucgagaacuugcgagacggcacaaaggaguuuaaaaacauccgcaauaaagcaaugaaaaacgaaaagaccggaaacauggaaagcacauacuacaacacuauccuggcguccgaccuggaaaaggagcuaaaacugauacuggaaaagcaacaagccuaccacaacuacuccgacacguucaucaaagagguacuagaaauagcguucuaccagcgcccgcucaaagacuuuagccaccuuguaggcuccugcaccuucuacgaaaacgagaaacgugccugcaagaauagcuacagcgcuugggaguucaucgcccucggcaaaaucaucaacacacucgagucgauuaagaaagacacaggcgagauauucagcaaugagaucaucacccagauacuaaaagagguuuuggacaaaggcagccucagcuauaccaaacuccgcaaaaugaucaaccucgacgaaaaaguaaaguucaaagggcucaaauaugacaaagaaggcguagagaaaacaaaccuaaucgaauuuaagaaacucaaagaguucaagaaagccuugggagaacacaaccuagaacgcaaaacacuugacgaaaucgccacgcacaucacucucacaaaggacgaaaaucaacugaaaaagcaacuagaacaauacgcccugagccaaaaucaaauagacgcacuagcagaacucgacuucaacgaccacauaaaccugagcuucaaagcgcuuuacgaaauccucccccuaauggaaaaaggcaagcgauacgacgaagccugcaacgaacucgggcugaaggccaaaaccagcaaccaaaaaucagaguuccuacccgccuucugugacuccaucuucgcucaagagcugacaaaccccaucgugaacagggcuauauccgaguacaggaaaguccugaaucggcuuuuaaagaaauacggaaaaaugcacaaaauccacaucgagcucgcucgagacgccggccugagcaaagaagcgcgaaacaagaucgaaaaagagcaaaaggagaacaaagacauuaaugacaaagcagaaaagacaugcaaggaguucggccucaaaccgaacgccaaaaacauacuaaaaaucaaacuauggagggaacaaggagaaaucugcgcuuacuccggcaagaaaauaaccaucgacgaccucaaggaagacaaagcacucgaagucgaccacauauaccccuacucccgaucauacgacgacuccuacaacaacaagguacugguuuucauaaaagagaaucagcucaaacuuaaucaaaccccauacgaagcauucggcagcaaccaagagaaauggucaaaaauccagguccucgcacagaaacuacccuacaaaaagaaaaacagaauacuggacgaaaacuucaaaaacaaagaccaaaucgaguucauaagccgaaaccuaaaugacacacgcuacgccaccagccuaauagccaaauacacgaaagaauaccuagaguuccucccgcuaagugacgacgaagacauaucccugaaaagcggugaaaaagggucaaaaacacacgugcaaaccaugaacggaauguugacgucgguacuacgacacgccuggggcuucucccagaaagaucgcaacaaccaccuccaccacgcccucgacgccauaauaaucgcguacuccaccaacagcauaaucaaagccuucagcgacuucaagaaaaaccaagagauccucaaagccaaacucuacgccaagaaauuaaccucagaggaauacaaaaaccaaagcaaauucacaggcuucgagaaauacaggagcaaaauccucgaaaagcucgacucgauauucguuagcaaaccacccaacaaaaacaccaaaggggcccuccacgaacaaacauucuacucauaccaggacaucuuggaggaauauaagacucaagaaggccucaaacgagcccucgaaugcggcaaaguccgcaagaucggcaccaaauacguagucaacgaccgcauggugagacuggacaucuucaagaaagacaauaaauucuacggcauucccaucuacaccauggacuucgcacuugggguucugccaaacaaagucguuaccaucggcacagacaaggacaaaauuaaaaaggaauggaagaccaucgaugaaaccuacgaguucugcuucucacuguacaaaggcgacuuaguccucauacaaaagaaggaaaugcaagaaagugaguucgccuacuacaacggguucgacaucucgucagccuccaucucccuagagaaacacgacaacaaauucgagaaucucacggaaaaccaaaaacuacucuucccuaaggccaaagagggcgauguugaaguccgaggaaucgguauccaaggacugaaagucuucaagaaauacaugguaaccccgcuaggcgaaauacaagagaccaggaccgaggccagacaaaacauccaaccucgaaagaaacacgggcuacgauga

SEQ ID NO: 6069 - RNA, 3033 nt, Artificial Sequence
  Cas9 variant
augucagacucauccuacgugcuaggccuagauuuaggcacuaauucgauaggcugggccugcguccgacuaaacaaaggaaaacccgacggccuccucgcgcaaggggucaggauauucgaagcaggacuggaaauugacgccuacggcagagggacaccccuaaauaccgaaaggcgcaacgcaagacaacgacgacgccuacacgaccgaagaaaaagaaggauccuaaagguacgacgcauacuacaagaggcaggaaugcuacccgccaacaaaccagaucacaaggacgccgaauggaagaugcuccucgccagaaaccccuaccgacuaagagcaaaagcgcuugaugaacaaauagaccuaaaagagauaggccucugcaucuaccaauucgcccaucggcgcggcuuccucagcaacuccaaaauacucaaaaaggacgacgaccguggcaaacucaaggacgcaaccaaggcuuucgccgaagacauggagcaaaaaggcgcccgcaccuggggagaauaccucagccaccuagacccccacgagcaaagaauccggaccaauuacaccuuaagagaaugguacacuuccgaauuugaccucauaugggaaaagcaacaauccuucuacccacacguucucaccgacgaucuuuacaaacgcguuaaagaagcccuguucuaucaaagaccccucaaaagccaagcacaccuccuaggccaaugcgaacuugaaccgggacgcaaacgagccccauucgcccugcugauggcccaagaguuccgacuacuccaaucacucaaccaccucagaguugucagcucaacaggcgacgagcgucuucucacagacgaagaaagaaaacaagcccucgcccuccuacgcucccggggaaaccaaaaguucacaaccuuaagaaaaguacucaaccuccgaggcacaaaauucaaucucgaacgcggcggagagaaaaccauccaaggcaauaacaccgcggcagcgcuaggaaaccucuuuggcgaagccugggaccacuucagcagcgaacagaaaaaccaaauagucgaagaccgccuaacuaucggggacaccgacgcacuaauacgaaggaugaagaaaacgugggggcucgacucagucacggccgaaauguucuccgaaacugagcuagaggacggauacugcggauuuagucgcaaagcccuagaaaaacuguuacccuugcucgaaagggggcaugcacuaauggaagcaguacaagccgccuaccccgacuaccagaaaaaccuuccacgcacagacacacuaccuccccucgaaaaccucaggaacccuaucguccaaagaacacuauccgaacuccgccggguaguaaacgcaaucauaaaagaauacggcaaauccgacaaaauccgcauagaacucgcacgagacaugaaacaaacagccaaaaacagagaaaagagcugggacagaaugcgcguaagagagagacaacgaaaagaagcagccaaaaagauccucgaagaaaccggaaaccccgcaccccgccgccaugaaaucgaaaaagugcuacuggcagaagagugcaauugggaaugcccguacaccggcaaaagaaucugcaugaacacacuccucggagacgcaccacaguuugacauagagcauaucauccccuucagcagauccuucgacaacucuuucuccaacaaaacacucugcgacguaaacuacaacagaaacguaaaggguaacaaaacccccuacgaaucagcaagugaaacagaacacgaagaaauggucugccgcguaaaaagauucacgggagacuacaaagaaauaaaacucgacagauucaacacacgagagacagacagccgcgccgacuucaucgaagaguucagcacaucccaacugaacgacacacgauacgcuagccgucucgccggugaauacuuaggaaagcuguacggaucagaauggcgcaaacacauacaaauagcaaaaggaggcaccaccaaauaccuacgcgaugcaugggaccugaaccgcauacuaagcgacggcggaaccaagagccgcgacgaccaccggcaccacgcagucgacgcaguuguuguugcacucacaacaccacaaacggucaaggccuuaucagacgccaaccaacgcgcgcccgagcaucgccgauacgccuucucggacaugccacuaccgugggagaccuucagacaagacguagagcaagccauaaauucaauaacagucucccacaaagugugccgaaaggccaacggucagcuccacaaagaaacguuuuacggccucaucaaagaccgaaaaaccggcgacacgcgaacaguccuacggaaaccgcuccacgagcucaccgacaaagagauuaaaagagcagaaaucgucgacagcuccauaagaaaacucauagaacagaaacuaaaagaccuggaccaaccaccaaagaccgcauucaaagaccgcaacaaccacccguucaucauugauaaaaacggaaacaaacgcuucauccacaaaguacggguauaccaagacgcaaaaccaguaaaaaucgcagaaaaccgacacgucaaacuuggcggaaaccaucaccucgaaauauucgaaguuauagacaagaagggaaaccccacauggaaaugcgaagucaucuccuuauucgacacacgccaaagaguuaaggagaaaagaccagucaucgugagacaagaucaaaacgguaacccccuuaaauucagccucuccaucggggaagccguccaacucgacuggaauggaggacgagaaaccgcagucgugcagaaaaugagcaagacacccaacaccguugaauacgucuuccgaaaacacaacgacgcccguaaggccgcagacaucccauacaaggaaacaauuaccguaaaauccgacucagcccuuuucgcguccaaccuacagaaaauagucaucacaccgacaggccuaauaaggcgggcaaacgauuga

SEQ ID NO: 6070 - RNA, 3033 nt, Artificial Sequence
  Cas9 variant
augaagaaccgaaacgugauaggcaucgacgucggcacuaauucgaucggcugggcgcugguggaagaaaacgaaaacggacucccacaaucgcuaaaggcagcaggcgugcgcaucuuccaggaagcggucgaagcaaagaccaggacccccaaaaaccacaagcgacgacaggcccgccuggcacgaagaguacuagcucgcagagccaggagaaaacaaagacuccaaaaccuacuccucaaacauggccuacucccaggagggguaacagaccccguacagagagaggccgcauucaccacccugggagacccauaccaacuacgagcaaagggguuaaaucuuccacuaggacuccacgaguucgguagagucuuguuucaacuaggcgcccgacguggcuuccugaguaaccgcaaaacgagauacggacaccuaaacaagcuggacgagcuagccgaucuaaucgaagcggaagacgcggccccgaagacaggggacgcagaagaaggcaucauacgaaaggaaauaggggaacuccgccaggccaugagugccgccggcagccgaacguuaggcgaauaucuggccggccucgccaaagaagaacgaaaacggugcagacacacagaaagggcaaugcuagaggaagaauuugaaagacucuggaugguccaagccagguuucauccggagcuaucggacgagcucaaaguacagguacacaccguaauauucuuccaacgcccgcucaaaagcaaccgagcaagccugggaaaguguagccuagaaccgucacgcagaaaagcagcaagagcauggcccgaagcccagagauucagacuacuccaagaccucaacaaccuagaaauacuagacccgcgaaccggagagcuacggcgacuccgagacacagaaagagcaauucuacuaaacgcccucgaacaacaaaagucaaugaccuggaacgccguacggaagaaacuaggacuccaccagggagaaaaauucaaccuagaaaccggagccaaagccgaaacaggacucaaaggucuccaaacacuagccagccuccacgccauauugcaaggcugguucgacgagcucggggacaaacgcgaccuacuaaucgaagaccuaaucacaauagaggacagcgcaggucuguacagaagacucagggagcacuggggguucgacagagaaacugcauuccgccuggccacccuagaacucgagccuggcuaugcaucgcuaucccuaaaagcgauacggaaacuacucccccacaugggagccggccacagauacuccgaagcgcgacaacaagugggcuacggcuacgaaacaggccaacgcgaccuacaagaaaggcuaggggaaccaccggacccccggaacccuguaguagacaaggcccuacacgaacuacgacgcguaaucaaugcacuaauacaccgcuucggcaggcccgacgucguaagagucgagcuagcgcgcgauuuaaaguuagccaaacgcgacaaagaaagacuagaaaagcaaaacagagagaaccagcgacugaaccggaaagcagaagcagcgcuugcagaacucgggcuaggacaaccaagcagagacgaccuaauaaaguaucguuugugggaagaaucaaaaggacucugcccauacacuggcagagagauaggucucagcacccucuuuagcccggaaguagacguagagcacaucauaccguacucacgcuguuuggacgacaguuacaugaacaaaacacugugcaugacagaggaaaaccgaaugcaaaagggaaaccgcaccccaugggaagccuacggaggcgaccccgcgcgauacgagcaaauacugcaaugcgcacgguacuuuccaauggcgaaacgcaaacgcuuccuagaacagggcucugauuucguagaccaguucauccagagacaacuaaacgacacgagguacauagcaaagcucgcuaaagaauaccucgccgcagucugcacgaauguucaagucaccaaaggcgggacaacagcaaugcuacgccaccacuggggacuaaaccgccuccucggagaagacgacggucaaaaagaaagaggagaccaccggcaccaugcacucgaugcagccguaauagccgucacaucaagaucauuauaccaaagacucgcacggaucgcccaccaaagaggccacgcuccaagccagcgaggcuucuacauagacccaccauggcaaggauaccaagcagaccucgcacaaacccuugcagggauaguagucagccacgcgaccaaccgaaagcuaacaggcgcacuccaugaagagacagccuacggacacauaccccacgucggguucguguaccgcaaaacacuaaacaaagacuucaaacucggcgacaucgaagcaauauacgaccccagccugcaagaauuaguaaaagcacaccuugaacaccacgggaacgacccgaaacgcgcguucgcggaaggaauacagugcuaccacaaagacggccacacgccaauuaaacgcguuaggauacgggcgaaacagguaucagagaagggaaccuucagcauaagcgaccgagcaggucgcgccuacaaacaccacaaaacagggucaaaccaccacguagagauccugcgccaccgagcaaccggaaaaauagaaccgguguaccuaaccaccaaggaagccacagaacgcgcgcgaagaggaggagaaccggucauacaacgagaccacggacccgaaugggaguucauuauaagccuaugcauaaacgauaugguccgccuaggagaagggggccaaguggcauauuuccgaguacagaaaauagaagcaaccaacaacaggguuacacugagaagccaccucgcugcaacccuagacgacgaagacaugaaaguaaccacaagcguucccaaacuagcggucaugccaggauuucaaaaggugcucgugaccgcggucggcgaaguacuagaacuccacgacuga

SEQ ID NO: 6071 - RNA, 3033 nt, Artificial Sequence
  Cas9 variant
augaaacgaauggcagcugucgggcuaaugccagcagaccccaccgaggccaaagcacucgaacuacuagaccccuacgcacuccgugccgcaggacuagaccaagcacucccucuaacucacuucggacgcgcacuguuccaccucaaucaaaggcgcggauucaagaguaacagaaaaacagacaaaggcgacaacgagucaggcaaaauuaaagacgccacuaaaagacucgacgaagaaauggcaaucaaaaacgcccgaacguacggcgaauuucuccacaugcgccgcacauccgcuaccgaccccaaaaacgucccgacaguacgaacuagacuaucgauagcccgaagggacaaugcggaaaaagaggaagcgggcuacgacuucuauccagaccgacgacaccucgccgaagaguucgacaaacucuggaaggcacaagcgggcuacucacccgacguccuaacagacgaacuaagagacgaaauaaguguaauaaucuuccaccaacgaccucuaaaaacgcccgaagucggucuaugccuauucaguggcucgcacggagugccaaagaaagacaaaagaauacccagcgcacacccccuuaaccaacggaggauacuauuugaaaccaucaacaacuugcgaguagcagcaagaggagaacccgcgcgcggucuaacccgcgacgaaagagacgcuauaguccacgcacuagacaacaaagcccacaccaaaagccuaucgggaaugucgaugaaacuaaaagcccucgguaaagugaucaagcuccgaccagaacagagcuucacccuccaaaccgcaaaccgagaaacaaucgccugcgaccccguacgagccagcuugagucacccagaccgcuucgguccaagauggucgaugcuagaugccgacgcccaaugggacgucguacaaagaaucagagcaguccaaucugaagccgagcacgacgccuuagugaaauggcucauggcgacccacggacucgacagagaccacgccgaaucgaccgcaaaagccccacuaccggaagguuacggaaggcuaggccugacagcaacaaaacgaauccuagcagcccucgaagcagacgucauaccauacagcgacgccgucaaggcgugcggauggcaccacuccgacggacgcaccggugagguccucacagagcuacccuacuacggccaaauacucgacagacacguaauccccggaaccuacaacgagagcgacgacgacgucacacgauacggaaggauaacgaacccgacaguacacauaggauuaaaucaacuacgaagacuugugaacaagaucauaacuguauacggcaaaccggacgagaucgucguagaguuagcacgcgaccuuaaacucucagaagaccaaaagagggacguacaacgcgacaucaagaaaaacacugacgcagccauagcccggggagcgaaacuaucagaaaugggcguccccgacaccggcgcgaauaggaugguacugcgccucugggagagccugggcgacgacguaaugacacgcaauugcccguacagcggcaaacgaauuagcgcaacaaugcuauucgauggcuccugugacguagaccacauccuccccuacucacgcacccucgacgacggcuucgcgaaccgaacacucugucuaaaagaguucaacagacagaaaacugacaaaacccccugggaggcuuggggagacacgcccgcaugggccaccauagaagcaaaccuuaaaaaucugccagcaaacaaagcguggcgcuuugcacccgacgcaauggaaagauuugaaggagaaaacgauuucacaagccgagccuuaaaagacgcccaauaccucagcagaaucgcccgcacauaccucgaugcacuauaugacggagccgacgggaaaucacacgucuggguugugcccggaagacucacagaaaugcuaaggcggcacuggggacuaaacagccuacuaccagacaaagacggcgccguuaaagccaaaaacagaacggaccauagacaccacgcaaucgacgcagcagugguagcagccacagaccgcagcuuaauacaacgaauaagcaaaauggcgagaaaggacgaagugaacggagcagaagaagucgcaagaagcguaccaccaccgugggaagguuuccgaaccgauauagaaacucaacuugaccgaaucaucauaagccacagagccgaccacggacggaucgacccagcggcacgcaaagacggacacgacuccacguccggucaacuucauaacgacacagcuuacggccucggagaaggaaacagcguaguaagcagaaagccauuacucuccuuaaagagcaacgacauugaaguaacgaccaaaggugcaaacauacgcgacguagaccuccaacgccaccucgaaagaaucacccguggccuagauggaaaggcucuagaagcagcacucgcggaguucgcggccacggcaaaacuaccggacggaaccgacaauccauacuacggacuacgcagaguacgacuagaggaaacgcuccaacaaggggcgaggguugaggucaaagaccgcaacggcaagccauucaaagccuacaaaggcgacagcaaccacugcuacgaaauauggagaaugcccgacggcaaaguagucccccaaguaaucacaaccuacgaggcacaccaaaucgacguagaaaagaagccacaucccgccgcaaagagacuacuccgcauuuucaaacgggacaugguagcgaucgaacaagacgacaaagccaucauuggcuacguacaaagcaugcauguggcaaacggacucuuuaucgcaccacacaccgaagccaaugccgacgcaaggagccgcgacaaaucagacagcuuccgucuaauccaaauguccgcaggcccccuagucaaggcgaaugcacgucgcguauacguagaugaaaugggccggcugcgcgacccaggcgcccccuccuga

SEQ ID NO: 6072 - RNA, 3039 nt, Artificial Sequence
  Cas9 variant
auggcgaacaugcgcuaccgccuugcacuagaccucgguagcacaucgcuaggaugggccaugguccgucuugacgcacagaacgaaacaugcgcagucaucaaggccggcgucagaauauucucagacggcagaaauccaaaagacggaagcucacucgccgucagcagacgagaagcgcgcgccaugaggcggcgaagagaccgccuccucaaacggaaaacacgaaugauggcaacgcucaugaaacacggcuucuuuccacaggacgaagcagcucgacaagcccuagucaacaaggaaccauucgcacuacgagcaaagggacucgaccacgcguuacucccagaggaguuugcacgcgcccuauuccacaucaaccagcgucgcggauucaaauccaacagaaagaccgacaagaaagaaaccgacaguagugcgcucaagaaagcaaucggacaacuccgcgaggcaaugcaggcuagcggcugccgcaccguaggcgaauggcucugcgcccgccaccagcaagggcucucagugcgggcaagauaccgcgaaaaccgcauaaccaaagacgauggcaaaaccaaaauagaaaaaucauacgaccuauacauagaccgcgccaugauagaggccgaguucgacgcacugugggcaaaacaaagcgaacuaaacccugaacucuuccacgaaacagcacgcgccgaacuaaaagauugccucuuacaccaacgcccgcucaaaccagucaagccgggccgaugcacccuacuacccgacgaagaaagagcaccccucgcguuaccaagccaacagcgcuuccggauauaccaagaagucaacaaccuaagacuccugagagaaggacuaaacgaggaaccauuaacccucacacaaagggaccaacugauacaagcccucgaaaccaacccaaagcgcagcuucacacagauccaaaaauuacuaggauucaguggacaguucaaccugcaagacgacaaacgcacggagcucaaaggcaauuccaccuccgccaugcuaagcaagaaagaauuuuucggaagucaauggcuauccuuugacgaaacacaucaggacgaaaucgucaugcagcuaguauccgaagaaaacgaggccaggcucaucgccuggcuccaagcagagaccggagucgacgaaauaaccgccgaaagaaucgccaacacaccccuugcugagggauacggcucacuuagcgcgaaagcccuagagaaaauccuaccggcccuacgagccgauguaaucaccuacgacaaggccguucuagcagccggcuucgaccaccacucccacaucagccacgcugccaccggagaaauucuacccgaccuacccuacuacggacaauaccugcaacgacaugugggauuuggaacgggaaaacccgaagacccagcagagaagagauacgggaaaauagcaaauccaacagugcacauaggacuaaaccagguacgaacaguggugaacgcucuaaucaaaagauacggccacccaucggaagugguaguagagcucgcccgcgaucucaagcaaagucaagagcagcggaaagaagaacaagcgcaacaagcgaaaaaccagcgacgaaacgaaagaaugagacaggacaucgccggacucuuaaacaccucaacagagagggugcgcgcacuagaccuacagaaaaugauccuuugggaagaacuaucauucaacguagccgaccgaaggugcccauacucaggcguccaaaucagcgcgcaaaugcuauucagcgaccaaguggagaucgaacacauccucccauucagccaaacucuggacgacucccuuaacaauaaaacgguggcaaugcggcaagccaaccgaaucaaaggcaaccgaacccccgcagaagcggcagccgacuucgcggcacaaggauggccaguggaagacaugcuacaccgagcaagccuaaugcccaaaggaaagcgauaccgauucgcacaagacggaauggcacaguggcugagagaagacaaaggcuuccucgcgcgcgcccuaaacgacacacggcaccucagccgaguggcccgcgaauaccuaagucuagugugcccacaaggaacccgggucauaccugggaggaugaccgcaaugcuaagggcaaaauucgggcuaaacgacauucugggccuaaacggcgagaaaaacagaaacgaccaccgacaucacgcagucgacgccugcgugauugccguaacugaccagucaaugcuacaaaaauucgcaaaggccucagccucagccagggaaaagcaacugaacaaacucguagaauccaugccccuaccaugggacaguuaccgcgaccauguacaacgagccguggaacgcaucuggguaagccacaagcccgaccacggacacgaaggagcaaugcacaacgacacggcguacggacuccugggcgggggccauguucagguacgcaaacgaauggacggcgugcgcacccgcgaaaccgcagcacuaaaagugaucgaguucgcagacaggcaagcccacccaagacacggacuccucccaaauggggaacccaugccauacaagggguacaaaggagacucaaacuacugcauggaaauaguccggaacgauaaagguaaaugggaaggggaagucguaagcacauuugaagccuaccagcuagucagacaacauggcuuggcgagacuacgacacccagcacucagcgucucaggcagaccacugguaaugcgccuauuacgcaaugacacacuacguguaauacacaacggagaacaaagaacaguucgcauuugcaaaaugaccgccgaaggaguaauagcccucgcagacaccacggaauccaauguagacgcccgcacaaggacaaaagaccucuccuacaucuucaaaacugcaggaagucuacaaaaauccaaaggacggagagucgcgaucuccccgucaggcgagaugaaagacccaggcuucuuugacuga

SEQ ID NO: 6073 - RNA, 3051 nt, Artificial Sequence
  Cas9 variant
auggaagucuucgucgacguaucagcuaggcaacuaggcaucgaccuaggcaucggcacaugcgggugggcgcuacucgccgaagacucacucauagcacuaggcacaagaacauucgacguaccagaaacggacaaggaaaggauaccaaccaaccaaauacggcgacaagcacgaggaaugagaagaguaaucgaccgaaggagacaacgcaugaacgcuguaagacgucuauuagcagaccacgggcugcucgcggacggaggaaaacuugggcuggcaacagucagacuagacccguggcaagcgagggcagaaggccuugacagacuccugagcgcaggggaacuagcagucgcacucgggcacauagcaaaacaccgcggguuuagaagcaacucaaagcgcgacagaggagccaacgcuccaaaagaaucgagcgcuaugcuaggcgcgauagcacaaacaggcgaaagacuacaacacuggcgaacggucggagaaauguucuggaaggacgaauuuuaccaaacgcgacgaaggaacagggacggagacuacagccgaacaguacagcgcuuagaucuagaaaccgaaguacaccggcuacuagcagcacaaagacgacucggaaacccacuagcaacguucgaccucgaacaaaguuucauagacguagccuucuuccagagacccuuagcagacagcgacgacaaagugggcccaugcccauucgaacccuccgaaaaacgggccgccaggcacuccccaucguucgaaagauuuagacuguuaucgcgucuggcagcgcuccgccucucaagcggggccggagaaagaccgcuaagcgaugcagaguucgccgcagccugcgcagacuucgggagacuacagggauucagcuuuaaaagacuaagacaacaccuaaaacuagacccauccauacgauucgcgggaauagcacccgaugaagaaggaaaaagagacgugguagcacgaagcggcgaagcaacgccagggucagcagcacucagacacugccucggugacacaguaugggacaacaugcuugggaccaggcccgcacuccuagacgcaaucgcggcaauccucaccuucagggacgacgcggaccgaauagcagaaggacuagcgggccugggcauagaggagcccauccuggaugcacuaauggacggaguccgcaacgggagcuucggcaaguucaaaggcccgggccacauuuccgcgaaggcgugcagggcgcuccuaccccaccuagcccgagggcggguguacucagacgcaugcgcggacgccggcuacgaccacagcaggcaaacggaaacaaaccuagaugauauucgaaaccccguggcgcgaaaggcgcugggggaagcauugaaacaaaucaaaaucauaauacacacucacggacggccaacagccauccacguagaaauggcacgggacauagggaaaagcgcagacgaaagagacgaaauuaaaaagggcauagacaaaagaaacagcgaaaaagacagagcucgccaacaauuucacgagaugguaggaacaccggcagcgggggccgaagacuuacucagguucgaacucuggaaagaacaaaauggauggugccuguacaccggaagggaaauacccauagacgcacuugucagcucggacaaccguauccaagucgaccacauauugccguggagucggagcggggaugauaguuauauaaacaaaacacucugcuucacagaagcaaaccaacauaagaaaggaaugacacccugggaauggcuccacgacgaccccgaaagaugggaaaaauucgcucgcacgguugaaggaugcaaaacaaugaaaggaaggaagaaacgaaaucuacugcuaagagacagcagcagacucgaaaaagaguucaggagccgcaaccugaacgauacccgguacgcauguagacuccuucuggggauucucaaacacacuuacccggacaucguugucgcggccaggccaggcccccuaaccgacagacugcggagagcauggggccugcaaucucucaagaaacaugaagauggcaccagaaaagacgacgacagacaccacgcauuggacgcagccguagucgcggccaccagccaaucaaugcuccaaagacucaccacacuauuccaaaaagccgaacgcgaaggcggccggagagacuucgucggacuugaaccaccauggcccggauucagagcagaucucgaagcgaaacuagaaggagucgucguuagccgagcggagagacgccgcgcaaggggcgcagggcacaaagauacaauacgagccaucggagaaggggaugcaggcccagugguguacgagagaaaaccaguagcagcacugacggaaaaggaucucgaccgagugaaagaccccgaaaggaacaaaguucuaauagagaaccucagacaauggauagcggcaggcaagcccaaagacccagacaaagcccccaggucaccgaaaggcgauccaaugaccaaagucaaacucgucacaacagacgauguaaggauccuaguaaggggaggcaccgcggaccgcggagacauggcacggguagacgucuucaggcaagcggauccaaaggggagauggcgauucuuccucguccccguuuauccccaccaaguauucgacccaacagacuggccucagccgcccaauagagcgguaguagcauauaagcccgaaaaggaauggaccgugaugggcccggaccacgaguuccucuggagccucuacccauuuucguggauagcaguagaaaaggcagauggaacgcgaauagaaggcuacuuucgaggaaugcaccgcucaaccggagcuauaagcauaagcccccaccacagcaaaagccuagcaucaacaggaaucggggccaagacccuagcgagcuucaggaaauucgccauggacagaaugggcaacuuauccgaaauagaaagagaagucaggacauggcacggcguagcaugcaccuga

SEQ ID NO: 6074 - RNA, 3054 nt, Artificial Sequence
  Cas9 variant
augcgggucgacagccuaggccgaugccucagcgacgaggaaugggcacgagucaucuaccaccuguguaagcacagaggguuccauuggaucucacgagcagaggccaaacaaacggaaggcgacaguaaaagugaaggagguaaaguaaaacaaggccuagccggaacagcaaaacucauggacgaaaaaggauaccgcucggccgccgagaugguacucgccgaguuuccagaagcacaaaggaacaaacaaggcgaauacaggaaagcgcuaagcagggagcuauuagccaaagaacuggcgcucuuguucgcacgccagcgaguguucggaaaccgacacgcaacagacacuuuagaaaccgccauccucggcaacucagacaagaaaucaggucuauucuggcaacagaaaccagcacuggccggggccgaccuccucaaaaugcuagggaccugcaccuucgagaaaaacgaauaccgagcgcccaaggccagcuuuacggccgaacgacacguguggcucacaagacuaaacaaccuacgaaucguaacugacggcaucacacgccaacuaacagaacaagaaagacagcuaguacucccccuaccguacagacaagccggagacuugaccuacaagcaacuagggauggcgcucacaaaagcaggacugcuugaagcggguugcuucaaguucaucggccuagcauauccuacugaagcgcaaaaagccgaaggcaaaaccaaagaccccgagagcgccacccucgucaaaauccccgcauggcaggaacuaagacaaacccucaacaaggcaagccuuaacgacgaaugggaaaagcucucaggcgacgcccucuguggccagccagaaauauucgacaaaaucgccuggauccugagcguauauaaagaugacgacgaaguaagaaccgaacuugccaaacucguacucccaaacccagagggacucacggaagcccuacuaaauauaagauuugacaaauuucacgcauuaagccuaaaggcuuuaagagcaauaguaccgcacauggaaaaaggacuaagauacgacgaagcaugcguacaagccggcuaccaccacagccaacuccacaaaaucggagaaggcgaacacaaauaccucccaccccucuacgacggccgagacggagacgggagaaugaucuucgcagaagacgccgacaucccccgcaaccccguaguacucagaagccucaaccaagcgagaaaagucguaaacgccauuauccggagauacgguucccccagcgccguccacauagaaauggcccgggaccugucacgaccauucgacgagcgaaacaaaaucaaaaaggaccaagacgaauaccaggcccgaaaucaacgagaccgugagcaguucauagaacucuuuggccaucccccaaagggacucgaguucgaaaaguggaggcucuauagggaacaaaacggacaaugcgccuacagccaaaaaccucucgccucaucaggcgacgucgccgaaaucuucuuagacggcagcacggaaaucgaccacgcccuacccuacagcagauccuuugacgacucgaagaacaauaaaguccuaguacuaacccgagaaaacagggacaaaggaaaccgcacgcccuaugaauaccuuggcggcgccgaaaacagcgaaagauggcaacgauucuuuaguuucgucgaaagcaauaaggcguaccgacucgcaaaacggacaagacuguuaagaaaagacuucggcgccaaagaauccgaagaguuccgagaacgaaaucuaaacgacacaagauacguuuguagauucuucaaaaacuacgucgaacaacaccucaaauuggccgaaggauccgaagccaaacgcugcgucguaguauccgggcaacucacuaacuuucucagaacacgcuggggccugcucaaaauccgaagcgacagcgacagacaccacgcccucgacgccgcggucguagcagcaugcagccacucaaugguacagcgacucagcaacuacagccgaacucgagaacuagaacaaguucgagacggcuucgucaacaucgaaacgggcgaaaucguuaacccagccaugcaccagcaacuccgcgaacacuuuccagacccauggccauacuucagacacgaacucgaagcccgacuaaaaaucgacuccccagcacuacuacgugaagaaauggcccgacucuccaguuacacagaagaagaacucgccgcacucaaaccacuauucguaucccgagcaccccaaagaagaaacggcggcgccgcacacaaagacaccauauacggacagccugaaaaacuuaagaaaaauggcagcguaucccaaaaaguagcccuagcaagccuagcccucaaagacauagaucuccucgccgacccgcaccgaaacgccaaacucuacggcgccauccgcgagaggcuggaagcccacgguggcaaaggagacaaagcguuccccgccaccaacccgcuaagaaaaccagauaaagaaggcaacccaacugggccgauuguccgcacaguuaccaaaguaauagacaaauuaucaggcauaccuguacgcggagguaucgccaaaaacgacacaaugcuacggguagacguauuuaccaaagcaggccgauuccaccucguaccggucuacguccaccaccgcgucaccgggcuaccaaaucaggccauaacacgaggaaaagacgaaaaccagugggccauaaucgacgauacauucgaguggcgcuucucccuauacccaaaugaccuaguacaaauucgacuuaaagacgaaacccaccucggauacuacgccuccacagaccgaucaaccuccagcaucuccaucugggcgcacgaccgcaaccaguccgugggcaaagauggacucaucagaaguaucggcguaacaaccgcgaaagauaucgaaaaauuccauguagacacgcucggaaacguauacccugcgcccccugaaaaacgacgggggcuagcguga

SEQ ID NO: 6075 - RNA, 3066 nt, Artificial Sequence
  Cas9 variant
augaggaggagacgcgacagauucaagcaaagacaagcggcccuacucaagcaccuggccggagucgggcuauuuccagcagacgaggcugcaagacgggaacuggccggccuagaccccuacgaacuccgcgccagagcauuacacgaagcacucccacucaaccacauuggacgagcacuauuccacuuaaaccaaagacgcggauucaaaagcaaccgaaagacugaccgcggaaaagccgacgacgaggggaaaauccgacuuggcguagcacgauuacaagaggccaugcacgagaagggcagcgcaacacuuggagaguuccuacacggcagaagggcagcggcaacagacccuaaccaaauaccaucaguaagaacaagacuacgagcagaaagcggggaaggagccagaggagacggauacgacuuuuaccccgaucgaagaaugcucgaagacgaguuugaggccaucugggaaucacaacaaguacaccauccggcgguacugacagacgaaauaaaacaacgguuuuucgaagucauauucuaccaacgaccccuaaagcaaccggaaauagggaccugcacccuagucgcaggagaaaggcgccuccccaaagcacacccccucuuccaaaagcgucgccuccuagaagaacuuaacgcccuacgaaucguguggccagggguacaggccgaacuccuaucaagagaacaaagagaccucgcauaccuaaagcuaaaggacaaaagagcagugcgauuugaaagccuaaggaaagcacugaaacucgacccggacgcaagguuuaacaaagagagcgaaaaccggagcgagcucaagggagacgaaguggccgcugaacuaggcgcaaaaucucgauucggcggacgcuggggacacacagcgccagccgaccagugggaaaucgugagcaggauucaagcacuagaguccgacgaugacgaagcccaauuuugcgucuggcuaagcgaaagauaugggcuagacagugaacaagcccgagccguggcagcagcaagacucccgcaaggguucggcagguuuggccucacagccacaaccagacugauaaaagcauuacaagacgagguaauagucuauagcgaagcuguucagaaaacgggacuaggacaccacagcgacuucagaaacggcgaaguccuagcggagcugccauacuacggaauagcacucgaacggcauaucaugcccgggaccggugacccgggcgacagcgacgaaaugagggugggcagaguaacgaaccccacagugcacaucgggcuaaaccaacuaagaaggguaguaaacagacuaauaaagagauauggaccaccaaggcaaauagccgucgaacuagcgagggaguuaaaacuggacgaccaacacaaacgggagauaaacggccgaaaccggcagaacagagaagcagcagaaagacggagccaaaaguuggucgacauaggcauagcagauaagggagccaacagagcgcuguuaaaacuaugggaagaguugaaucccgacaacgcgcuagaccgccggugcgucuauacaggaagacaaauauccauagaaauguuauucagcggggcagucgaaguagaccacauccuacccuucgccgcaacucucgacgacagcaacgcuaacaaacugcuaugccuaagagaggcgaaucggaacaaacgaagaagauccccguucgaagcauucggacaaggggccgacugggaagaaauagccgcgagggcggcgagacucccgagggaaaaacgauggcgauucgaacccgacgcaauggcccgcuucgauacagaagaaaaauuccuagcacggcagcuaguagacacgcaauacuuaagcagacucgccagagaguaccucggaguacuguucccggacaagggagaaggcagcgggagaguaugggucucccccggcagacugacggaaaugcuaagacgaucauggggacuaaaccaccuacuacccgaccacaaccucggaggcggggcggaccaaccgaaaaacaggagggaccaccgacaccacgccauagacgcgauaguaguggcuguaacggacaggcaccuacuacaagccauagcaagagaagcaggccaacgaggacacgaagccgccaacagaaugacagcggauuuaccaguaccauggccggacuucgacagggacguggggcaaguaauacgacaagucguaguaucgcaccgcgcagaccacggcaccguaagcaaagccggggcagcaaaaggacaagacaguacagcaggaagacuacacaacgauacagccuacggccugacaggacagacagacgaaaagggaaauacaauagugguacgacgaguaccgcuaacagcucucaagaaaccaaccaguauugaagcgguacgagacgacgaacugcguaaagcacuuucagucuggacaagaggcuacgacggaaaagccuucgaagcaaggcucucccgauucccggaacucggaccccuacaauucagggggauacgacgagugagggucguggaaccgcuaacagugauacccauaagggacaguagcggaaggguguacaaaggguacaaaggugacucgaacuacagguacgaugugugggaauuaaaagacggcaaaugggucgcggaaguagugagcauguucgacgcgcaucaaucaagcuggaccagcccaguaaggagggaaaacccgacggcacgaaagguacuaagccuacaacagaacgacaucguggcaauagagccagagggaaaagaaagagagcucaugcgaguagcccagcucagacaaggcgggcagaucacccuagcagcaugccaugaggccggagacuuaaaaaggcgcgacgcggaaucaaacgaagucgacccauucaaauauuucucacccaccgcgggagggcucaaaaggguacgggcgcgacagguaagaguugacgagcucggcaggguauuagacccgggcagucgagaucgagaaagaggggcagcguga

SEQ ID NO: 6076 - RNA, 3066 nt, Artificial Sequence
  Cas9 variant
augaaauauacucuaggccuggacguaggaaucgcaucaguggggugggcagucaucgacaaggacaacaauaaaaucauugaccuaggcguacgaugcuuugacaaggccgaagaaaguaaaacaggagagucucucgcuaccgcccgcaggaucgcacggggaaugaggcggcgaauaagccgccgaucgcaaagacucagauuaguaaagaaacuuuucguccaguacgaaauaaucaaagauucaucugaguucaaccgcauauucgacacaucgcgcgacggcuggaaagaccccugggaacuucgcuacaacgcccuuucccgaauccucaaaccguacgaacucguccaagugcucacucacauaaccaaacgucgaggcuuuaaaagcaaccgcaaagaagaccucucaaccaccaaagaaggcguaguuaucaccuccaucaaaaauaacagcgaaaugcuccggaccaaaaacuaccguaccaucggcgagaugaucuuuauggaaaccccugaaaauucuaacaagcgcaacaaagucgacgaauacauccacaccaucgcccgcgaggaccuccucaaugagaucaaauacauauucagcauccaaagaaaacucggcuccccauucgucaccgaaaaacucgagcacgacuuucuaaacaucugggaauuucagaggccauucgccucgggagacagcauccucagcaaggucggaaaaugcacacuucugaaagaagaacuacgcgccccgacguccugcuauaccagcgaguacuuugggcuccuccaauccaucaauaaucucguccugguagaagacaacaacacacuuacccucaacaacgaucaacgggcaaagauaauagaauacgcgcacuuuaaaaacgaaauaaaauacucggaaauacgaaaacuccucgacaucgagccggagauacuauucaaagcccacaaccucacacacaagaaucccuccggaaacaacgaaucaaagaaauuuuacgagaugaaaagcuaccacaaacucaaauccacccuacccacagacauauggggcaaacuccacagcaacaaagaaucucuggauaaccuguucuacugccuaacaguauacaaaaacgacaacgagaucaaagacuaccuacaagccaacaaccuagacuaccucaucgaguacauagccaaacuacccaccuucaacaaauucaaacaccucucccucgucgccaugaaacggaucaucccauucauggaaaaaggcuacaaguacagcgacgcaugcaacauggccgagcucgacuucaccggcucgucaaaacuagaaaaauguaauaaacuuacagucgaacccaucauugaaaacgugaccaaccccguaguuauccgagcacuuacacaagcccgaaaagucauuaacgccaucauccagaaauacggucugcccuacauggucaacauugaacucgccagggaagccggcaugacucggcaagaccgcgacaaccugaaaaaggagcaugaaaacaacagaaaagcacgcgagaaaauaucagaccucauccgacaaaacgguaggguagccagcggacuagacauccucaaguggcgacugugggaagaccaaggaggacgcugugccuacuccggcaaacccauacccgucugcgaccuacuaaacgacagccugacacagauagaccacaucuaucccuacucgcgcucuauggacgacuccuacaugaauaagguccucguucucacagacgaaaaccaaaauaagcgcaguuacacuccguacgaaguauggggaucaacagaaaaaugggaagauuucgaagcccgaaucuacaguaugcaccuuccacaaucaaaagaaaaacgccuccucaaccgcaacuucaucaccaaagaccucgacucauucaucucacggaaccucaacgacacgcgcuacauaagccgauuucucaaaaacuacauagagucuuaccuccaauuuuccaacgacuccccaaaaucaugcgucguaugcgugaacggccaauguacggcucaacuacgcagccgcugggggcucaacaagaacagagaggaauccgaccugcaccacgcacuagacgccgcagugauagccugcgcagaccgcaagaucaucaaagagaucacgaacuauuacaacgaaagagaaaaccacaacuacaaaguaaaauacccucucccguggcauaguuuccggcaagaccuaauggaaacacuagccggcguguucauaagccgcgcgccccgccgaaaaaucacgggcccggcccacgaugaaaccauccgcucgccaaaacacuucaacaaaggccugaccucgguuaagauaccccuaaccaccguaacccuagaaaaacucgagacuauggucaaaaacacaaagggcggcauuuccgacaaggcagucuacaacguacugaaaaaucgguuaauagaacacaacaacaagccccucaaggcguucgccgagaaaaucuacaaaccccuuaaaaauggcaccaacggagcaauaauccgcuccauccgcgucgaaacgcccucuuacaccggggucuuccgcaacgaaggcaaaggcaucagcgacaacucccuaaugguacgcgucgacguauucaaaaagaaagacaaauacuaccucgugcccaucuacgucgcccacaugaucaagaaagaacuacccucaaaagcaaucgugccgcuaaaacccgaaagccaaugggaacugauagacagcacgcaugaauuucuguucucacucuaccagaacgacuaccucgucauaaaaaccaagaaaggcauuacugaaggauacuaccguucgugccaccggggcaccggaagucugagccuaaugccucacuucgccaacaacaaaaacgucaaaauugacauaggcguccgcaccgccauuagcauugaaaaauacaacgucgacauacuugggaacaaauccauagucaaaggcgaaccccgacgaggaauggaaaaauacaacucuuuuaagucaaacuga

SEQ ID NO: 6077 - RNA, 3072 nt, Artificial Sequence
  Cas9 variant
augaaaauccugggcuucgacaucggcgucgcauccaucggcugggcauucgucgaaggcgacgaaauacgagacugcggcguccgcaucuucacaaaagcagaaaaccccaaaacgggcgaauccuuagcgcuaccccgccgcgaagcgagagggguaaggcgccgccuggcccgccggagaguacgacucaacacgauuaaaaagauaauaugcaaagaguucgaccuucgacuuuccgauuacaucgccgacgacggggaauuaccaaaggccuaccaaaccaacaaggacaccaaaucaccguacgaacuccgcuacaaagcccuuaacgaacgccuaucaaaagaggaacuggcacgagucauccuccacauagccaaacaccgaggauacgggaauaagcacgccaaggacggagacgacaaagacagcggcaaagucaagaaagccauuggagaaaacaaaacccuacucgaacagaagggauacgaauccgucggagaauacugcuucagggaguucuucaaauccauaaaagacaaagacggcgaaacgcacaacaucccaucacagaacauaaggaacaaaaaggggaacuacgaccgcugcguaagccagaaacaacucgaagacgaacuaaaacucauauucgcaaaacaacgcaaacugggcuucaacaaagaguucgaagacgcgauccucgaaguagcauucuaccagcgaccacuaaaagacuuugacgacaaaaucggagacugcaucuucuucgauaacgaaaagcgagccccaaaagaguccaucuccgccauagaguucgucgcccucacucggauaaucaacacccuaaaauaccucucaaaaaccacgggcgaggucuacgagaaggaaauuaucaacaagauauggcagaaaauccucgaaaacggcaagaugaccuacgccgaacuacggaaaauccucgcccucgacagcagcguguucuucaaagacaaggaucucgacuacacgcuaggaauaaaagaggccgagaaaaucaaguucaucgaauuuaagaaauuaauaaaauucaagaaagcucuaggcagcuucgacggacuaucacgcgaaauacuugacaacaucgcaaugcaaauagcaauuaccaaagacaggcaacgccuacucgagaagcuggaaguguucccacuaaacaaagaacaaaaagaaaaccugagucagcuaaacuucagcaaauacaucgaccucucacugaaagcccugaaccaaauccucccauucaugagagaaggccgccgcuacgacgaggcgaaggacgacgcgaaacuccaagaaaaagcuaaaaacaccaaaaaggaagaguuccugccuccccuuaaagaguucgaccucaaccucacaaacccagucgucgcacgcgcccucgcugaguucaggaaaguacucaacgcccuacucaagaaauauggcaaaguccacaaaauacaccuagaauuugccagggacaugcgucucgacuucgacgaacgcgaaagacucaucucaauucaaaacgacaacuucaauaaaaggcaacuugcggaagacuucugcaaagaacacggacuggagccaagcaacgcaaacauccucaaaaucaagcuguggcaagaacagcaauggcacugcauguacagcggggaacugaucggcaucccagaccucaaggacccaacgaagcuccaaguagaccacaucuaccccuacucccgaucguucgacgauucauacacaaacaagguccuaguacgagcagaauggaaccaagagaaaggaaaccacacuccuuuugaagccuucggcggagacaaaaacaagugggacaaaaucguagcucucgcggaaaaacuacccccguccaaaaagcuaaaccgaucggagaaaagcaagaaagacaagcuccucgacgaaaaauucaacgacaaagagcuagguuuccucgcgcggaacauaguggauacaggcuacauagcccgccucguagccaaguacaucgauauguaccucgaguuccucccgcuggaagaaaacgaaaacacgagucucgccaggggcgaaaaggggagcaagaaacacaucggcauaguaaacggccgacugaccuccgaaguccgccacaacugggggcuagacccgaaggaccgcgacaaccaucugcaccacgcaaucgacgcaauagugaucgcauauaugaacgacaaacgcaucaaagccuucgcugacuuucgaaggcugaaggaacuaaaaaucaaaagguacggacgagaaaucacagaagacgaauaccaggaaaagaagaaagaacuaucaugcgcacccuucgaugacuuccgaaacagaacccucgaaaacauagacaaaaucuucguuucaaggccaccacggaaacgggcacgcggaaccuugcacgaggaaaccuucuacagcaucgacgacaaaaagcuacugaaggccuacggaggaaaagaaggaaugcagcgggcccuaagccucggcaagauacggcaaaucggaacgaaaaucgucaaaaacggaacaaugguacgaguugacauauucaaagacaaaaggggccgcuucuacggagucccaaucuacacgauggauuucgcacucgggguacuacccaacaaagcagccgucucagguaaggacaaaaacggucuaauaaaagaaugggccgaaauggauucgggauacgaguucugcuuuucgcuuuucaaagacgaccucauccuaguucagcgaaaagaaaugcaagagcccgaacucugcuacuucgucagcuucgauagcagcaacgcccagaucgacguacgcagucacaauaaccacuuuuccguccuaaacgagaaccaaaaacuacuauucaaguccgcgacucaagccgaagucauaggcgaaagcaucggaauccaaaacuuaaaaguauucgaaaaguggcacgucucaccacucggugaaguacgcaaagccgaguucuccccgagaggcgaagcaaagcuaaaaacgagcaaaaagcgcaagaaauga

SEQ ID NO: 6078 - RNA, 3072 nt, Artificial Sequence
  Cas9 variant
augaaaaucuauuccuuugacauaggcgucgcauccaucgguugggccuucaucgaaaacgaaguccuccaagauuguggcauccgaaucuucaccaaagccgaaaacccuaaaaacggggccucccucgcacucccacgcagggaagcccgagggguacgaaaacggcuagcccgucggcgcggacggcucaacaccauuaaacagcugcuaugcaaggaguucggccuccagcuggaagacuaccucuccaacgacggagaacuacccaaagcauacaccgcgucaaaagcgaacccccuaaaauccccauacgaacucagaacauuagcucucucgcaaaaacuagacuccaaagaccucguacgagugauacuacacauagccaaacaccgcgguuacggaaacaaacacgccaaagacagcaaggacacagaaagcgggaaagucaagaaagccauagaguucaaccguaaaacacuagccgaaaaaggcuacagguccgucggcgaauacuuauaccgcgaguucuuccaacagucccgcauuucgcaaaacaacggggccacggaguucauuaacguucgaaauaaagcagguaauuacgaacacugcgucgcgcaagauaugcucaaagaggaacucgaaagcauccuaaacgcccaacgccaguucgguuucucucuaaaacaagacuucgaaagcaaacuccucaccaaaauauuugaacaaagaccccuaaaaucauuugcagacaaagucgggaacugcugcuucaucgccggagaaaaacgcgcaccaaaagacagcccaucagcgauagaguuuauugcacucucccgcacaaucaacacucuaaucaaucucagcaaagaauccggagaaaucuacaauagagcaaucauucuacagauagucgaaucgacccucaagaaaggagaaauaagcuacaaagaacuccgcgaaauaauccgacuagacgaacgccucagauucaaagacccccgccucgacuacagucgcgagauaaaagaggcggaaaaagucaaauuccucgaguucaaacagcuaaaaggauuuaaaaaggcacuuggggaauccuucacaacccuggccaucucacagcuagaugaaaucgcugagcacaucgcgcuaaucaaagacagaguaaaauugaacgagaaacucgaaagcuaugcucucaccaaagaacaacgugaagcccuaucgaaccugucauucuccgcucacaucaaucugucacugcaggcgcucaaacaaaucuugccguucaugcgcggagacaacggggaacagugccuugacuacgacgaaucaguagaaaaggccggccucaaggcgcuaucaaaagauacccucaagggccaaaugcuuccaccccucaacgaguucgaaccauaccuaucaaaccccgucguugcgcgggcccuagccgaauaccgcaaaguccuuaacguccuccucaaacaauacggcagcccccacaaaauccacauagaguacgcacgcgaagcaaaacuauccaguacagaaaggcaaaaauacgagaaagagcaaaaagauaacuacgcggcuaaccaagcagcccacaagaagugccaagagcucggacuagagcccucaagcacaaaccuacuaaaacucaaacuuuggcaagaacaaggaggccucugccuauacagcggcgcaaaaauaaccauuuccuaccuccaagauccaacagcccuccaggucgaucacaucuaccccuacucgcgcuccuuugacgauuccuacaugaacaagugccuaguucucaccaaagccaaccaagagaagggcaaccggacacccuucgaggcauucggcaccgacucagcaaaguggggcguaauuacgacgcuagcccagaaacucccacacaagaaacgccgucgcauccucaacaccgcauucaacgacaaagaagccggauucaaacugcgcaaccugaacgacaccuccuacauagccagacuugucgcagacuacacagaaacguaccuagaguucuuaccccucgucgaaucagaaaacacaacacucuccaaaggacagaaaggcucuaagaagcacaucgccauagugaacgguguacuaacauccaccaugcgcuacuaucucggcuucgcgaguaaggaccgggacaaccaucugcaccaugcauuggacgccgucaucaucgguuucaugaacgacucagugaucaaggccuucuccgacuucaagaagacacaagaaaccucaaaggccgcauacuacgcgcacaccuuaagcaaacaggaauacaagaaacagcgcgccuucauacaacucccguccggagaaaacuucaggguaucagucuuggagaaaguagagagcgucuucguguccaaaccuccaagaaaacgaguacgcggcgcccuucaugaagccacauucuacucccccaacgaucccaaacuacuaaagaacuacggcggcacaaaaggcgucgaacgagcccucgcuuuaggcaaaaugcguaaagucggggcgaaaaucgucagcaacggcgccaugguucgcgucgacauauuuaggcacaaaaguagcggcaaauucuacggcgucccggucuacaccauggacuucgcccucggcauacucccaaauaaagccguaguagucggaaaagaccaaaacggcgucaucaaagacuggcuagagauggacagcucguaugaguucaucuucucgcucuacaaggacgaugugauccuaguacagaagaaagaaaugcaacgccccgaacuuugcuauuucgucagcuucgauacaucaggagccuccauuaaaguggccaaacacgacaacaacuucucaacccuaaccgaaaaccaaaaacuccuguucagcaacgccaccaaagaagaagucgucgguaaauccauaggaauccagaaccuaaaagucuucgaaaaauggcaagucagcguacuaggagaaguaaaacgaacacaaucguacccaagagaaaacaucucgcucgcuuccaaggcaaagaaauga

SEQ ID NO: 6079 - RNA, 3075 nt, Artificial Sequence
  Cas9 variant
augauacgcacccugggcauugacauuggcaucgcgucgauuggaugggccgucaucgagggcgaguacaccgacaaaggucuagagaacaaagaaauaguagccuccggcgugcgcguguucacuaaagccgaaaauccaaagaauaaggaaagccuagcgcuuccccgcacacucgcccgcuccgcaagacggcgcaacgcccgcaagaaaggccgaauccaacagguuaaacacuaccuauccaaagcccuaggccuggaucuagaauguuucguccaaggggaaaaacucgcuacacuauuccagacaagcaaagacuucuuaucacccugggagcuaagagaacgcgcucucuaccgaguacucgacaaagaggaacuggcccgaguuauccuacacauugccaaacgaagaggauacgaugacaucacauacggugucgaagacaaugacagcggcaagaucaagaaagccauagcggaaaacagcaaaaggaucaaagaggaacaaugcaaaaccaucggagagaugauguacaaacucuacuuccaaaagucacuaaacguccgaaacaagaaagagagcuacaaucgcugcgucggacgaagugaacuaagagaggaacuaaaaacaauauuccaaauucagcaagaacucaaaagcccauggguaaacgaagaacuaaucuacaaacuccugggaaacccagacgcucaauccaaacaagaacgagaaggccugaucuucuaucagagaccccuaaaaggcuucggcgauaaaaucggcaaaugcucacacaucaagaaaggggaaaacuccccauaccgcgccugcaaacaugccccaagcgccgaggaguucgucgcccucaccaaaucgauuaacuuccucaaaaaccucacgaacagacacggccugugcuucucccaagaagacauguguguauaccuaggcaaaauacuccaagaagcccagaaaaacgaaaaaggacuuacauacagcaaacucaaacuacuacucgaccuaccuucagacuucgaauuucuaggccucgacuacucaggcaaaaacccagaaaaagcagucuuccucagccucccuucaacauucaagcucaacaaaauaacccaagaccgaaaaacccaagacaaaaucgccaacauccuaggcgcaaacaaagacugggaagcgauucugaaggagcucgaaagucuccaacuauccaaggaacaaauccaaaccaucaaagacgcaaagcucaacuucuccaagcacauaaaccuaagccuagaagcccucuaccaccuucugccccucaugagagagggcaaacgauacgacgagggcguggaaauccuccaagaacgcggaaucuucucgaagccacaacccaaaaaucgccaacuacucccaccccuuucggaacucgcaaaggaagaaucauauuuugacauacccaaccccguccuacggcgcgcccuaucagaauuucggaaaguagugaaugcccucuuggaaaaguacggaggcuuccacuauuuccacauagaacucacccgagacgucugcaaagcaaaaagcgccagaaugcaacuugagaaaaucaacaagaaaaauaaaucggaaaacgacgcagcgagccaacuccucgaaguccucgggcuacccaauacauacaacaaccggcugaaauguaaacucuggaaacaacaagaagaguacugucucuauagcggagagaaaaucaccauagaccaccucaaagaccaaagagcgcuccaaaucgaucaugccuucccacuaucgcgaagccuggacgauucccagucaaacaaaguacucugccuaaccuccagcaaucaggaaaagucaaacaaaacccccuacgaauggcucggauccgacgaaaagaaaugggacauguacgucggccgagucuacuccucaaacuucucgccauccaagaaacgcaaacucacgcagaaaaacuucaaagaacgaaacgaagaagacuuccuggcgcggaaccuuguagacaccggcuacaucggaagagucaccaaagaauauaucaagcacucauugagcuuccuaccucuacccgacggcaagaaagaacacauaaggaucaucagcgguucaaugaccuccacaaugcguagcuucuggggcguccaagagaaaaaucgagaccaccaccuacaccacgcacaagacgcaauaaucaucgccugcaucgagccauccaugauccaaaaauacaccaccuaccuaaaagacaaagagacacaccgcuugaaaagccaccaaaaagcccaaauccugagagaaggagaccacaaacuaucgcuccgauggcccaugucuaacuucaaggacaagauccaagaauccauccagaacaucauaccuagccaccacgucucccacaaggucaccggagaacuacaccaggagacgguccgcacaaaagaguucuacuaccaagcauucggaggggaagaaggaguaaagaaagcccuaaaguucggcaaaauccgagaaauuaaccaaggaaucgucgacaacggagccaugguaagagucgacaucuuuaaguccaaagacaaaggcaaauucuacgccguccccaucuacacauacgacuucgccauaggcaaacugccaaacaaagccaucguccaaggaaagaaaaacggaaucaucaaagacuggcuugaaauggacgaaaacuacgaguucugcuucagccucuucaaaaacgacugcauaaaaauccaaacuaaagaaaugcaagaagcaguccuggcaaucuacaagagcaccaacuccgcgaaggccacaaucgaacucgaacaccucuccaaguacgcacucaaaaacgaagacgaagagaaaauguucaccgauaccgacaaagagaaaaacaaaaccaugacccgagaaagcugcggcauccaaggccucaaggucuuccaaaaagucaagcugagcguacuaggcgaaguccucgaacacaaaccacgcaacagacaaaacauagcccucaaaacgacuccgaaacacgucuga

SEQ ID NO: 6080 - RNA, 3078 nt, Artificial Sequence
  Cas9 variant
auggguggcuacaugccacaacuuaugcgauaccgccucgcccuggacauaggcagcacgagcaucggaugggccaugauacgacuauccaugcaaaacgaacccauagcaauuauccgcauggggguacggauuuucuccgauggccgcaacccgaaagauggcucgagccucgccguuacgcgccgaguagcccggcaaaugcgccguagacgugaccgucuccucaaacgcaagacccgacuccugaacgcgcuagugcaaaagaaauucuucccagaggacgcagacgcacgcaaagcacucguaguccuuaaccccuacgaacuacgcaaagaaggacuauacaggcaauuaucgggcccagaguucggcagagcacucuuccacaucucacagcgccgcggauuccuauccaaccgcaaaaccgacaagaaagauaacgacagcuccguccuuaagaaagcaauaguggaccuacgucagcaacucgaaguugaaaauugccagaccaucggagaauggcuguucaaacagcaacaaaguggaaaaagcguccgagcacgccuacgagggaaaacacaaaaagacaaagcauacgacuucuacauagaccgagccaugaucgcccacgaguucgacacucucugggugucccaagcaaaauacgacccgcuccucuucaacgaagacgcaagggcuauccuuagagacauccuacucuaccaacggccacuaaaaccagucaaaccaggucgauguacccugauaccagaugaaagccgggcuccacucgcccuaccacucacgcaacaagcccggaucuaccaagaacuaaaccaccuacgcaucacaacaccagcccuaggggcacaagcacucacagucgcccaacggaacacaaucgccgcacuccuagaaaagagcgacgugacauucguaaaaauagccaaagcacugggccucacauccacaacagaguucaaccugcaggacaucaaacgcgacagacuaaaaggaaaugcaaccgcaauaauccuggcgcggaaccaauauuucggccgacgauggcacgauuucaacgcagaccuacaaaaccugaucguagacaagcucgucaaugaagggagcgaaacagcacucaucgaauggcuaaaagccaacacagacguagacgaauccgccgcagaaaggguaucgggagucacccuucccgaaggguacgggagccuaagcgucgccgcccuacgaaggcuacuacccgcccuaaaagaagacguagucgucuacuccgaagccgucaaaagagcuggcuucgauucgcacuccgcacucagccuaaucgaacagaccggcgaacuauaccaagaacuccccuacuacggagagguccugcaaagacacguaggcuucggaagcggcgacccaaacgacagcccggagcgcagguucggcaaaauagccaacccgaccguccacauaggacuaaacgaacuccgaaagaucauaaacgcccucauuaaacgcuacggcaacccggcagaaguaguggucgagcucgcccgcgaccucaaacucucaagagagaaaaggaaggaaauacaagaagaacaaaaacaaagacaagaccgaaacgaaaagagaaucaaagacgcaugcgaaauacugggcaucgacccauuaguaaucgaccgagguaagcgacgcgaaaucucccagaaaaugcaacuaugggacgaacugaaccccaaggacgcggccaaccgccgaugcccauacacaggggaccagaucagcauugaaaaacugcucagcgcagaagucgaaauagaacacauccucccauucucgaaaacacucgacgacucgcuaaacaacaaaacaguagccaugcgacgcgcgaaccgagauaagggcaacagaacccccuacgaagcauucggagaaagucuaaauccagacuaugacuacgacgcaauccuccaacgcgccucacugaugccccgagaaaaacgcaaaagguucgcgucggacggcuaucagcaauggcucagggacgacaaggacuuccuaucaagagcccuaaacgacacggcuuaccugagccgcauagccaaggaauaccugacacucauaugcccuccaaacucgguccgcgccauuccggggcgaaugacagcacaacuacgcgccauguucggccuuaacagacuccuuagcgaaggcggaaucaaaaacagagaagaccacagacaccacgccaucgacgccgccgucauaggaguaaccgaccaaggccuucuacaaaaauucagccgagccuccgcccggaccagagaacuacagcucucacgccuagucgaugacaugccacucccgugggacacauaccgagaacacgucacccgagcccuagaacaccucgucgugagccacaaaccagaccacggguaccaaggcaaaaugcaugaggacacagccuggggacuaagagacaaugggcaaguaacccgccgcguacgcucagaagacggcggcccacgccaacgccucuuagagaauaagaacguugucaagaucaacagcacgcgagacuuuagcaggcacgggauagacgagcagggacagguaaacgccuauaaaggauacgucgggggaagcaacuacugcaucgaaauauggaucgacgaaaagggaaaauggaauagcgacguggugucaacauuccaagcauaccaaauuguaagagagcuaggagaaaaagcagccuggcaaaaacuccgaaauccacuucugucccucagcgcaaagccgcuuguaaugcgacuaaucauugacgacguaguaaagaugcaaauagcagggcaaaacaaaauuaugcgaguuguaaagaucgcccaaaacggacagaucuucuucgcagaacacaacgaagccaacguggacgccagagacaaagacaaaaacaaccccuucaaguacaucagcaagaccgcaggcucacuccagaaagccggcggaauacacauggccauaucgcccaucggcgacgcacgaccgguacgcuacggacgcuga

SEQ ID NO: 6081 - RNA, 3084 nt, Artificial Sequence
  Cas9 variant
augaaauacaccuuaggccuagaugucggaaccaacucuauaggcugggcgguccuagagcuaaacaccaacggggaaccgcaacgaaucgagaaacucggaucccggauauucaccgacggccggcaccccaaagacggaacaacccuagccagcaagcgaagacagaaacgccacgaacgacggcgacgggacagacuacaccaacgcaagaaacucgugcucaaccaacuugugagcaugggacuguuuccgcaguccgaacaagaacagcaagaccuaaaaagccucgauguacucacgcuacgcgccaacggugucuccaaacaacuaagcgccuacgagcucggccgcguauuuuacuaccucaaccucaaacgcgguuuuaaaagcaaccgcaaagguggaucggaggaagauaaagccaacaaaaucuccgaacgaaucaagaaacuccaggaacagcucaaagaaaacgacuucaaaacggucggacaauaccugcacgaccgauacaucaagggacuaucaacaaaggcaacaaucgagaacgacuuccacuuacuccgccaacucaucgaagacgaguucgacuucaucguagaaacccaaaguaaauucuuccccgaaauauccgacgaacaauggaacaccuuacgaaaucgaauguuccaccaacgaccccuaaaaccagucgaaacaggcacgugcucccuauucgaagacaagaaacgcacauacaaauacaugccuucuuucgaagaguaccgguuccuaaccgagcuuuucaaccuguccuaucaagacgaaaacuuccacucccacucgcugagcucggaacaaauuuucaaagucuuccacgaacuuaaaaacacccgggaagcuaccuacaccaaaaucaagaaacuccucaaacuccccucagaccucagcuucuccaucgaacgaucgaaauccaaagacaaaaucaaaauaucaaccaccaaccacuucuucaguaaaucccugcucuuugccgaagagugggccucucuagaccuaaaacugaaagacgaaguagccgagaucuacuucagcgacauguccgucgaagaaauuaagaaaggccuccuccaacucaaaaucgacuccgagaucauagagaaccugcucgaagaaaaagucccaaacguacaagaggcuaccugcagcuacuccaaagaagcccuacagaaaaucguaucacucauauuagaagaggaacgccauccgacgcuuaucguagacgaccucuucaaaaacgaaaaagaagagacaucccucaucgaccggcuagacuacuacggagcuuccaucccugacuccaugcaacccauaccacaacacaucaaagacaacaaccugacgcucaacgaggacgaaaaacgcuacggcaaaaucgccaaucccaccguccacgcagcucuaaaccaaauccgccagguagucaacgaccucaucgaacaauacggcaaaccuacgaacauccacaucgaguucgcgcgagaucucaagaaaucgaaagaagaaagagacuucgacaaccgcaagaaaaagaaaaacgaagaacugaacgaacaaguccgcgacuucauagaaaaacacaaccaaaagccuagcgccuucaacuucgaacgagucaaacucugguucgaacucgacgcuaugaauaaucagguaugcgccuacagcggcaagaccaucucagcccggaugguccucucggacgaagugcaaguagaccacauacucccuuucucccgaacccuagacgacucacucgccaacaaaguacucguccucgcaucagagaacguuaaaaagcggaaccguacccccuacgaagcguuuggccaggacaccgagaaaugggccuccauccaggaacuagcaaaacgacucccguaccacaaacaauggagauucgccgaggacgccaucaagaaauucgaagaaaaagaccaauuccuacaacggcaccucaacgacacaagauacaucuccaaaaucgccaagaaauaccucggauccauaaccgaccccuauaaaaucguagcgucccgcgggcagaugacuucgauuauaagagguaaacucggccuaaaccaauucauucagaaacccgacgguaccaaaaaccgcgaggaccacagacaccacgccaucgacgcuuugacaguugcccucacaucccgcucauaccuaaaacgaauauccgacgccucggccagaaaccaagauccuaacagaauccccaucccugagccauggaagggguuuaucaaggacgcagacgucaaguucaacgaaaucauuguuucccacaaagucgaccaugguaaaaacggccccuucauggaagagacaugcuucggccucaucaaaaaccccaacaaauacgaagaagaaaacgacuucaaacucauaacaaccaaaagccuggacucagucaaggacccaagcacaauacgaagccaaucgcugcaaaaccucgcagagaaaagcggcguaauaucccucgccaaaagcggcgugaagaaacuacgcguguaugacgucacuaaagaaaacccagccgacauaggccuaaucgaaucaggccuugccaaaauaacccacggcaaagacaaacaacacgucaaacacuaccaaaagggcgacaucaacuaccucgcaaucuggugccuaccccaaaacaucacucucaaaucagacaaccacaagaaacgcaaaaccgauuacauauucaccgccauuaaaacauucgaccucaacagcaaaaaccccaacgaccuacgcccccaccccgccgccaagcuaguaacgaaaguauacaaaggcgacaccguggcccucgaaguaaacaaccagcugaauuacuacaucguuaaaucaauacgggcugcuaacaagaaacucuacuucuuaaaaaucaaccagagcuccgaacuagccaacgaaacgcaauucauucccgccuacacuaaacuggucgauuacaaauuccgaaaaguaagcgucucacccaccggcgucauaacugauaacgguccccuccucaaauga

SEQ ID NO: 6082 - RNA, 3090 nt, Artificial Sequence
  Cas9 variant
augaggagccuaagguaccggcucgcacucgaccuaggcuccacgucgcugggaugggcgcuauucagauuagaugccugcaacagacccaccgccgugauaaaggccggagucaggauuuucucggauggcagaaacccaaaagacggaucaagccuggcagugacaagacgggcagccagagccaugcgcagaagaagagauagacuccucaaaaggaaaacacgcaugcaagcgaaacuugucgagcauggguucuucccggcugacgccggcaagcggaaggcccuagaacaacuaaacccauaugcacuacgcgccaaaggacuccaagaagcucuacuacccggagaguucgcaagagcacuauuccacauaaaccagaggagaggcuucaaaucgaaccgaaaaaccgacaagaaagacaacgacucgggcgugcugaagaaggcgaucggacagcugcgccaacaaauggcagaacaaggaagucgaacagugggagaauacuuauggacacgacuacaacaaggacagggaguaagggcgagauacagagagaagccauacaccaccgaagaaggaaagaagagaaucgacaaaagcuacgaccuguacauagaccgggcaaugauagaacaagaguucgacgcauuaugggcagcgcaagcagcguucaaucccacccucuuccacgaagcagcacgagccgaccugaaggacacgcuacuccaccaaagaccucuaagaccaguaaaaccaggaagaugcacauugcucccagaagaggaacgcgcaccccucgcacuacccuccacgcaacgauuccggauacaccaggaaguaaaccaccuaaggcuccucgacgaaaaccuaagagaagucgcccuaacccuggcacaaagagacgcgguagugacggcccuagaaaccaaagcaaaacuauccuucgaacaaauacgcaaacuucuaaagcuguccggaaguguacaguuuaaccuagaggacgccaagcgcacugagcucaaaggcaacgcaacaagcgccgcgcucgcccgaaaggaacucuucggggcagcauggaguggcuucgacgaggcacuccaggacgagaucgucuggcaacuggucaccgaagaaggagaaggcgcucuuauagcguggcuacaaacacacacaggaguagacgaagcccgggcacaagcaauagucgacgucucacuacccgaaggcuacggcaaucuaagcaggaaggcauuagcccgaauaguccccgcccuaagagcggcggucauuacauacgacaaagcuguccaggccgcaggauucgaccaccacagccagcucggauucgaauacgacgcaucagaagucgaggaccuaguacaucccgagacgggcgaaaucagaagcguauuuaaacagcuaccguacuacggaaaagcacuccagaggcaugucgcauucggaagcggcaaaccagaagaccccgacgagaaaagauacggaaagauagccaaccccaccguacacaucggacuaaaucaggucagaaugguaguaaacgcacucauaaggcgauacggacgcccaaccgaaguagugauagaauuggccagagaccugaagcaaucgcgagaacaaaaaguagaagcacaacgaaggcaggcggauaaccaacggcguaacgcgagaauacgacgcuccauagccgaaguguuaggcauaggagaagaacgcgucagagggagcgacauacaaaaauggauuuguugggaggaacucuccuucgacgcagcagaccgccgaugcccauacucgggagugcagaucagcgcagcaaugcuacuaagcgacgaaguagaaguagagcacauacuaccauucagcaaaacgcuagacgacagccuuaacaaucggacagucgccaugaggcaagcaaacaggaucaaacgaaaccgaacccccugggacgccagggccgaguucgaagcacaaggauggagcuaugaggacauacuacaacgcgccgaacggaugccacuaagaaaaagauaccgguucgcacccgacggcuacgaaagguggcuaggagacgacaaggacuuccuggcccgagcccugaacgacacccgguaccucucgcgaguagcggcagaguaccucaggcuuguaugcccaggaacgagaguaauucccggacaacuaacugcccuacucagagggaaauucggauuaaacgacgugcuagggcuagacggagagaaaaaucgaaaugaccaccgacaccacgccguugacgccugcgucauagguguaacugaccaagggcuuaugcaaagauucgccaccgcaagcgcccaagcacgcggagacgggcucacacgccuagucgacgguaugcccaugccauggccgaccuacagagaccacguagaacgcgccguaaggcacaucugggucagccaccgcccggaccacggguucgaaggcgcaaugauggaagaaacgagcuacggaauacgaaaagacggaucaauaaaacaacgaagaaaagccgaugggagugcgggacgagaaauaagcaacuuaauaagaauccaugaggcaacccaaccauuaaggcacggagugagcgcggacgggcagccccuggcauacaaaggcuacgugggaggcagcaacuacugcauagaaaucacaguaaaugacaaggggaaaugggagggagaagucauaagcacauuccgagcguacgguguagucagagccggcggaaugggccgacuaagaaacccacacgaaggacaaaacggccgcaaguuaauaaugagacucguaaucggcgacagcguuagacuagaaguagacggagcagaacgcacaaugcgcaucgucaagauaucaggcaguaacggccaaaucuucauggcaccaauacacgaggcgaacguggaugcacgcaacacagacaaacaagacgcauucacauacacaagcaaauacgccggcucacuacaaaaagcgaaaacacgccggguaaccaucucaccgauaggagaagucagagauccgggauucaaaggauga

SEQ ID NO: 6083 - RNA, 3090 nt, Artificial Sequence
  Cas9 variant
augaaauaccgccuagcccuagaccuaggcaguaccagcuuagguugggccaucguacaacugaacgcaaaagacgaacccugcgcaaucguccgugcaggaguaagaaucuuuccagacggccgaaacccuaaagacggcagcagccuagccguaacaaggcgcaacgcaagagccaugcgaagaagaagagaccggcugcuaaaaaggaaagcacgaaugcaaagacucuuaaucgaacacgaccuguuccccgcagacgaagcagcaagaaaagcccuugaaacauuaaaccccuaugagcucagggcgaaaggacuagacgcagcucuaacaccagcugaauuugcgagagcccucuuccaccuuaaccaacgucgaggauucaaaucaaaccgacgaacugaccgcaaggacaacgacaguggugcacuaaaagcagcaauaggcggacuuagagcacaacuagacacagccggggcagauggucgcgcgcgaaccguaggcgaacugcuauggaggcgaaugagcgaccccaacguucucacaguacgcgcacgguaccgcgaacaaaggaucaccaaggacgacggcaaaacccgcguggacaagucauacgaucucuacguggacagagcaaugguagaagcggaguucgacgcauuaugggcaaaacaggcggaacucucgcccacacaauucggcgaagcagcaagagcaacacuaaaagacugucugcuucaccaacgaaaccugcgcccagucaggccggggagaugcacacucgagccagaugaaccgcgagccccacucgcacuacccagucagcaaagauuucgaauccuacaggaagucaaccaucuaagacuccuaggaggacgacuuuuagaagaaagccuaucggucgaacaacgagacaaacugguggccgcauuagaagacggcuccaagucauucaaaacagcuauaccgaaacuacugggccucccaggaaccguacaauucaaccucgcggacgccaaaagaaccgaacucaaaggaaacgcaacaucaaugcugcugggaaagaaggacuucuucggcccggccuggcacggcuucagcgaagcacgacaagacgaaaucguaaugcgaauacaagaagaagaaagcgaagcccgccucguagacuggcuggcaacaucaaccgguguagacgaggcucacgcccuaaaaaucgccaacgccgcccucccggaaggcuacggaucccugagcgcaaaagcacuagccaaaauccuccccgcaaugagagccgaagugauuacguacgacaaagcgguccuagcggcaggcuacgaccaccacagccacaucucacacgccgccuccacaggcgaaauacugcccgaacuccccuauuauggcgaauaccuccaaaggcacgugggcuucggcacgggagaacucaacgacacaccagaaaagcgauucggccgcaucgcaaaccccaccguccacauaggacuaaaccaagugcgcguugucguaaacgcgcucauaaaaagauacggccaccccaccgaagucauagucgagguggcucgcgaccucaagcagucacaagaccagagaagagagacccaagaacagcaggccaaaaaccagaaaagaaacgaaaggcugcgcaaggaugccgcugcaauccucggaauagcugacgaacgaguacgacuagccgacauccaaaagcuaauccugugggaggaauuaucauucgacauagcugaccgaagaugcccauacagcggaguucaacuaagcgccgcuauggucuuaucagagcaaguggaaaucgaacacauccugccauuuucaaugacgcucgacgacagccuaaacaauaaaacagucgcaaugaggcuagucaaccggcugaaaggcaaccgcacaccgugggacgcccgcgaagccuucgcaggacaaggaugggacuaugacggcauuuuaaugcgcgcagagcgaaugccaagagcaaaaagacaacgauucgcuccagauggacuagaaaaauggcuuaaagaagacaaagacuuccucgcaagagcacuaaaugacacccgacaucucucgagaguugcccgagaauacuuaucccuaguaugcccagccucuacaaggguaaucccaggacaaaugacagccaugcuccgagcaaaguucggacucaacgacauacuaggauugaacggugagaaaaacagaaacgaccacagacaccacgcagucgacgcaugcgucgucgcgguaacagaccaagggcugcuacaaagguucgcccaagcauccgcugacgcgagggggaaaggccuggaccgacucgucgaaaccaugccggacccaugggacucguaccgagagcacguccagagagccgucaacagcaucugggucucccacaagcccgaccauggauucgaaggcgcaaugcacgaggacaccacguacagaccuccccaccuagacccgaagaacauguggcgcacaagaggcauaggcggugggaagcccaacgagaaagaagcagacagcaaggcaauggucggauucacugggccggaacaccuacaacgccaccaucgagacaaagccggccaacaacuaccauacaaaggauaugucgcguccccaaaauucuguauggacauaguaagaaacgacaaaggccgaugggaaggggaaguaguaucaaccuucgaagccuacagacuggugagcgaguucggccgagacgccgcacucgcgcacauacaaagcaaaagccgcucgaucuccggaaagccccucguaaugagacuccaaggaggcgacauggucagauuugacgacgaugaaggacgcccaguagucuugcgaguaguaaacaugacgggcaacggacaaauauucuucgcaccccacaacgaagcgaacggcgaugcaagaaaccgugacaagcaagaccaauucguauacuuaaguaaauacgcgggcagucuacagaaagcccgaggucgacgagucacagugagccccgccggggaacugcgggacccaggauuuaaagaauga

SEQ ID NO: 6084 - RNA, 3090 nt, Artificial Sequence
  Cas9 variant
augcgaucacuaagauauagacucgcgcuggaccugggaucaacaagccugggaugggcucuauuccggcuagacgccugcaacagaccaacagccgugaucaaagcaggcguaagaauauucucagauggccgaaacccgaaagaugggagcagcuuagcugugacuaggagagcagcacgagccaugaggagaagaagggaccgacuacugaagagaaaaacacgaaugcaagccaagcuaguagagcacggauucuucccagcggacgcaggcaagagaaaagcacuggaacagcucaacccauacgcacuaagggcgaaaggacuccaagaagcacuccugcccggagaguucgcaagggcccucuuccacauaaaccaaaggcgaggguuuaagucaaaccgaaagacggacaagaaagacaacgacagcggcgcgcucaagaaagcaauaggacaacugcggcaacaaauggcagaacaaggaagccgaacagugggggaauaucuauggacccgccugcaacaagggcaaggaguacgggcucgcuaccgagaaaagccguacacaacggaagaagggaaaaagcgaauugacaagucauacgauuuguacaucgacagggcaaugauugagcaagaauuugacgcgcuaugggcggcccaggccgcguucaacccaacacuauuccacgaggcagcgcgagcagaccuaaaagacacucugcuccaccaaagaccccugcgacccguaaagccaggacgaugcacacuccuaccggaagaggaaagagcgccucuagcgcuuccgagcacacaaagauuccggauacaccaagaaguaaaucaucugcgccuccuagacgaaaaccuaagggaaguggcacuaaccuuggcccagcgagacgcaguaguaacagcccuggaaaccaaagcgaaacugagcuucgaacagauacggaaacuacugaaacuaucagggucgguccaauucaaccuagaggacgcgaagaggacggagcuaaaaggcaacgccacgagcgcggcgcuagcaaggaaagaacuauucggagcagcauggagcggguucgacgaagcacuccaggacgagauaguguggcagcuagugacagaagagggggaaggcgcgcuaaucgccugguuacaaacgcacaccggaguugacgaagccagagcccaggcgauaguagauguaagccucccagaaggcuacggaaaccugagccgaaaagcacucgcacgcaucguccccgcacuacgagcagccgugauaacguacgacaaagcaguacaagccgccggcuuugaccaccacucacaguuaggauucgaauacgacgcgagcgaaguagaagaccuaguacaccccgagacgggggagauacgaagcgucuuuaaacagcucccauauuacggaaaagcccuacaacgacacguagcauucggaagcggcaagcccgaagacccagacgagaaaagguacggaaaaauugccaacccgaccguacacaucgggcuaaaucagguacgaauggucgugaacgcgcuuauaagaagauacggacgaccaacagaagucgucaucgagcuagcccgcgaccucaagcagucacgcgagcaaaagguugaggcacagcgacggcaagccgacaaccaaagacgaaacgcuaggauaaggcgcagcauagccgaaguacucggcaucggcgaagaacgaguacggggaucagacauccaaaaauggauaugcugggaagaguugagcuucgacgcggccgaucgcagaugcccguacuccggaguacagauaagcgcagccaugcuccuaagugacgaaguagaggucgaacacauuuuaccauucagcaaaacgcucgaugacagccuaaacaauaggacgguagcgaugcggcaagcaaacaggauuaaaagaaacagaacgccaugggacgccagagccgaguucgaagcacaaggcuggucauacgaagacauccuacaaagagcggaaagaaugccacuuaggaaacgauauagguucgcgccggacggauacgaaaggugguugggcgacgacaaggacuucuuagcucgagcacucaacgacacccgcuaucuaucaagaguagccgcagaguaucuacgccuagugugcccgggaacaagagugauacccggacaacugaccgcacugcugaggggaaaauucggacuuaacgacgugcugggccuggauggcgagaaaaacagaaaugaccaccgccaccacgccgucgacgcaugcguaauaggagucaccgaccaaggccuaaugcaaagguucgcaacagcgagcgcacaagcgcgcggagacggacuaacgcgccuaguagacggaaugcccaugccguggccaacguaccgcgaccacgucgaaagagcgguacggcacauuuggguaagccacagaccagaucacggauuugaaggcgcaaugauggaagaaacaagcuacgggauucgcaaagaugggagcaucaaacagcgaaggaaggcagacggcagcgccggucgggaaauaagcaaccuaauucgcauucacgaagcgacgcaaccccucagacacggagugucagccgacggccaaccacucgcauauaagggauacgugggaggaagcaacuauugcauagaaauaacaguaaacgacaaaggcaaaugggaaggagaagucauaaguacguuccgagccuacggcaucgugcgggcgggaggcaugggccggcuucgaaacccgcacgaagggcagaacggacggaaacuaaucaugagacucgugauaggagacuccgugagacuagaggucgacggagcagaacggacaaugcgcauagucaaaauaucgggcuccaacggacagauauuuauggcaccuauccacgaggcaaaugucgacgcaaggaacaccgacaaacaagacgcguucacguacaccaguaaguacgccggaucacugcaaaaagcgaaaacgagaagagugacgaucagccccauaggcgaggucagagauccgggcuucaagggauga

SEQ ID NO: 6085 - RNA, 3096 nt, Artificial Sequence
  Cas9 variant
augccagcaauauauagacuggcacuagacuuagggucaacaagccuuggcugggcgguacuacgacuagaacccgccgcccuagaaccaauagcaauaaucaaagcaggggucagaauauucagcgacggacguaacccgaaggacggagcaaguuuggcaguaaccaggagagcggcacgagccaugcgaaggagacgggacagacuccugaaaaggaaagcaagaaugcaagacaaacucgugaaacacggcuucuuccccagcgacauggacgaacgcaaggcgcuggagcgacucgaccccuacgcucuacgagcaaagggacucagggaagcacuuacacccggggaauuugcaagggcccucuuccacaucaaccaaagacgaggauucaaaucaaacagaaagacggauaagaaagacaacgacucaggagcgcucaagaaagcaauaucgcaccuacgacagcaaauggaagcuggcggacacaggaccgugggagaccaccucuggucacgucuacaacagggacuaggagugcgagcacgcuaccgcgaaaccccauucacgaacgacgaaggaaagaagcgaauagacaaaucauacgaccuauacauagacagggcaaugauagaacaggaauuugacgcauugugggcggcgcaagcagccuucaacccagcacucuuccacgaaguggcacgggcugaccucaaggacacacuccuccaccaacggagacuaagaccaguaaaaccgggccgguguacccuacuaccggaggaagaaagagcucccuuggcgcuccccucaacacaaagauuuagaaucuaccaagagguaaaucaucugcgccuacugggugaagaucuccgagaaguugcacuaacccuagcgcagagggacgcagucgccaacgcacuagaaucgaaagcgcgccuaacauucgaacaaauacgaaaacuacucaagcucuccggaucagugcaguucaaccucgaagacgcaaaaagaaccgaacucaaaggcaacgcaacaagcgcagcccuggcacgaaaagaacucuucggagcggcauggggcggguucggcgaggcacuacaagacgaaauaguauggcaauuaguaacggaagaaggcgaaggcgcguugauagccuggcugcaagcgcacacgggaguagacgaagcccgagcucaggccauagcagacgcaagccuacccgagggcuacggaagccuaagcagaaaagcgcuggcccgaaucguaccagcacuaagagcaggcguagugacauacgauaaagccguccaagccgcaggauucgaucaccacucucagcuuggguucgaauaugacgcgggcgaaguugaggacuggguccaccccgacacgggggaaauucggccagucuucaaacaacuccccuacuauggcaaaccacugcaacgccacguagcauucgggagcggaaaaccagaagacccggacgagcgcagauacggcaaaauagccaacccgacaguccacaucggccugaaccaaguacggacggucgugaacgcacucauaagacgauacggcagaccgaccgaggucguaauagaacuagcaagagaccucaaacaauccagagaacagaaaguggaggcucaacgaaagcaagcggaaaaccaacggcgaaacgcccgaauccgcaaaucaaucgcagaaguacuagguaucggggaagaacaagugaggggcgccgacauccagaaauggaucugcugggaagaacugagcuucgacguggccgaaagacguugccccuacucagggguacaaauauccgcacgaaugcuccugagcgacgagguggaaguagaacacauacuaccauucagcaaaacccuagacgacagucugaacaaccgaacaguggcgaugagacaagcaaaccgaaucaaaagaaacagaacgccguggaccgcacgagacgacuucgaagcgcaaggauggucauacgaaggaauacuccaaagagcagaacgaaugccacucagaaaaagauauagguucgcgcccgaugguuacgaaagauggcugggcgacgacaaagacuuccuggcacgggcacuaaacgacacccgauaccucagccgcgucgcagcggaguaccuccggcucgugugcccagggaguggcacccgaguaaucccgggccagaugacggccagacuucgcggaaaauucggucucaauggaguacucggacccgacggagagaaaaacagaaaugaucauagacaccacgcggucgacgcaugugugauaggaguuacggaucagggacuaaugcaaagauucgccaaugcaagcgcccaagcgagagaagacggccuaacgagauuagucgacgacaugccuaggccauggccaacguacagagcacacgucgaaagggcagugaggcacaucuggguaagccaucggccagaccacggauucgaaggggccaugauggaagagacgagcuacggcaucggaaaggacggaagcauaaaacagagaagaaaagccgacgggucaccgggcagggaaauaacaaacuuaaucagaauacacgaggccacccaaccucaaagacacggcgcaggacccgacgggcaaccucucccauacaaaggauacguaggagggagcaacuacugcaucgagauuacaagaaacgacaaaggcaagugggagggagaagucauaagcaccuuccgcgccuacggcauaguaaggaccagcggccuagggcaguuacgacacccgagggucggccaaaauggacgcgaacuggugaugcgacuggucaucggcgacucaguccgauuagaaauagaugguauagaaagaacgaugaggauaguaaaaauaucaggaucaaacggacagauauucauggcaccaauccacgaagcaaacguagacgcgcgcaacagcgacaaacaggacgcauucgcauauacaaguaaauacgcgggaucacuacagaaaacgaaagcgagauuugucacgaucucgccuaucggagaaguaagggaccuaggauucaagggcuga

SEQ ID NO: 6086 - RNA, 3099 nt, Artificial Sequence
  Cas9 variant
augaagaaacgaauacuggggcuggacaucggaaucgccagcgugggcugggcccuuguagaauuugacgacgaguuccaagacaauaaaaagaaaggcaccauaaucaaaagcggaguaagaauauucacaagagcagaaacgccaaaagaaagagagucacuggcaaaacccagacgcgaggcgcggagccagagaagacgcauccgcaggcgcguggagcgccucaacucaauacgcgagcuuuucgugaaaaacggaguaguagaggaauggagcguaagcaaaaagaacccgaauaacaucuacauaacccuaaaucagaucaaaacacccuggcaacuccgcauggaaagccuggacagaaagcugacgaacgagcaauucgcgguaguacuaacacaccucgccaaacacagaggguacaaaagccugcgcaaagacgauaaagcaggcaaggugcucgaagccaucagccaaaacaagaaaaggcuaaacgacagcgacuacaggacgcuaggcgaaauguucugcaaaaacgagagcuauaaagaacacaaaagaaacaaaggaggggaguacaucaacagcguagcacgcgaacuaaucgaagaagaaguagagaaaaucuucguaaagcaaagggaaaaagggaacaacuucgcggacgugaacacagaacgcgaguaccugaaaaucgccuucagccaaaaaccagccgggagcauaagcaaaaugguaggauucugcaccuucgagaacggugaaaagcgggcaccacgcgauucuuacagcgcggagcuauucaaaguccuaugcacaaucaacaacaccaccuucacagacaugaagacgggagaaauacggagcuucaguaaggaagaaaucggcaaaacacuagagaccgucaaaaaugugaaagacguaaaguacgccaaaauccgaaaagaccuggggcuggaggacucagucaaguucagcggcguggacuaccgagaaaacgcaaaaucaaaaggggaaggcgaaauuuucguaagcaugaaaacguaccacgagaucaaauccaaaaucgagaaacuaagcaaggaaaagugggacaaccucaaggggaacacggagcuccuagacuccauaguaaacauaaucgcaaaccuaaaggacgacgagaguaucaagaaagaguuccagaaacuaaaaauagacgaggacaucauagacguacuccuaaacuucgaauuuaagaaauuuauaaaccucuccuucaaagcgcuccgaaaaauaauaccguuccaguuccagggccaaaaauacauaacggcaagcacguccgcaggguacucccuaaaacaagagggaaucaaaaacaaacugguaccgcccgcgaaagaaaacauuaacguagccguaguagcgcgagccuucgcacagacgagaaaagugauaaacgccgucauacgaaaauacggucaguuugaucaaauaaacaucgaacuagccaccgagcucaaaaauucgaaauucgaucgaagcaaaauagaggaaggacaaaagaaguuccagagccagaaggacaaaaucuuuaaggagguccaggaacuacgaggaggcaugacccccagcagcagucuccuucugaaauacagacuguggcgcgagcaagacgagagaugcguauacagcggcaggaaaaucagcuucgaggaccuacuagacaccggcuuccuagacauagaccacaucauacccuacagcaagagcauggacgacagcuucaacaacaaaguacuaugcuuagcggaggagaacagaaacaagaaaaaugauauacccuucaacuacuaccaacgaaucgaccgggacuggaaccuccugaucaguauaauaaccagcaugaaaaacaugaagauagccaagaaaagcagacuacugaaacaggaacuaagugacaucgaggguuucaucgaacgaaacaucaacgacacacgcuacgccacgcgauacaucaaagacuuccucgagaacaaucuagaguucaaagaaaacgaguucaucaaagugaaaguccaggccagaagcggaggccugacgagcgugcugaguuacaauuggggcaugagcaaggacagggaagaaucauacuuccaccacgcgaaagacgcgauaauaguagcuugcagcacgcaaggaaugguacaguauauaucgaaaauaucacagcaauacgaaaacgacaaagacaaaaugaagaaaauaaaagacaaaacagagaacugcauaccgaaaccgugggacucguucagagcggacgucgaggaaagcaucgaaggaauauucguguccuucgccccgcgacacaagguaacaggcagcgcacacaaagaaaccauauacagcaagaagcaccuagaaaaagaaagauacgucacggugaaaaagagucuagacaaaauaaagcuaagcgaccuagaaaacauaccgugcaacgagaacuguggcauaaucagaguacuaaaagagcgccuugagaaguucaaaaacgacagccuaaaagcguucgcagacccgguccacaugcccacgaaaugcccgaacaagaaaggcccggugauccggagcguaaaaaucaaagaaagcaacaaaaccggcauagaaguacguaagggccuggccgagcgcggggaaauggucagagucgacguauucauaaaagacaaaaaguacuacuuggucccuaucuacguauccgacuuuaaaaacaaagaccuacccaacaaggccaucgccgcgcuaaagcucgaaaacgaauggaucaugaucgauaagacauacagcuucaaguucucacuauucaaggacgaccucauaaaaaucaagaagaagaaggaagagauauucggauacuucggugggguacacaggagcacgggcacaaucaagaucaaaucccggcacaagcccaaagagauagacgagggcaucggcucccgcugucuccuggacuuccgaaaguuccaagucgacguccuaggcaacuacacagaagucaagcacgagaaaagaaugccggcauauauaaccaggaaagacaagaaacauuga

SEQ ID NO: 6087 - RNA, 3105 nt, Artificial Sequence
  Cas9 variant
augaaaauacugggauucgacauaggcaucgcaagcaucggcugggccuucguagaaaacggagaacuccgggacugcggcguccggaucuucaccaaggcggagaacccaaaaacaggagacucccucgcaaugccccgcagagaagccagaucagugaggcggcgcuuggcccgcagaaaaggccgccuagaaacacucaaaagacuacuagccaaggaaugggaccucugcuacgaagacuacaucgccgcagacggagaacugcccaaagccuucaugggcaaaaaccuaacaaaccccuacguacuccgauacgaggcacuccaacgccuccucggaaaggaagaacuagcacgggugauacugcacauagcuaaacaccgcggauacgguaacaagaacgcaaaaaucaccaaauccgaggaauccaagcgcgaacaagggaagauacuaagcgcacuggcgaccaacgcgagcguaaucgcgagguaccgcaccgucggagaauacuucuacaaagaauuuugcgaaguaaucaaaaauccacaaggccuaaacaccaacgagaacugcacccaaccaaaagucagaguccucaagccuauacgcaacaaaggaggagaauacacaaacugcauccuacaagaggaccugcaacgcgagcugaggugcaucuucgagcaccagaaaggguucggguuccccauaacacaggaguuccaagacaaaauauugaaaaucgcauuuuaccaacgaucacucaaagauuucucccaccucgucggcaagugcacauuuuacccagacgaaccacgggccccaaaauucucccucucagcaauagaguucauaacgaaagcuaaaacaaucaaccuccucgucggcaucgucaaggaauccggcgaagucugggacaaagaacaauggcgagaacgacuggacucggucuucagcgccgugugugaacgcggcaaucuaaccuucgcacagaugcgcaaaauacucaaaaucgacgaacggauccaguucaaagaaguagacuacaccgcgaaaaacccggagaacaagaaauucguggaguucaaaaaccugaaaaaguucugcgaaauauuaggcgccauaguaggcgaucgggcacuggccgacagcaucgcccgcgacaugacccugaucaaggacgaagaggaacuagcacaaaaacuccgcggauacgguaaauuuagccaggagcagaucacccaacuaggggcucuaaacuucagccaccacaucaaccuaucccucaaggcccuuucugagauccuacccuucaugcgcgaaggcaugcgcuacgacgaggcaugccaggaagccaaacuacaggcaaaacacaacgacaagaaaucaaaauuccugccacccuucugcggcagcauauacgcagacgagcuaacaaaucccguaguccaccgggccauagcagaauaccgcaaaauccuaaacgcacugaucgcaaaauauggaaacguacacaaaauccacaucgaauuaacaagagacgucggcaaaaacuuccaggaaagggagaaauacaagaaagaaaucgagucaaacuacaaggcccggguacaggccaugcaagaaugcgaaaaacuuggacucacacuuuccgagggaaauauucugaaacuaagacuauucauggagcagaacgaacgcugcgucuacuccggacgaaaaaucacgcuagcaaaccugaaggaacaaggagcucuugaaaucgaccacauacuacccuacucacggucaucagacgacagcuacaugaacaaaguccuggucuucacaaacgaaaaccaaaauaaggguaacaagaccccauaugaagccuucggaggagacagccaaaaauggggagaaaucgaaagccucgcccuccgcagcggcuaccccaaaaagaaagccaagcgcauccuggauaagggauucggcgaucgcgaagccggauucaagagccgaaacauaguagacagcggguacaucgcccgacucauagcaaacuauaccaaagaguaccugaaauuccuaccccuagauucccacgaaaacaccgcacucaucgcaggagaaaaggacaguaaaauccacgucgaagcaguaaaaggcaugcucaccgccaccaugagacauuucuggggacucggcagcaaaaaccgcuacgaacacacgcaccacgccauagacgcaaucaucaucgcuuacaucaacgcagccaugauccagcgauucagccaauuccgccaaaaccaggaaagccugaaggccagauucuacgcaaaagagcuagccaaggaggaguucaaaacccaaagagcauucuucgaacccuucuccggauuccgcgaacaagugcuugcaaaggucggccaaauauucgucucgagacccccgcgcaaacgcgcuaggggcgcccuacacgaagagacauucuacucaaucgacgacaagaaacucagcgagaccuacggaggcaaagagggcguacagcgcgcacuaagccuuggcaaaauacgacaaaucgggacaaaaauugucgccaacggaccaaugguccgggucgacauauucaagcacaaaaagagcgggagauucuacgcagugccaauuuauacaauggacuucgcccuaggcauccucccaaacaaagcaguggucagcgggaaagacaacgaucgcaucaucaaagacuggcuagagauggacucaaacuacgaauuuugcuucagccuauucaaagacgaugucaucgaaguccagaagaaagacauggaaaaaccggaacuugcauacuuugucagccuaaacacaucaagcgcaaguauagcccuggucaaacacgacaacaaauucgagacacucaccucgaaccaagcuaaacuguuuuccaaugccaaagaaaacaacguaaucgcagaaagucuugggauacaaaaccucaagguauucaagaaguacaaagucagcccacuaggcgaaaucaaagaagcaaaauacgagccacgccaaccaaucgcccucaagacgagcccaaagaaacaccgcaaacagaacaaugcccaauga

SEQ ID NO: 6088 - RNA, 3108 nt, Artificial Sequence
  Cas9 variant
augcgccgccucgggcucgaccucggaaccaacucuauaggauggugccugcuugauuuaggagacgacggcgaaccggucucaaucuuccgcacaggcgcacgaauuuucucagacgggcgcgacccgaagucccuaggaagccugaaagcaacccggcgagaagcacgacucacaagacgccgacgggaccgcuucauccagcggcaaaagaaccucauaaacgcacucgucaaguacggccuaaugcccgcggacgaaauccaacgacaggcgcucgccuacaaagaccccuacccaauaagaaagaaagcccucgaugaagccaucgacccguacgaaaugggcagagccaucuuccacauaaaccaacgaagaggcuucaaaucaaacagaaaaucagcugacaacgaagccggugucgucaaacaaagcauagcagaucuagagaugaaacucggcgaagcaggcgcacgcacaauaggagaguuccucgcugacagacaggccaccaacgacacaguccgcgcgcgccgucuaagcgguaccaacgcccuguacgaauuuuacccggaccgguacaugcuagaacaggaguucgacaccuuaugggccaaacaagcagccuucaacccaucgcuauacauugaagccgcgcgcgaacgucuaaaagaaauugucuucuuucaacggaaacuuaaaccccaggaagucgggcgaugcaucuuucucuccgacgaagaccgcauauccaaagcgcucccaucauuccaacgcuuccggaucuaccaggaacuauccaaccucgccuggauugaccaugacggggucgcccaccgcaucaccgcaucacucgcguuacgagaccaccuauucgacgaacuggaacacaaaaagaaacucaccuucaaagccaugagagcaauacuuagaaaacaaggcguaguagacuacccagucggcuucaaccuagaguccgacaacagagaccaucuaauagggaaccugaccucauguauaaugagagacgcaaagaaaaugauuggauccgcaugggauagacuagacgaagaagaacaagacucauucauacugaugcugcaagacgaucaaaaaggcgaugacgaggucagaucaauacuaacccaacaauacggccuaagugacgacgucgccgaggauugccuugacguaaggcucccggacggccacggaucccuaagcaagaaagccauagacagaauacuacccguccuaagagaccaaggccucaucuacuacgacgccgucaaagaagcuggacucggugaggcaaaccucuacgacccauacgcagcccucagcgauaaacuggacuacuacgggaaagcacuggcaggccacgucaugggcgcaucaggcaaauucgaagacagcgacgaaaaacgcuacggcaccauaucgaaucccacgguccacaucgcccugaaccaggucagagcaguagucaacgagcucauccggcuccacggcaaaccugacgaaguaguaauagaaauuggcagggaccuccccaugggcgccgacggaaaacgcgaacuagaaagguuccaaaaagagggcagagccaagaacgaacgugcucgcgacgaguuaaagaaacucggacacaucgacucccgcgagagccgccagaaauuccaauuaugggaacaacucgcuaaagagccaguagaccgaugcugccccuucaccggaaaaaugaugagcauuagcgaccuguucuccgauaaagucgagauagaacaucugcuccccuucagccucacgcucgacgacagcauggccaacaaaacagucugcuuccgacaagccaauagagacaagggaaaucgagcaccauucgacgcauucggaaauuccccagcaggauacgacuggcaagaaauucucgggcgaucccaaaaccugcccuaugccaaaagauggagauuccugccugacgcaaugaaacgauucgaggccgacggaggcuuccuagaaaggcaacuuaacgacaccagauacauaagucgcuacaccaccgaauacaucuccacaaucauccccaagaacaagaucuggguagucacgggaagacuaaccucacuccuccgcggauucugggggcuaaauagcauacuccgggggcacaacacugacgacggcacuccggcaaagaaaagccgcgacgaccaccgacaucacgccaucgacgcaaucgucgucgggaugacuagcagagggcuucuacaaaaagucucaaaagcagccaggcgcagcgaagacuuagaccuaacacgccuauucgaaggcagaauagacccaugggacggauuccgcgacgaaguaaagaaacacaucgacgcaauuaucgucagccaccgcccuagaaagaaaucacaaggagcacuccacaacgacaccgccuacggcauagucgagcacgcagagaacggcgcaagcaccgucgugcaucgaguccccaucacuagccugggaaaacagucggacaucgaaaaagucagagacccacucaucaaaucagcacuccucaacgagacagccggacucucagggaaauccuucgaaaacgccguacaaaaauggugcgccgacaacagcaucaagagucuccgaaucguagagaccguaucaaucauaccuauaaccgacaaagaaggagucgcguacaaaggauacaagggagacgggaacgcuuacauggacauauaccaggaccccaccuccuccaaauggaaaggcgaaaucgucucacgauucgacgcaaaccaaaagggcuucauaccuagcuggcaaucacaauuccccacagccaggcugauuaugagacuccggaucaacgaccuacuaaaacugcaagacggcgagaucgaggagauauaccgcguccaacgccucuccggcucaaaaaucuugauggccccacacaccgaagcgaacgucgacgcccgggacagagacaaaaacgacacauucaaacuaacguccaaaagcccugggaaauuacaauccgccagugccaggaaaguacauaucagcccaacaggccuaauacgggaaggauga

SEQ ID NO: 6089 - RNA, 3108 nt, Artificial Sequence
  Cas9 variant
auggagcagcuaaacuacauacucggacuggacauaggaauagcaagcgugggaugggccgucgucgaaaucgaccacaacgaagaccccauacggcuuauagacgucggggugcgcacguucaacaaagcggaagucgcaaaaacgggagagucccugagccucauacgccgucucgcacgaggcucccgcagacucguacgaagaaagaaaaugcggcuccucacagccaaacgucuacucaaaucagagggaauccucagcgaucuagacuucaacaagggcgccauacugaaccucccaaacaacugcugggaguuacgcguuaagggccucgacaagaaacuaagugacaaagaaugggccgccguauuacuccacauaauaaaacauagaggguaucugagccagcgaaaacacgaccgcaaaacagacgacaaagaacugggagcacuccuuucgggcguaucuaagaaccauagccuuuuagaagagggcgaauuucgcacagccgcagagcucgccaucaacguauucugcaacaguaagggccacaucaggaaccaauggggcgauuacucacacaccuucucacgacuggaccuccaaaaagaaauaaaacaacuauucguaagccagagagaacugggaaaccccuacacaucauccuccuucgaagagaacauaaucagccuccucaugaaacaaaaagaagccaucuccgggaaugacauucuaaaaaugcucggaaaaugcaccuacgagaaaaacgaauauaaagcggcgaagaacacguacagcgcugaaagguuuguaugguuaaccaaacucaacaaccuccguaucgucgacgacggagucgaacgagcacuaaacuccagcgagcgaaaacuccucaucgaugagccuuacaagaaagccaagcucacguacgcccaaguccgaaagauacucgaacuaccagacucagcgguuuucaagggggugcguuacuucgcugacaaugccgagucaucaacccuaauggagaugaaauucuggcacuccauccggaaagcacucgaaagcaacaaccuaaaagacgaguggcugguccuaaaaacaaaaccagagcuacucgacgaaaucggcaccggcuucagcaucuacaaaacagacgacgauaucacaagcuaccucagcaacaaacuggacaagaaaguacucgacauacugcucgucgaggucagcuuugacaaguucauagagcuaagccuaaaaugccuccgaaagaucauaccccucauggaaaaaggauaccgguacgacgaagcauacaaguacauuuacggcgaaguaaacaucgaguacaaccugaacgacaucaaaaacccggucguccucagaaguuucagccaaucccgaaaaguaauaaacgccgucauucgccuguacggguccccugcccgcauacauaucgaaacggcacgcgacauaggcaaauccuucaaggagcguaaagcgauagaaaaacaacaggaaaagaaucgccuagagaaaguacgcgccgcggaacacuucaagcagcuguuccccaacuacgucggggagccaaaggccaaggacauacucaaaguacgccucuacgaacaacagcaaggcaaaugccuauacagcggcaaaauacuagacauaaaacgacuaauggagcacggcuacgucgagauagaccacgcacuaccauucucacgcacaugggacgauucauucaacaacaaaguacugguccuagcgaacgaaaaccagaacaaaggaaauaaaacaccguacgaaugguuuaacgggaaagacaacuccgauuccuggaagagguuccuggcgcuagucaacaacucgggcuucuccgcaguaaagaaacaacacauacugaugaaagaaauagacgaggagggauuuaaacaacgaaaccugaacgacacccgcuacauaacgagguuccuaugcaacuggguagaaaacaacaucccucuccucggcaaaggcgugaaacgcgucuucgcaccacaaggcaagaucaccgcccuacuacgaagcaacugggggauucgcaaaguaagagaggauaacgaccggcaucacgcgaucgacgcaaucgugguagcguguaccacggucagcauacaacaaagaauaaccaacuacgucaagaacagcgaaauaaaccguaaaauaaaacgacaaaacuacuugaaguucccggagccauggaaauucuuucgcgaagacauuuccauucgagucuucagcaacaacccaaucgaggaacuaaagcaacaacugagcgaccgaccagaagcaaaccaccaguucgucaccccacuauucguaagccgagccccagucaggaaaaugaccgggcaagggcacgaggacacgauccgcagcgcaaagcgcauauccgaaggaauaucagugcuacgagugccacucaccaagcucaacgacaaaagccucgaacugauggucaacagagaacgagagaaggagcuauacgacgcccugaaacaacggcuccucgaguucaaaaacgaccccgaaaaggccuucgcagaaccauucuacaagaagggaggacagcaaguaaaaacaguacggauagagcgcguccaaaagaauggcguccuggucaacaacaacacggggaucgccgacaacgggaacauaguccgcguagauguguuucuaaagaaaaagaaguacuuucuaguaccaaucuacagcuggcaaguagccaagggaauacugcccaacaaagcaaucguagcccacaaaaacgaaugcgacugggcagacauggacggcuccgcccaauuccuauucucgcuguacaccaacgaccugauagaaguaguucucaaggacagcaccauccuaggauacuucagcucaaucgauagggcgaccgcagccaucauaauaaaggagccagacauggaaaaaucgaaaggcaaagaaggcauccacagagugggcguaaagacagcacggucguucauaaaauacaacguagacguacugggcaaaaacauaagccgaugccgcaaagcgaaacggcucccaguacgcuga

SEQ ID NO: 6090 - RNA, 3108 nt, Artificial Sequence
  Cas9 variant
augcuacgaaaaaugcauuaccguuuagcacuagaccugggcucgacaucccugggcugggcuaugauccgccuaaacgccggaaacgaacccugcgcagucauaaaggcgggaguccgaauauucuccaacgggcguaaccccaaagacggcagcagcuuagccgugacucgacgcgaggcgcgcgccaugcgacgcaggagggaccgauugcuaaaacgcaaagccagaaugauacaaacacucauagaauauggcuucuucccugccaaagaggaccaaagaaaagcacuagaaauaaugaacccauucgcacugagagcaaaaggccucaacgaagcucuaacaccggccgaguucgcaagagcauuauuccacaucaaccaacgacgaggcuucaaaagcaacaggaagacagacaagaaagacaacgacagcggggcucucaaaacagcgauaaauaaacugcgcgaaacccuaaaaacagaaaauugucguaccguuggagaauggcugaacaaaagagacguggcaggccuaacaguccgcgcaagauaccaccaagacaagacgauaaaagaggauggcaaaucuaaaauaaacaaauacuacgaccuauacauagaccgagccaugauagagcacgaguucgacgaacuauggaagaaacaagcggaacuaaaccccacccucuuuacggaagcagcaagagcagaccuaaaagacgugcuccuacaccaacgcgcccuaaaaccaguaaaaccaggcagaugcaccuucaugcccgacgaggaacgagcaccacuagcccuuccaagcacccaacgcuuccgcauguaccaggaagucaacaaucuaagaauacuacgggacggacuaaaagaggaaucguugacccuaaaccaacgagacgaccucaucgcagcgcuggaagagaacaacaaacgcacauucacacaaaucaagaaacuacucggucuuggaggggucgucaaauucaacuucgaagaccccaaacgcgaagaacugaaaggcaacaccacaagcgccauucuuggcaaagacgaacauuucgguuccguuugguucaaauucgacgaagcaaaacaagacgcaaucguaaugcagcuauucaaagaagaaaacgaagcgaaauuacuacgcuggcuccaaaacgagaccgggaucgacgaaaaacgcgcggagaccaucgcaaacguggggcucccagaaggcuauggcagucucugcgcccuagcacuugcaaggauucugccagaacuaaggcgcgaugucgucccauacagugacgcagcgaaagccgcaggauuccaccacagcgacacgagcaacaaccaggaagugccagguuuaacauuccccauagagcuugucgucacggaaaccggcgagauaaaaaccaaacacauauuccacgaacuacccuacuacggcgaauacuuacaacggcacgugggguucgggagcggcaaaccagaagacuccgcggaaaagcgguacggaaaaaucgcgaacccaaccguacacauaggacugaaccaaguccgacucguagugaacacccuaaucaaacgcuacgggcacccaagcgaagucauuguagaaguagcaagagaccucaagcagagcaaagaccuacgcgacgaggaggggaaacgccaggcagaaaaucagaaaagaaacaaacggauacgcacagcuauagcaggaguacugcaaacaagugaagaaagaguccgacgagacgacaucgaaaagaugauacugugggaagaacugagcuucgacccagcagaccgacgcugccccuacucaggaguacaaaucuccgcggcgaugcuacuaucagacgaagucgaaaucgaacacauacuaccauucagucaaacacuggacgacagccugaacaacaaaacagucgccuuacgacaagcaaacagggugaagggaaaccgcaccccgugggaagcauucggcgcucaaagcacagcgggauucgacuacgccacaauacucgcccgagcagagcacaugcccaaaggaaaacgauaccgauucgcggaggacggauaccaaagauggcuuaaagacgacgccggguuccuaccaagagcacucaacgacaccagacauaugucaaagguagcacgggaguacaugucccucaucugccccaacacccgaguaauccccggacgaaugaccgcgaugcuucgaggaaaauucggccuaaacgacguccucggauuaaacggagagaagaaccguaacgaccacagacaccaugcagucgacgccugcguuauagcggucacggaccaaggacuacuacaacgcuucgcaaaagccucagccucggcccgcgaacagcaacugaacagauuaguggagaacaugcccuuacccugggagaguuaccgcgaacacgucgaaagagcgaucgacgcgauuuggguaagccacaagccggaccacucacacgaaggagcaaugcacaacgacacagcauacggacuccucggcgacgggaaaguguccauucacaaaauggucgagggaaaaagagaaaggaucgaagagagccucaaagugauagcauucaccaacgcaaaggcaaacgacagacacggacugcuagacaacggcgaaccucgcccauacaagggcuacaaaggagacagcaacuacugcaucgaaauaauccgcaacgagaaaggcaaaugggaaggugaagucaucuccacauucgacgcauaucagcuaguccgcgaacacgggguagcacgucuccgccauccuacacugucugucuccggaaagccccucgugaugagacuaaugaaagacgagaccauacguaugguaacgaacgaaaaaccaauaacagcccgaguaugcuggguacgcuccgacaccaggaucgcauuugccagcacaagcgaagcaaacguugacgcacgcgacagagacaaaaacgacucauucucguacauagugaaaacagcgucaguccuacaaaaacugcaagcgcgaagaaucucaauaucaccuaccggagagcucagagacccgggauucaaagaguga

SEQ ID NO: 6091 - RNA, 3108 nt, Artificial Sequence
  Cas9 variant
auggaacagcugaacuauauccucggauuggauauagggauagcaucagucggaugggcgguagucgaaaucgaccacaacgaagacccaauccgucucaucgacgugggaguccggaccuucaacaaagcagaagucgccaagacgggagaaucacugucccuaauaagacgacucgcccgggggagccggcggcucguucgacgcaagaaaaugagacugcugacagcaaaaagacuccucaaaagcgaggggauccucuccgaccuggacuucaacaagggcgcaauacugaaccuaccaaacaacuguugggagcugcgcguaaagggccuggacaagaaacuaagcgacaaagaaugggccgccguacuccuacacauuauaaaacaccgcggauaccuaucgcaacggaagcacgaccgcaagaccgacgacaaggaacugggcgcccuacucucgggagugagcaagaaccacucacugcucgaagagggagaguuccguaccgccgccgaacucgccaucaacguauuuugcaacagcaaaggacacauacgaaaccaguggggcgauuacagccacacauucucgcgacucgaccugcaaaaggaaaucaaacaacucuucgucucacagcgcgaacucggaaaccccuauacaaguagcagcuucgaagaaaauaucaucagccuccuuaugaagcaaaaagaagcaauaagcggaaacgacauacuaaagaugcucggcaaauguaccuacgagaaaaacgaauacaaggccgccaaaaauaccuacuccgcagaaagguucguauggcuaacaaagcugaacaaucugagaauagucgacgacggagucgaacgagcacucaacucaucggaaagaaagcugcucaucgacgagcccuacaagaaagcuaaacucacauacgcccaagucagaaaaauacucgaacuacccgacuccgcgguauuuaaaggcguucgcuacuucgcagacaacgccgaaucaaguacacuuauggaaaugaaauucuggcacuccaucagaaaagcccuggagagcaacaaccucaaggacgaguggcucguccucaaaaccaaaccggaguugcucgacgagauaggcaccggauucagcaucuacaaaaccgacgacgacauuaccucauaccuaucaaacaagcuagacaagaaggucuuagacauccuauuaguggaagucuccuucgacaaguuuauagagcuaucacuaaagugcuuacgaaagaucauaccccuaauggaaaaaggcuaucgauacgacgaggcguacaaguacauuuacggcgaagugaacauugaguacaaccuaaacgacaucaagaauccagucguccugagaucauucagccagagcagaaaaguaaucaacgccgugauccgacucuacggaucgcccgcacgcauacauauagagaccgcaagagacaucggcaagucauucaaagagcgcaaggccaucgaaaaacaacaagagaaaaaucgacuagaaaagguccgcgccgcagaacacuucaagcaacucuuccccaacuacgugggcgaaccgaaagccaaagacauucucaagguaagacuauaugagcaacaacagggcaagugccuuuacucgggcaagauucuagacaucaagcgcuuaauggaacacggcuacguggaaaucgaccacgcgcuccccuucagccgcacgugggacgacucauucaacaacaagguccuaguacucgccaaugagaaccaaaacaaaggaaauaaaacccccuaugaaugguucaaugggaaagacaacucagacucguggaaacgauuccucgcccucguaaauaacagcggauucuccgccgucaaaaagcaacacauccucaugaaggagaucgacgaagagggguucaaacaacgaaaccucaacgacacgagguacaucacccgcuuucugugcaacuggguagaaaacaacauaccucugcuuggcaaaggugucaaaagaguguucgcaccccaaggaaagauaaccgcacuacugcggagcaacuggggcauacgcaaaguacgagaagacaacgaccgacaccacgccauagacgcaaucguagucgccugcacaaccgucucgauacaacaaagaauuacaaacuacgugaagaacagcgaaaucaacagaaagauuaaacggcagaacuaccucaaguuccccgagcccuggaaauucuuccgagaggauauaagcaucagagucuucuccaacaacccaaucgaggaacucaagcaacaacucucggaucgaccagaagccaaccaccaguucgugacgccucuguucgucagccgagcgcccguacggaagaugacgggccaaggucacgaggacacgauccgcuccgccaagcgcaucuccgaaggcauaucgguccuccgugucccauuaacgaaacuaaacgacaaaucgcuagaacugauggucaaucgagagagagaaaaagaacucuaugacgcacucaaacaaagacuacuagaguucaaaaacgaccccgaaaaggccuucgcagaaccguuuuacaagaaaggaggacagcaagucaaaacaguccgaauagaaaggguacagaaaaacgguguccuagugaacaacaacaccggcaucgcagacaacgggaacauaguacgagucgacguauuccugaagaagaagaaauacuuccugguacccauuuacagcuggcaagucgccaaaggcauccuccccaacaaagcgaucguagcccacaaaaacgaaugcgacugggccgacauggacggcuccgcccaauuccucuuuagccuauacacaaacgaccucauagaagucguccucaaagauucaaccauccucggcuacuucuccucaaucgacagagccaccgcagcccuaauuaucaaagagcccgauauggagaaaucgaaaggcaaagagggaauccacagagucgguguaaaaacggcacgcagcuucauuaaauacaacguugacguacucggcaaaaacaucagcagaugucgcaaagccaaacgacugcccguccgcuga

SEQ ID NO: 6092 - RNA, 3111 nt, Artificial Sequence
  Cas9 variant
augagaaucuucggcuucgacaucgggaucacaucgaucgggugggccuacgucgagucuaacgaacuaaaggacugcggcguacgcauauucaccaaggcagaaaaccccaaaaacggcaaaucccucgcccuaccacgacgagaggcccgcggggcacgacgccgacuggccaggcgcaaggcccgcuugaacgcuaucaaacgacuacuaugcaaggaguucgggcucaacgucagugacuacuucgcaaacgacggggaacuaccaaaagcguacgaaacaacgaaggacacaaaaagcccauacgaacugcguagccuagcucucgaacaaaaacucgagccgaaagagcuagcacgcguaauacuccauaucgcaaaacaccgcggcuacggaaacaaacacgcgaaaacgggcagcgacaaggacuccggcaagguccucucagccauaaaggucaacgaaacagcgaugaaagacaaauaccaaagcgucggggaguaucucuacaaagaguucuaccagaaacuccgccucgaaagcgagaagaaaggcaacaauauaaccaaagaguucaaaaacguccgcaacaaaggagaaaacuacgaacauugcgucgcccaagaacagguccgugcugaacuggaacuaaucuucgcgaaacaaaaggacuucggcgcaacguucucagaaaacuucgaaucacaaauaaucgaaaccgcauucuaccaacgagaccucaagagcuuugaagauaaggucggcaagugcgucuucuacgaaaacgaaaacagggccccaaaagacucacucucagccauggaauuuguagcccucacgcgcauaauaaacacccugaaaaaccucgaggaaaaauccaaaaaccuagguaucggcgaggucuacgggaaggacaagauccaagaaauccucaaaauaguccucgacaaaggcgaaaugagcuacaagaaacuacgcgagauacuccacuuagacgaacacauucucuucgccaaagacucaaaacuggacuacacacagggagugcaagaggccgagaaagcaaaguucauugagcugaaaaaccucaaggcauucaagaaagccaugggcggcgacuucaguaacuucgcaagagaggaacuagacaagauagccaccgacaucacccugguaaaaagcaaagaaaaccuggccaaaaagcuccaaaacuacagugccuugucgaaagaacagguagaagcccucagcaaccuaaguuuugcaaaacacaucgaccucucucugaaagcgcucgaacaaauccuacccuucaugcgaggcgacaaaaccggcaagugccugcgauaugacgaggcaguaaagaaagccgaacuccaagaacaccgaaaacacaaacagaaaggcgaguuccuaaucccacuaaaagacuacgaaccguaccucgcgaaccccguagucgcaagggcgcucucagaguaccggaaaguacucaacgcccuacugcggaaauacggcaaaguccacaaaauacacuuggaguuuacccgcgaagcaaaacuuagcgcaaaggaacggcaaaaguacgaaaaagaacagaaagagcacuucgaagcuaaccaacgcgccauucagcaaugcgaaauccuagggcuaccgaucaacgguaccaacauccuaaagaugaaacucuggcucgaacaaggcgaaugcugcgcauacuccggagagaaaaucacccgagaacaccuccucgacagcaacgcgcuccaggucgaccacauauaccccuacuccagaaguuucgaugacagcuacaugaacaaggugcucgucuucgcaaaagaaaaccaagauaaaggcaacaaaaccccauuugaagcauucggaggcgacaaagagaagugggaccgaauccugagucugucggccaaacuuccgaaacaaaagcaacgccgcaucucaaacacaaacuucaaggacaaagagggcggauuccucgcacgaaaccucaacgacacaggauacauagcaaaauuggccagccaguggaccaaagauugccucgaguucgaggaccuaagggaaaacgaggucacgauagcaggcgagaaaggaagcucaguacauauugaggugguuucagggcagcuuaccagcaugcugcggcacuacuggggccucggaaacaaggaccggaacaaccaucuccaccacgcagucgacgcagucauacuggcguacacaaacaacgccaugauaaaggcguucgcuaauuuccgcaagaaccaagaagaaaacaaaaagaaauucuacgccaaacaaaucgccgaguccgaauacaaagcaaagaaagccuuuuucgaacccugcaaaaacuuccgccagcgagucgaagagaaaauaaaagagaucuucgucagcaaacccccacgcaaacggguaagaggcgcacuccaucaggaaacguuuuacccguucgagaaacuaugcaacgacaaggaguacucagaaaaacucaaaauggacuacgggggcgagaagggcaugcagaaagcuaucgcccuaggaaaaauaaggcagaucggaacaaaaauaguaagcaacggugccauggugcgcguagacaucuucaaggacaagaaagggaaauucuacgcaguaccuauauauacuauggacuuugcacucggaauccuccccaacaaagcgguggcgauagggaaagacaaggacgguguaauaaaggacuggauagaaauggacucgaacuacgauuucuguuucagccuauucaaagacgaccucauccugguacagaaaaaggaaauggaacgggcggaacuaugcuauuucgucagcuucggcaguaccaacgcacaaaucaacguagagaaacacaacaacaaauuugaagggcuauccgaaaacgaaaagauacucuacagcaacgccacgcaaaaagaggucgccggcaagagcaucggaauacaaaaccuaaagacauucgaaaaguaccaagucagcccgcuaggagaaguccaaaaagccgaguucgaaccccaccaagaaauaaaacuaaagagcagccccaagagaaaagauuga

SEQ ID NO: 6093 - RNA, 3111 nt, Artificial Sequence
  Cas9 variant
augcuccacaaaaugcacuauagauuggcccucgaccuaggcuccacaagccuaggaugggcgaugauacgccucgacgccgacaaccaacccugcgcaguuaucaaagcaggaguccgcaucuucuccaacggacgcaaccccaaagacggcucaagccucgcaguaacccgaagagaggcaagagcaaugaggcgccgacgagaccgacuucucaaaagaaaagcgagaaugaugcgcacgcucauugaauacggauucuuccccgccgaagcagcgcaacguaaagcacuagagaccauuaaccccuucgcacuccgcgccaaaggacuagacgaggcgcucaccccagccgaguucggccgagcccucuuccacauaaaccaacgaagaggguucaaaagcaaccguaagaccgacaagaaagacaacgacucaggagcacuaaaaaccgcaaucggcaaaguaagagccacaauagaagcagaaggcugcagaaccguuggagaauggcuccacaaacgcgacgucgcaggacugaccguaagagcccgcuaccaccaagauaaggucaucaaagaagacggcaaaacaaagaucgacaaauacuacgacuuguacauugaccgggcgaugaucgaacaagaguucgacgaacucuggaagaaacaggcagaacucaacccagcccuauucaccgaagcggcacgcgcggaccucaaagacgugcuccuacaccaacgcccacuaaaaccugugaaaagcggucgaugcacauucaugcccgacgaagaacgagccccacucgcacuaccaucaacccagcgcuuccgcauguaccaggaagugaauaaccuacgcauacuaagagacggccucaaagaagaaccacucacccucaaacaaagagacgaccucaucgcggcccuggagaaaaauagcaaacacagcuucacgcaaauaaaaacccuacuaggcguugggggcgcaguccaauucaauuucgaagaccucaaaagacaagaacucaaagguaacaccacauccgcgauccucagcaacgacaaacacuucggcaaagccugguuuaccuucgacgaagccaaacaagacgccaucguccuccaacugguaaaagaagaaaacgaggcaaaacucguaagauggcuacaagacgaaaccggcaucgaugagaagcgcgcggaagcuauagcgaacgucggccucccggaaggauacggcucacucugcgcaaaagcacucgcgagaauacugccggagcuacgccgcgacgucaugacauacgacaaagcgguacaagcggcaggauucgagcaucacucgcgccuaggaucgaauaccgaaauaccgggccuaaccuucaaaaucgaauccauagaccaagauucaggagaagugaagcaauuccacauccacaaaguacucccauacuacggcgaauaucuccagagacacguaggauuugguagcggcgagcccgaggaccccgcagaaaagagauacggcaagaucgcaaacccgacaguccacaucggucugaaccaaauacggcuaguugucaacgcccugcucaaacgauacggacacccauccgaaguaaucguugagcucgcccgggaccugaaacagucaaaggaccaacgcgacgaagaaucaaaacgacaagccgaaaaccagaaacgcaacaaacgccuaagagacgccauugcagggacccucaaaaucucagaggaacgaguaaggagggacgacauacaaaagaugauucuaugggaggaacucagcuucgacccggccgacaggaggugccccuacucuggagcgcaaauauccgcgaccaugcuccuaagcgacgaagucgaagucgaacauauccuaccguucagccaaacccuggacgacagcuuaaacaacaaaacaguagcccucagacaagcgaaccgcaucaaaggcaaucgaaccccgugggacgcauucggcgcacaggcaguagcaggauucgacuacgaaagcauacuuguccgagcagaaggaaugccaaaagcaaagagauaccgcuucgcagaaaauggauaccaacgcuggcuaaaagaugacgcgagcuucuuagcacgcgcgcucaacgacacacggcacaugagcaaaguggccuucgaauaccucaagcugaucuguccaaacacccgcgucauaccagggcgcaugacagcaaugcucagagcuaaguucggacucaaugacguauuaggccucaauggcgagaaaaaccgcaacgaccaccgccaccacgcgguagacgcaugcgucaucgccgucaccgaccaaggacuacugcagcgauucgcaaaagccucagcaagcgcacgugaacaacaacuaaacagauuaguggaaaacaugccccucccauggggauccuacagagaacacguccaacgagccauuaacgcaauauggauaagccacaaacccgaccacagccacgaaggagccaugcacaacgacacggcauauggacuacgaggugacggcaaagucuccuuccacaaaauggucgaaggaguacgaacucacuccgaagacaaccuaaaagucaucgagaucagcaacgccaaagcaacggaccgacacggccuacuccccaauggcgaaccacgcccauacaaaggauacaaaggggacucuaauuacugcaucgaaauagucagaaacgagaaaggaaaaugggaaggcgaagucauaagcacauucgaggcauaccaacuggucagagaacacggaauagcccgucuuagacacagcacgcucagcgucagcggaaaacucuuagucaugcgacucaugauagacgacgucguccgacuaaucaucgacgaacagacaagaaccaugcgaauagcgacccuguccgggaacggccaaaucuucauggccgacacgagcgaagcaaacgucgacgcgaggaaccggucgaaagaggaaaccuucgccuacgugagcaaaauggcagggucacuccaaaaggccaacgcgcgaaggaucaacauaucaccgauaggagaacugcgggaccccggauucaaggaauga

SEQ ID NO: 6094 - RNA, 3114 nt, Artificial Sequence
  Cas9 variant
auggaacgaaucuucggguucgauauaggaaccaccagcauaggguucagcgugauagacuacagcucaacacaauccgcaggaaauauccaaagacuaggagugcgaauauuccccgaagcaagagacccggacggaacaccccugaaccaacaaagacggcaaaaacgaaugaugaggagacagcuccgacgccgacgaauaaggaggaaagcccugaacgaaacgcuccacgaagcgggauuucuacccgccuauggaagcgccgacuggccagucgugauggccgacgaacccuaugagcuccggagaagggggcuagaggaaggccucucggccuacgaauuuggcagagccaucuaccaucuagcccaacacagacacuucaaaggcagggagcucgaagagucggauacaccugacccagacguagacgacgaaaaagaagcagcaaacgagcgcgcggccacacucaaggcgcucaaaaacgaacaaacaacccuaggagccuggcucgcccgaagaccacccagcgaccgaaaacgaggaauacacgcacaccgaaacguggucgcugaagaguucgagcggcuaugggaaguacaaaguaaauuccacccggcacuaaaaagugaggaaaugagagcaagaauuuccgacacaauauucgcccaacggcccguauucuggaggaaaaacacucucggcgagugccgauuuaugcccggagagccacucugcccaaaaggaagcuggcuaagccaacaaagaagaaugcuagaaaagcuaaacaaccuagccauagcagggggcaacgcccgcccgcuggacgcagaagaaagggacgcgauccuaucaaagcuccaacaacaagccagcaugucguggccaggcguccgauccgcacuaaaagcacuuuacaaacaacgcggagagccaggagccgagaaaaguuugaaauucaaccuagagcugggaggcgaauccaaauuacucggcaacgcacucgaagcaaaacuagcagacauguucggccccgauuggccagcacaccccagaaaacaggagauccgacacgcaguacacgaaaggcuaugggccgcagacuacggagagacaccggacaagaaaagaguaauaauacucuccgaaaaagaccgcaaagcgcaccgcgaagcagcagcuaacagcuucguagccgacuucggcaucacgggagaacaagccgcgcaacuccaagcacucaagcuacccacgggaugggaaccauauuccaucccagcacuaaacuuauuccuagccgaacucgaaaaaggggaaagauucggcgcccuuguaaacgggccagauugggaaggguggcgccgcacaaacuucccacacaggaaccagcccacuggcgagauauuagacaaguuaccaagccccgccucgaaagaagaaagagaaaggauaagucaauuacgaaaccccacaguggugcgcacccagaacgaguuaaggaaagucgugaacaaccugauaggccuguauggcaaaccagacagaauccggauagagguaggcagagacguaggcaaaucgaaaagggaacgagaagaaauacaaucaggaauaagacgcaacgaaaaacaacggaagaaagcgacagaagaccuaaucaaaaauggaauagcaaacccaagcagagacgacgucgaaaaauggauccucuggaaggaaggacaagaaagaugcccauacaccggggaccaaauaggauucaacgcccucuuccgcgaaggaagauacgaagucgaacacaucuggccuagaagucggucauucgacaacagcccacgaaacaaaacacucugccgaaaggacguaaacaucgagaaaggcaaccgcaugccauucgaggcguucggccacgacgaagaccgauggucugccauacaaauacgacuacaaggaaugguaucggcaaaaggaggaacaggcaugucaccuggcaaagucaagcgauuucuagcuaaaacgaugcccgaagauuucgccgcaagacagcuaaacgacacccgguacgcagcaaagcaaauacucgcacaacuaaaacgccuauggccagacauggguccagaagccccgguaaaaguggaggcgguaaccggccaaguaacggcgcagcugcgcaaacuauggacacucaacaacauacuagcagacgacggagagaagacacgcgcagaccaccggcaccacgccauagacgcccucaccguagcauguacccaccccggaaugaccaacaaacucagccgcuacuggcaacuuagagacgauccaagggccgaaaaaccagcccugacgcccccaugggacaccauccgagcagacgcggaaaaggccgucagugaaauagucgugagccaccgcgucagaaagaaagucagcggaccccuacauaaagaaacaaccuacggggacaccggaacggacauaaaaaccaaauccggaacauaccggcaguuuguaacgcgcaagaaaaucgagagccucucaaaaggcgaacuagacgagaucagggacccaagaauaaaagaaauagucgcagcccacguagcaggucgcggaggagaccccaagaaagcauucccacccuacccuugcgugaguccgggaggaccagaaauccgaaaaguacgacuaacgagcaaacaacaacuaaaccuaauggcccagacagguaacggauacgccgaccucggaagcaaucaccacaucgcgauauacagacugcccgacggcaaagccgacuucgaaauaguaucccuauucgaugcuagccgccggcucgcgcaaagaaauccgauagugcaaagaacacgagcagacggagcaaguuucguaaugagccuagccgcaggcgaagcuauaaugauaccagagggaagcaagaaaggaaucuggauaguacaagggguaugggcaucaggacaagugguccuagaaagagacacagacgccgaccacagcacaaccacaaggccgaugccaaacccaauucuuaaagacgacgcgaagaaagucagcaucgaccccaucggacgcguucgaccaucaaacgauuga

SEQ ID NO: 6095 - RNA, 3117 nt, Artificial Sequence
  Cas9 variant
auggccaagcaaguuagguacagacucagccucgaccuaggcagcacaucccuaggcugggccauauuucgacuagacgccgacgcgcacccaacagcuauaaucaaagcaggagucagaauauucucugaugggcggaacgcaaaagauggaucaagccuagccgugaccagacgcgccgcccgcaguaugagaagaagaagagacagacuacuacgaaggaaaacccgaauguuagacgcacugcuagaauauggauucuucccucaagacgcagcccagcgcaaagcgcuagaacgccucaaccccuacgcacugagagccgaaggacuagcccgcccacuaacgcccggagaguucgcaagagcuaucuuccaucugaaccaaagaagaggauucaaaagcaaucgcaaaacagacaaaaacgacaaugacucaggagcgcucaagaccgcaacaagccaacuccgccaagacauacaagcaagcggcugccgaacagucggcgaauggcuuuggacucaacgacuccagaagaaaccagagggaguaccacaccaaggcguacgagcgcgguaccgcgaaacgccacacauaaacagcgaagggaagaaaagaauagagaagaaauacgaccucuacauagaccgauccaugauagaggcggaguucgacgcccuguggagugcccaagcgaccuucaaccccguagucuuccaugcaacagcacacgaaaaacuaaaagacauccugcucuaccagcgcccauuacgacccgugaaacccggaagaugcacccuccugcccgaggaggaacgagccccacuagcucuacccucgacacaaagauuccguauauaccaggaacuaaacaaccuccgacugcuaguggaucaacuaaacgaacagccacucacccucgcccaacgagacacaaucgccacacuaauggagggcagagccaagaucagcuucgaccagauuagaaaagcacucaaauuaggaucaaugaccaaauuuaaucucgaggacgauaagcggaaugagcucaagggcaacgcgacaggcagccaacuugccaagaaggaauuuuucgggcccgcauggcaccaauucgacgaagcacuccaagacgacauagucuggcaccuacuaucagaggagaacgagagcgcacucauaucuuggcuccaagacaggacaggcauagacgcugcgacugcacaagccgucagcaacgcuagccuaccagaaggcuacggaucgcuaucccgcaaagcccucgagguaauacuuccccgacuaagaagcgaaguaaucaccuacgacaaagcaguacaagccgcuggauucucacaccacagccaacugggcuucgaauacgaccccgacgacguagaagacuggauagaccacgcgacaggugaagugaaaccaauauucaaaagacuuccuuauuacggaaaggcgcuccaacgccacguugcauucggaucagguaaacccgaagauucacaggagaaaagauacggcaaaaucgcaaacccgaccgugcauaucggacucaaccaaguaagggucguagccaacgcccucauagcgcguuacgggcggccaaccgaaaucaucauagaacuugcacgagaccucaaacaaagcagagaacaacgacaacaggaccaacggcgacaggcggacaaucagaaacggaacgcccggauacgcaauagcauagcccaggccuugggcaucgcagaggccagagucagacgcgaagacauccaaaaauggauccuaugggaagaacuggacccgggagacgccaugcacagguguugcccuuacagcggaguaccaaucucggcguccaugcuacuaucagaacaagucgagaucgagcauauccuacccuucagcaugacccuagacgacucucugaacaaccgcaccguaagccuaaggcaagcgaaccggaucaagcgaaaccgcucaccgugggacgcacgugaagacuucgaagcacagggguggcacuacgacggaauccuacagcgcgccgggcugaugcccguccaaaagagauacagauucgcagcagacggcuaccaaagauggcucagggacgaccaagacuuccucgcacgagcacucaacgacacacgguaccuaagcagaauagccgccgaauaucuacgccuagucuguccccaaggaaccagagucauaccaggacagcugacagcccuacugcgucgacgauucggacuaaacgacauccuaggacucgaaggagagaaaaaccgaaacgaccacagacaccacgcaguagacgcgugcguuaucggaaucacagaccacggccuaaugcaacgauucgcacgcgcaagcgcccaagccagagaacagggccuaacacggcucgccgaagaaaugccgcucccguggccgaccuaccgagaccaugucgauagagcggugucacuaaucuggguaagccacaagcccgaccauggacacgaaggagcaaugauggaagagacagcauacgggcucaugaaagacggcaccauuagacaacgccacaaagccgacggcacaaaaggccgagaaguagcaaacguaauccgaaucgcugaacccgcacaaccuacgcgccacggcguggacgaccaaggacgaccccugccguacaagggauacauaggaggcucgaacuacugcauagaaaucacacgcggagcacaggggaaaugggaggggacgguaaucagcaccagcgacgcauacgggaucgucagggcacgcggaaucgcuggucugagaaacaccucacaaggccaaaacggacacccgcuaguuaugcgauuagucauaggagacagucuacggcuacguauaaacgacgcacugcaaacaaugcgaguaaccaaaauaagcggcaacggacaaguauucauggccggcguccaugaagcaaacguagacgcaagaaaccgggauaaaucgcaagcguucgcgcuagugagcaaaauggcgggaucacuccaagcagcacaagcacgacaggccaccauuagcccaauaggagaaauacgcgacccaggguuuccgggguga

SEQ ID NO: 6096 - RNA, 3120 nt, Artificial Sequence
  Cas9 variant
augaagaaaagaauccuaggccuugacaucggcaucgccuccgucggcugggcccuaauugaguucgacgacgaguuccaagacaacaagaagaaagguacaaucauuaaauccggcguacgaaucuucaccagagcagaaaccccaaaagaacgcgaaccacuugccaaaccccgccgagaggcacgcucccaacgccgccgcauaagcugccgcgucgaacgccuuaacuuugugagagaacucuucgucaaaaacggccuagucgcaaaagaauccgucaauaaaaacaacccgaacaacaucuacauaacacuaaaccaaaucaaaacccccuggcaacuaagaauggaagcacuggaccgcaaacuaacgaacgaagaguucgccgugguccuaacccaccuugcaaagcacaggggauauaagucgcuccgcaaaacggacuccaaagacaauaagacgggagaaaugcucaaggccauaaaucagaacaaagaacgccuggacaacagcgacuaccgcacacucggcgagauguucugcaaacacgaauccuacaaggaacauaaacggaacaaagacggcgaauacaucaacuccgucacccgcgaacuaauagaagaggaggccgagaaaaucuucgcuaagcaacgcaaggaaggcaacaacuuugccgacguggacauagaacgagaauaccuaaaaaucgcauuuucacaaaaaccuaccggaagcauaaacaaaauggucggcuuuugcaccuucgaaaacggggagaagcgggcaccccgagacucauauagcgcugaacuguucaaagucuuaaacacgauaaacaacacaaccauaacggacaugaaaacaggagaaacgcgaaacuucacaggcgcggaaaucaagaaaauaauagagaucaucaaagacacgaaaggaaucacauacguaaaaauaaagaaagaacucaaacuagggucaucgcaguucuccggggucgacuaccgggagaacgcaaaaucuaaaggagagggcgagaucuucgucagcaugaagacguaccacgagaucaaguccaaaauagaaaaacucagcaaagaaaaguggaauaaacucaaggaaaacaccgaacuccucgauagcaucgucaacauaaucgcaaacuucaaggacgacgaaagcaucaagaaagaguuccaaaaacucaaaaucgacgaagauaucaucgacguccugcucaacuucgaguucaagaaauucaucaaccucucguucaaagcccugcgaaaaauaaucccuuuccaguuccaaggccagaaauacaucacugcaucgaugucagucggcuacucauugaaacaagaaggcaucaaaaacaaauuccuccgcgucccgagccaggaagaaaacgugaacgugccggucgucgccagggccuucgcacagacgcgaaaagucauaaacgcagucauacgagaauacggacaauucgaucagauaaacauagagcucgcgaccgaccucaaaaacagcaaauucgaccgcagcaaaaucgagaaagggcaaaaagaguuccagucgcaaaaagacaaagucuuucaggaaguacaagaccuuacaggggaaaucaucccuucgucgucgcuacuacucaaauacaggcuauggcgcgaacaggacgaaaggugcauauacucagggcgcaaaaucucaagaaaggaccuucuggacacgggcuucuuggacaucgaccacauaauccccuacucgaagucgauggacgacggauucaacaacaaaguacuaugccuagcagaagaaaaccgcaacaaaaagaacgauaucccguucaacuacuaccagcgaauaggccgcgacuggaacuuucucauuagcaucaucgccaguaugaaaaacaugaaguacgucaagaagaaaagacuucucaaacaggaacucagugacaucgaaauagaauccuucauugaaagaaacaucaacgacacccgcuacgccacaagguauaucaaaaacuuccuugaaaacaaccucgaguucaaggaaaacgaguucauaaaggcaaaagugcaggcaagacacgggggucuaaccagcguacuccgcuacaacugggguaucagcaaaaaccgugaagaauccuaccuacaccacgccaaagacgcuauaaccguagccugcucaacccaggggaugguccaauacaucuccaacauaucacaaaaauacgaaaacggaaaauacaaaaugaaacaaaucaaagaacgcaccgaaaaucggauaccgaaaccaugggauucguucaaggacgacguggaacgauccaucaacgauaucuucgugagcuucgcaccccgacacaaggucaccggaucugcccacaaagaaaccaucuacagcaagaaacaccucgaaaaaggauauguaaccauaaagaaaagccucgacaaaaucaaacuguccgaccucaaaaacauuccaugcgaugaaaacugcgacauaauucgaguccucaaagaacgccucgaaaaauucaacgacgacucccucaaagccuucgcugacccaguucacaugccaacuaaaugcuccaacaaaaagggccccaucauccgcagcguuaaaauaaaagagaacaacaaaacagguaucgaaguccggaagggacucguagagcgaggcgacaugguacgcguggacgucuuuaucaaagacaagaaguacuaccuaguacccaucuacgugagcgacuuuaagaacaaagaccugcccaacaaagcaaucgucagcagcaagucggaaaacgaauggauaaugaucgacaaaacguacagcuuuaaguucagccucuucaaagaugacuuaaucaaaaucaaaaacaagaaaggcgagauauucggcuaccuaggagggguccaucggcuaacaggcgggaucaauaucaaauccuguuacaaacccaaagagaaagacggaaacauaggcagcaaaugucugcucgacuuucggaaauuucaggugggaauccucggcgacuacaacgagguaaagcacgaaaaacggaugccagccuacauaaacaccaagaaggacaaggaacacuga

SEQ ID NO: 6097 - RNA, 3123 nt, Artificial Sequence
  Cas9 variant
auggaccggcgcgaugcgagagcaaugaggcgccgacgggaccgcuuccaacaaagacagagagcccuacuaaaauaucuagucgccgacggacuauuccccgaagacgaaggcgagagaaaagcccucgcagcccuggacccauacgcccucagggcaagggcccuagaugaagcccuaagccuacacgagcucggccgcgccuuauuccaccucaaccaaagacgcggauucaaaagcaacagaaaggccgaccgcaaggcagacgacgacgcaggaaaaauagcgaucggcguugacagagcccgugaggcaauggccgaaaacggagcacgaacguacggagaauggcuccacagacgcagagccagcgcgaccgacgcaaacgcaaucccacccgugagaacccgauuacgaccggagaguggagaagacgcaaaaggagacggauacgauuucuaccccggaagagaccuacuagaagaggaguucgccgccauaugggaggcgcaagccgcacaucaccccgacgugcugaccgacgacguguaugagcgccucuucgaaauagucuucuaucaacgcccgcuuaaagccccacagaucggaaugugcacccucaucgcaggcgaucgcagacuacccaaagcacacccacucuuccaacgccgacgacugcuagaagaacuaaacgcacuaaugauaguaaggccgggagaagucgcacagagacuaacacgggaagaaagggacacacucuucuuaaaacugaaagaccgaaacaaaguaucauucgaaagccuaaggaagacgcucaaacucgauccagacgcacgauucaacaaggaauccgagaacagaaccgaacugaagggcgacgagguagcagcagcgaugggcaguaagacaagauucggaaacagauggguccacuuaagcaucgaggaacagugggcagugaucgaacggcuaggagaugucgaaagugaugcagaagacgcagcauucagggcuuggcucgcagaacgcuaugagcuuacaccagagcaaacaagggcaguaacaaaugcaccccuaccacagggcuacggcagauucggagaaaccgcgacaaggaaacucauagaugcgcuccgagauggcgaaaaagacggacgaguccugguguacagcgaagccguaaccgcagcaggucucggccaccacucggacagacgcaccggagaaguauucgaagacgaagagggccgcccacaacuucccuacuacggagucgcacuugagagacacauaaugcccggcacaggagacccaagcgacucggacgaaaugagaguaggcagauuaacaaauccgacaguccacaucggacugaaccaacucaggcgcauaguaaacagacugauaagagcauacggaccgcccgcagaaaucgcaauagaacucgcaagggagcuaaaacuaacagacgaggacaaaaagcggaucaacaaggagaacaacagcaacagacuugacgcagaaagacguagcgaaaaacuccuagccauaggcaaaccggacacaggagcgaacagagcacuccuaaaacuaugggaagaauuaaacccagcaaacguacuggacagacguugcauauacucaggaguacaaauaagcaucgacaugcuauuuagcgcagcagucgaaguagaccauauacugccauucacagccacauuagaugacagcaacgggaacaaaauagucugcacgcgugaagccaaccgggaaaagcguaagcgcagcccguacgaggccuggggacauagcgccagaugggaagaaaucgcggcucgugcagcccagcuaccacgaaacaaacgauggagauucgaaccagacgccauggaaaaguucaaagaugacggcggauuccaagccaggcaccucauagacacccaauaccuagcgagauuaagccgggaauaccuagcaacccucuaccccgacaaaggcgaaggaagcggacacauaugggugucgccaggcagacuaacggaaaugguacgacgcaaacuagggcucaacgaccuacugcccgaccacaacuucggcggaggggcagaccaggcgaaaaaccgccucgaccaccggcaucacgcaauagacgcagucgucgucgccauagucgaccgaggcaugcuuaacagaauagcaagggcuucaggacaagagggagcugaaggaagagaacgaauaauaauaccggaaccaugggaaggcuucagagacgacuuaagaaccgcagucaacgcuauaacggucagccacaggacagaccacggcaccgcgagcaaagcaggacugccaaaaggcaaggacgcgacugccggacgauuacacaacgacaccgccuacggcuucaccggggaaagcgacgcuaaaggaaacucgauaguagugagaagagugccccucagcucguucaagaaacuagccgacaucgaucgggugcgagaccccgagcuaaaagcggcacuguaccagcaccucgacggauuagagggcaaagcauucgaaaaagcaaucggcgaauuuggcucaagggaauggcacccguauggcgggguucgcagaguaaggguuacggaaccacuuagcgugaucccaauaagagaccggaacgggcacaucuacaaaggauacaaaggagacuccaacuaccgcuacgacguaugggaacucccuggagggaaguggguaaacgaaguaguaagcauguucgacgcacaucaaccaggguggcagagcgcaauacgagcugcaaacccaaccgcacgaaaaguacuuagcuugcacagggacgacguccuagccauagaacgaaacggggccgaaagggagcucguacgggugguaaaauucagcgagaagcaauucgcaguagcaccgcccaacgaaggaggcgcacugaaagcccgagacgcagacaaaggggauccauucaaauacucauacccaagucccaacacccucaaagcccuacgagccaggcagguacggauagacgaacuagggcgagugcuugacccaggauuucccgcccggacaaaacaacgaaaaacgagaaaaccaaacuga

SEQ ID NO: 6098 - RNA, 3132 nt, Artificial Sequence
  Cas9 variant
augcaaagagacaacccucugguguaccgucuagcacucgaccucggcagcaccagccugggcugggcagucuuccgacuagacgcagaaggaagcccgcucgcgauaauaaaagcuggcgcacguauauucucagacggccgaaaccccaaagacgggagcucacuagcagucacgcgcagggcagcccgcgcaaugcgacgccgacgcgaccgccuacucaaacgaaaagcuagaaugcuaggcgcacucgaaaggcacggcuuuuucccucaagacgaaagcgcuaggaaaguacuagaaacacucaaccccuucuuacugcgggcccagggcuuagaagucgcucuaaaaccagaagaguucggacgagcccucuuccaccugaaccaacgaagaggcuuccaauccaaccggaaaacggauagaaaagacucugacaguggagcgcugaaacaagccaucgggacgcuaagagcccaaaugcacgaaucgggcugccgaaccgugggcgaaugguuuuggaaagucaggauggaacauaaaccagaaggugugaaaggccaaggaguccgagcccgguacagagaaaccccguuuacgacagacgaaggcaaaaagcgaaucgacaagagauaugacuuauacgucgaccgggcaaugguggcccaagaauuugaugcccucugggcugcccaagccgcauuuaaccccgcacucuuuaacgaagccgcaagagcggaacugcgagacaucuugcuccaccaaaggaaacuacgaccaguacaacccggacgcugcacccuaguacccgaagaacccagggccuugcuagcccugagcuccacgcaacgguucaggaucuaccaagaaguaaaccaucugcgaguacuacacgacgaacucagggaagaaacccugaccuuggcgcaacgcgaccaaauagucgcccuccuggaaaaacaagccaaaguaacauucaccgcaaugagaaaagcacucggguucucggccuuauucaaccucgaggaugccaaaagggacggacuuaagggaaacgcaacagcagcggcacuaagcaagaaagaccuguucggcccgcuuugggccggcuucggcacggcgcuccaggacgagauugucacccaacuaaugaccgaggaaagcgaaccacgcuuaaucgccuggcugcaagaacacacaggaguagacgaggcgagagcccaagccaucgccaauaccgggcuucccgaaggauacggcagccuggggagaacagcgcucgcgagaauugucccagaacuacaacgggacguaauaacuuacgauaaagcggugcaggccgcaggauucgcacaccauagcgaccugggauucuccuucgagcacggcgccgacgaagucgagcguauaggcgaacgaacgaucgccagcacaggagagaucaaaccaguguucgcauucaagcaauuacccuacuacgggcgagcgcuccaacgucacguggcauucgcaaaagacaacccacgaaacgacgaagaacgauacgggaaaauagcaaaccccaccguacacauagggcuaaaccaaguacgagucguaguaaacgcacuaaugagaagguacgggcgaccagcagaagucgucauagaacuagcuagagaucugaaacagucacgcgaacagaaacuugaagcccaacaaagacaagcggacaaccaaaagcgaaacgcaagaaucagaagaucgauagccgaagugcucggaaucuccgaagaaagggucagaacauuagacauacaaaaguggauccuaugggaagaacugagccaugaugcugccgaccgaaggugcccguacucgggcguacagauaagcgcaagcaugcuccugggcgagagaguagaaauagaacacauucucccguucucaaugacacuagacgacagccugaacaaccggaccguagcacucagggaggcaaacagaaucaaaagaaacagagcaccaugggaagcgcgagcggacuucgaagcucaagggugguccuacgacggcauacuccagcgagcagaaaggaugccacuacgaaaaagauaccgauucgcccccgauggauacgaacguuggcuaggugaggauaaagacuuccucgcacgagcacucaacgauacaagauaccuaaguagaguggccgcugaauaucuaagacucgugugucccggauccgccacaagggugaucccaggucagaugacagcacuacuacgggggaaauucgggcuaaacgacguacugggccuagacggugagaaaaaccgaaacgaccaccgccaucacgcagucgacgcaugcgucauaggugugaccgaccaaagaaugaugcagcgguucgcgcaagcaaacgcacaggcacgcgaagacggacucacgcgguuagucgaagacaugccacuacccuggccaacguauagagaccaugucgaacgcgccguacaccacauaugggucagccauaaaccggaccacggcuucgaaggggccaugauggaggaaacgagcuacggcauacucagggacggcagcaucaaacaacgccgcaaagcagacggaagcgcaggcagagaaauaagcaaccuaauccgaauagccgaaccaggccaaccacaacgccacggcgucgaugcagaaggaagaccacuacccuacaaaggguacgugggaggaagcaacuacugcauugaaauuacagucaacgacaagggaaaaugggaaggccagguaaucagcacuuuugacgccuaccguauaguccgugagggcggacugagacaacucagacacccgacacaaggacaaaacggccgagcacucgcuaugcgccuggucaucggugacucagucagacuggaggcaggggaaggaagccugcaaacguuaagagucgcgaagaugagcgcagccgggcaaguauucaugucagaaguaaaccaagcaaacguggacgcacgcaaccgaaacggagaccugccauacgucuccaaaauggcaggaaguuuccaaaaagcaagagcgagacaagugaccauaagcccuauaggagaacugagggacccaggauucaaaggauga

SEQ ID NO: 6099 - RNA, 3135 nt, Artificial Sequence
  Cas9 variant
augaaauacacccucggacuagaccugggauacaacucuauaggaugggcgauauuagaaaacgacgaaaaugggagcccgauaaaacucuucaacgcgggaguacacaucuucgaaccgucaaucgaagacaucgaaaucgacggcaaaggaaaaaccaaaaacgucaaacgccgcgaagcccgccuacgccgccgccagcuauuccgcaaaacgaaacgccucgaaaaacuacuuaacuucuucauccaagaaggauucuuccaaaaccaaaaaguccucauaaacgacccguucgaacgcgccgaguucuuauaccaacuagacaagaaaagccggaacccuuacauccuccgccgcgaagcacuugacaaccgacucagucuagaagaaaucgcaagaaucuucuaccacauagcccaacaccggggcuucaaaucaacaaaacgagaauuagcugaaaugaauaaagacgagaagaaaaagaaagaagacggcauaauacaauccgaaauaaacacacuaaaagaagaaaucaagaaaaacagcugcagaacccugggagaauauuucgccaaacuuuucgaaaauggagagaaaauacgcggccggcauacugaccgaaaaauguacgaagaagaauuucagaaaaucuucaacaaacaaaaagaguucuaccccaacaucuucacugacgaguucaagaaaaagcucuacaaacuaauauuccaccaacgggaacugaaaucccaaaaggacaaggucggauuuugcagucucgagagaggaaagaagcgggccccauuggcccuccuuguaucacaacgcuaucgcuauaugugcaaagugaacaaccuaaaugucauagacaccgaaacaggcgagaacagagaauugacgguagacgagaaaaagaaacucuaugaaaaacuagaaaacagcgaaaaacugagcuucaaagaaaucaagaaaauccuuaaucuaucugaaaaacgauacaucuucaaccucgaaaagagcgagaaauacaucaucggaaauaaaacaaacguaaagaugaaaaacaucaucaaagauugggauaacuucgacgaagacaagaagaacuucuucaucaacgaagcccgcacgguagugaagauugaaacacucgaacgccggggcaagaaacuagggcugucagacgaagaaagcaaggaguucagcaaagucguauucgaagacggcuaccuaaacuucagcaagaaagccguggagaaacuccugccauaccucaaggagggcaagaaagaauacgaggccaucaagcucgccuaccccgagaacucgguacaaaacgacaaccucaaggagcucgacuuccugcccccaauaaagagcaaggaacuaaagaaguacuucgaagugcgcaaccccaucguagagaaagcccucacagaaacgcgguaccuggugaacuuccuaaucaagaaauacggcaagccggaaacgaucaaaaucgaacucgcaagagaacucaagcuaucaaacaaacaaaaagaacgaaaacacaaagaaaaccaagaaaaccgcaagaaacgggaggaaguaaucgaaaaacugaaaaacgaucuaaaaaucucagaacccacagaaacacaaauccagaaguaccuacuggccgaagaaugcgacuguaaaugccccuacacagggcggucgaucuccauggacagccuauucggcgagcacccacuguuugacaucgagcacaucauaccguucgaccgcucgcuggacaacuccuuccugaacaaaacccuaugcuacagcgaagaaaaccgcaaggucaagcacaacaaaacacccuacgaagcauauuacggaacugaaaaaugggaggcaaucaucgaacgcgucaagaaauucaagagcaacguaagaaacgaaaagcuacgacgauuccaaaugacgaaagaagacgucgaaaacuauauccagaacuucucaacccaaaaccuaaacgacaccaaauacgccucaaagcucgccaaaaaguaccucggacuacuauacggaagcaucaacgaggacggaauugacaagaaccgcaaacgccgaaucuuugcuucaucgggaaaagucacauccacacuccgauaugcacuugggcucaacaccauccuuaacgacgagaacauaaaaacacgcgaagaccaccgccaccacgcaauagacgccaucaccauugcucucacggauagcagcaugaucaagaaaauaucagacgcaagcaagcgcgagaagaacaucaacucccucuucaaagacuuccaagcgccuugggagaacuuccgcaaggaaguggaagaaauuaucgcaaagaugaacaucaguauacgcauaaacaaaaaggugagcggccaaauccacgacgagacguucuacaagaaaccauuuaaggaggaagaaaaauccuacacgcaccagagaauaaacuuagaagaacucacaauuaaagacgaagauaagaagaaacaauccucaaagcuaauagacaacaucguggacagcaaaauccgcaauaucaucaucaacucccugaacggagagaaacccaaaauacgguucaaggacccaaaagaccacccauacauaauccagaaaaacggcaagaaaauacaaauccacaaagucaccaucaagaccaaacuugagaccuacaacgagauaggcccagaaaaggccaaaagauacgucaaauccagcgacagccaccacauagagaucuucgaggacuuaaaaacaaagaaaugggacggcuacguugugagccugcuagaggcauacgaaaggaaaaagaagaaacuaccaaucgucaacaaaaacuuaggcgagggcaagaaauuccucuucagccuggccaaaggagaaaucaucgagcucgacaccgaaaauggcaaaagagagcuauucguagugcguaucauaucggcauccaacaaccaaaucaaauucacgaggauaaacgacucacgcaaaaucacugacauaccugcaaccggccugacagccugccccucaagucuaaagaaacguaacugcaagaaaguaguuaucaacauccugggcgaaaaacacuacagcaacgacuga

SEQ ID NO: 6100 - RNA, 3135 nt, Artificial Sequence
  Cas9 variant
auggccgaaaagaaauucaaauaccgacuaggacuggaccucggcaccaacagcauuggcuggugcaugcugagacugaacaaagacaacgaacccgcggcagucaucaaaucgggaguucgaaucuuccacgauggccgcaaugagaagacgaaagaaccacuagcugugguccgcagaaacgcacgaucuaucagacgcaaccucgaccggaaaaucucgcgccgaaaccaccuacucaacacccuagucaaauacuuccuccuaccauccaacgagauagagcgcaaggcacucgcagugcucaaccccuacgaguuacgcagccgagccgucaacgagcgccucgaacuguucgaacucggaagacuccucaugcaccuuuccaagcgacgaggcuucaagagcaauaggaaaguagacaaagaagacagcuccgggaaaauaaaaccugcgauagagcgccuaaagaacaagaugcaagaaacaaacaaaaagacggcgggcgaauaucuauacagccuaaugcagaacgggaagcccguucgggcccgauuaggacggaucgacggcucuaacggcuacgaaaucuaccucgaccgagcacugaucgaggaagaauacaaccugaucaugaacgagcaaaagaaacaccacaaagaacuaaccgacgauauaaucaacgaaauauucaacauaauauucuaccaacgaccccucaagaaacaaaucaucggcaaaugcucgcuaacgggcgaagacacaaaacuaaagaaagcgcacguauuagcacaggacuucauccuacuacagaaaguacaagaccucagagucuucgacgacaaccagcuagaguucagaccacuaagcaaugacgagaaagauaucauaaaacgugaacuaaggaaaaagaaagaaguaucuuacgaaaacauacguaaacuccuaaagaaauacuacgagaacguuaaauacggcauguucucacacgagacccuuuacaagaaacuccagggaaacaaaaccaacgcccuaaugagugacaaagaaaucauaggggacagcugguacagccucucgccagaaguccaguacgauaucaucgaggagcucuacuccgauaaagacaacgacgagcugagcaaacuauacucagagaaauucaaccuaaaugagucucagaucaacggccuccucaacaaagccauauacagacucgauucaggguacauacgcuacggcaaaaccgccgucacaaaccuaaauagcaucauggacaaagacaaccucaaccuccacgaugcgcgggaagaggcgggguacgaaaaagaaaauaaacaggacgccucggaauaccuggaauauuacgguaagguccucccggacuccguggucgacccgcaaaucgaaaaccccaaaaacgacgaggagagauacgggaagauagccaacccaaccguccacgcggcacucaaccaauuacgcaaacuggugaacgagcucauaaagcuauacgggaaaccagagcaaauuguaaucgaacuagcccgcgaccugaaaaacucgcgaaaagcuaaggacgucaucaacaagaagaucgccgaaaacaggaaacucaacgaagagguagacaagacacuccaagaguacuccgagaaauacaacacacacaucgucaaaaacaaacuaaaccgagauaaaguaaagcucuggcgcgaacugggcaaggauccacucgaacgaaaaugcauauacacgggggaacaaaucaacauagcaaaguuauucagcgacgaagugcaaaucgaacacaucguccccuacagcaaaacgcucgaugauagcuucaacaacaaaacacucucaaugaaacaggcaaacuacuacaaaggcaacaagacccccuacgaagcauucaaagacagcaaggacggauacaacuacgacgacaucauagcgcgagccaaacuacucaacaacgacaacaaauuuaaacgcuucaccaaagacgccauggacauauacaauagagacggcaaagacuucauagcacggcagcucagcgacacacaauaccugagcacccgugcccuaaucuaucuacagucccucuacgaaaaagcgcaccacaguucaauauggacaauacccggucaacuaaccgcccuaauacggaacuaccuaggccuaaacacacucaucagcaacgacaaaaacaaaaaucggaaugaucaccgccaccacgcagucgacgccuucgucgucgcaguuaccucgcgcagucuccuccagaaaauauccuacgcagccucgcuccaagaggaccucgacaaccgaaacgugagcaguuacaggaacaaacuacucgaaaagaugccggaaccauuccccaauuaucgaaaaagucucgagcuagccauagacaacaucaagacaagccauaaagcagaccgcagcaucagcggcaagcuacacgaggacacagcauacggcaucgucgaaaacgacgacaaguacaacguggucacaagguggacaguggacaaauuuaaagaacaaaaacacuucgagacaaucagagacaaugaauuaaaagaaaucgcgugcagugacaaagagcuguuugccaagaucguagaaacccggaagauaaaaagcauccgaaaacuagcgaaagagaaccccguaaucaaaaucaaagacaaaucgggccgcgacuacaaggccuucgcgggcgguaacaacauaugcguggaaauauacgaaguggacggcgugcggaaaagcgaagugauccaacuguucgacgccgcacaaaagggcuucaugcccgaguggaugaagaaguauccaaacggcaagcuccuuaugcgccucuucaaaggggaugucaucggcuucauagagaaccgaaaguacaacuacuacaccaucaaaggcauauccauagcggaccaaaaccuaaaacuccucgccauuaacaaagcagaaggaaucuucaagaaaggacuuaacauccucuucgacucuaacaacaaaaacagccucaaugcaaagcaauucaacaucagugucacaggaaucgucacaaagaagaaaaccgcagauguuaacuucuggaaaaaccggaaauga

SEQ ID NO: 6101 - RNA, 3135 nt, Artificial Sequence
  Cas9 variant
augcuccacaaaaugcgcuaccggcuagcccucgaccuggggagcacaagucucggcugggccaugguaagacuaaacgcaaaccaacaaccaugcgcagucauaaaagcaggagugcgaauauucucaaacggccgaaacccuaaagacgggucaagucuagcaguuacacgacgagaagcacgauccaugcgacgcagacgcgacagacuccugaaacgaaaggcccgaaugaugcgaacccuuaucgaauacggcuuuuucccagcuaacgaaacccaaaggaaggcacuggagaaccugaaccccuacgcacuccgagcaaaaggacucgacgaggcacuaacccccuccgaauuugcacgggcgcuauuucacaucaaucagcgaaggggauucaaaucuaacagaaaaaccgacaagaaggacagcgacagcggagcccuaaaaaccgcaauaaaacaguuacacuccguccucgauccacaaggcaaugacgggaaaccacgaacagucggcgaacuccuauacaagcgcuucacggacuuaucaaaacuccccaaagacagaaccguccgcgcgagguaccgccaggacaaaauagugaaggaugacggcaaaaccaagaucgacaaguacuacgaucucuacaucgaccgagcgaugaucgaacaagaguucgacgcgcuauggaaaaagcaaagcgaacucaacccgauacucuucacggaaaaugcaagagcggaccuaaaagacguacuccuguaccagagaucacuaaaacccguaaaacccggccggugcaccuucaugagugaagaagaaagagcaccccucgcacuccccucaacccaacgcuuccggauguaccaagaagugaacaaucuacgaauacugcgcgaagggcuaaaagaagaaucccucacacuccaacaacgggaugaccugauaaacgcauuagaaaagaauaacaggcgcacuuuuacgcaaauaaagaaacugcugggagucggcggcucaguucaguucaacuucgaagaccccaaacgcgaagaacucaaaggaaacacaaccucagcaauccucgguaaauccgaacacuucggagaggcuugguucgccuucaacgaagccaaacaagacgccaucguccuacaacuaauaaaagaagagaacgaagcgaaacucguaagguggcuccaagacgagacagggauagacgaaaaacgcgcugagguaaucgcgaacgcaggccugcccgaaggauacgggucccucugcaucgaagcccuagcaagaauacugcccgaacuccgucgagacgucgugaccuaugauaaggcaguucaagcagcaggauucgaacaccacagcaaacucaaccgcaaugaggaaauacccgacaucaccuucaaaauagaaucaaucgaccgcaacagcggagaaauaaaacaauuccaucugcacaaggaacuaccuuacuacggugaauaccuucaacggcacgucggcuucggcagcggaaaaccagaagacucaaucgagaaacgauacggcaaaauagccaacccaacgguccacaucggucuaaaccaaguccgcguaguaguaaacgcccucauaaagcgguacgggcacccaagcgaaaucaucguagaggucgcuagagaucuaaaacagagcaaggacagacgagacgaagaaaauaaacggcaggccgaaaaccaaaaacgcaacgaaagacuccgaaaagacaucgccgauauccuggguaucagcgaggaaaggguccgcagagacgacaucgagaaaaugauccucugggaagaacucagcuuugacccagccgaucggcgcugcccauacagcggaguccaaguauccacggucaugcugcugucugacgaagucgagguagaacacauccuaccauucagccagacguuagacgacucccucaacaacaagacagucgcacuccggcaggccaaccggaucaaagguaaccgaacacccugggaagcauucggcacgucaaacauauccggguuugacuacagcggaauacuaacccgcgcagaacugaugccgaaagcaaagcgauacagguucgcagaagacggcuaccaacgguggcuaaaggacgacgcaggcuuccucgcacgggcacucaaugacacacgacaccuaaguaaaaucgcacgcgaauacaugucgcucauaugcccaaacacccgugucaucccgggacaaaugacggccaugcucagacgcaacuucgggcucaacgacguccuaggccucaacggagagaaaaaccgcaaugaccaccgccaucacgccguagacgccugcgucauagccguaacggaccagggccugcugcagagauucgcggcagccagcgccagcgcacgggaacgccaacuuaaucgucuagucgaaaacaugccacucccaugggaaucguauagggaacacgugcgcagagcaaucgacggaaucugggugucucacagaccggaccacagccacgaaggagccaugcauaacgacaccgcauacggccuaagaggaaacggacgugucuccuuccacaaaaugguagaaggcaaaagagaauacauagaagacaaucugaagguaauugaaauaacagauacuaaagccauugaccgacauggccuccuaccaacuggcaaaccgcguccauauaaaggcuacaaaggcgacuccaacuacugcaucgaaauaguccggaaugaaaaaggcagaugggaaggcgaaaucaucucaacauucgacgccuaccaacucguccgaaaauacggaaucguccaacuccgcuaccccguccucucgguaagcggcaagccgcuagugaugcgccuaauacgcaacgacuucguacgacucgagcacgagggaauaaccagaacccuccgaguaugcaagaugcgggaggacggccaagucgcccuagccgacgucacugaagccaacgucgacgcacggacccggacaaaggaaauaugcuacguuuuuaaaaccggaggcagccuccaaaaagccaaagccagacgcauaaccaucagcccaaucggcgaacuucgcgaucccggauucaaagaguga

SEQ ID NO: 6102 - RNA, 3138 nt, Artificial Sequence
  Cas9 variant
augcaaaaagaaaagccacucgccuaccggcucgcccuggacuugggaucaacaucgcuuggaugggccguccugagacucagugcaccaggggaaccgagcgcaguaaucagagcgggcagccgcaucuuuucggacggcagaaauccuaaggacgggagcucacuagcaguaacccgcagagccgccagagcaaugcgacgaagacgagaccgauuguugaagagaaaggcgagaaugcuagcagcacuagaaaggcacggauucuuuccgcaagaugaagcagccagaaaagcccucgaaaaacuaaacccauacggacuaagagcccggggacuagagagcgcgcuaaagcccgaagaauuuggccgggcacucuuccaccuaaaccaacgacgaggauuucaaucgaacagaaaaacagacagaaaagacagcgacagcggagcacucaaacaagccaucggaacacuacgcgcccagaugcacgaaagcggaugccgcacgguaggagaaugguucuggaaagugcgaauggagcgaaaaccggaaggaguaaaaggacagggaguacgggcccgcuaccgcgagacuccauucacaacagacgaggggaagaaaagaauagacaaacgauacgaccuauacguagaucgggccaugguagcccaagaguucgaugcacugugggcggcucaggccaccuuugcgccagcgcuauucaacgaagcagcacgagcagaacuucgcgauauccugcuccaucaaaggaaauugagaccgguccaacccgggagaugcacgcuaguuccagaagaaccccgagcccuacucgcacuaccaagcacacaacgguucagaaucuaucaagaaguaaaccaccuacgcguccuccacgacgaacuuagggaagaggcccuuacacuagcacagcgcgaccaaauuguugcacuauuagaaagacaggcaaaaguaacauucacggcgaugagaaaagcgcucggauucucggcguuguucaaccucgaggacgcgaaacgggacggcuuaaaaggcaacgcgacgacagccgcccucggcaagaaagaccuauucggaccacugugggccggguucgauacagcacuccaggacgaaauaguaacacaguuaaugacugaagaaagcgaacccagacuaauagccuggcuacaagagcacacgggaguggacgaagcaagggcacaggcaauagcgaacgccggacucccggaaggauacggaagccuagggaggaccgcgcuagcgcggauaguaccggaacugcaaagggacgugauuacauacgacaaagcgguccaggcagcgggcuucgcccaccacucggaucucggguucagcuucgagcacgacgcagaugaaguagaaagaauaggggaaagaacaauagcaagcacgggagaaauaaaaccagucuucgcauuuaaacaacucccauacuacggccgcgcgcuccagcgacacguagcauucgccaaagaaaacccccgcaacgacgaagagagauacggaaaaaucgccaaccccaccguacauauaggucuaaaccaagugagaguaguaguaaacgcccuaauguguagguacgggagaccaaccgaggucguaaucgagcuagcgagagaccucaagcaaucccgagaacaaaaacuggaagcacaacaaagacaagcagacaaccaaaaacgcaacgccagaaucagacgaucuauagcggaaguacuaggaauaucagaggaacgcgucagaacacuagacauacaaaaauggauccuaugggaagaacugagccacgacgcagcagacagaagaugcccauacuccggagugcaaauaagcgcaagcaugcuacugggggaacgcguggaaaucgaacacauauugccauuuagcaugacauuagacgauagccuaaacaaccggacgguagcgcucagagaagcaaaucgaaucaagcgcaaucggacaccgugggacgcgagaacagacuucgaggcccauggauggucauacgacggaauacuucagagagccgagaggaugccacaacgaaaaagacacagguucgcacccgacggcuacgaaagguggcuaggagaagacaaggacuuccucgcacgggcgcucaacgacacgagauaccucagccggguggccgcugaauaccucaggcucguaugucccgggagugcaacgcgggugaucccgggacaaaugaccgcccuccugagggggaaguucggacugaaugauguccucgggcucgacggagagaagaacagaaacgaucaucgacaccacgccguggaugcaugcgucaucggagugacugaccaacgaaugaugcaaagguucgcacaagccaacgcacaggcgcgcgaagacggacucacgcgccuaguagaagauaugccacugccauggcccaccuacagagcccacgucgagcgcgcgguacgacauaucuggguaagccacaaaccggaccacggauucgaaggggccaugauggaagaaacaagcuacgguauacucagagacgggacgauaaaacagcgccggaaggcggacggaucagcgggcagggaaauaagucggcucauacgaauaacagagcccucacaaccccagcgacauggaguagacgccgaaggcagaccacuacccuacaaaggcuacguaggaggaagcaauuacugccucgagauuaccguaaacgacaaaggaaagugggagggccaagucaucucuaccuucgacgcauaccgaaucguuagggaaggcggccuacgacagcucagacacucaacccagggacaaaacggccaagcacuggcgaugaggcucguaaucggcgacucgguaagacuagagguagacgaacaagaaagggucaugcgcauaguaaagauuaauggcaacaacggacaaguauucauggcccccguacacgaagcaaacguagacgcgcgaaacagcgacaaaaacgaagcauucgcguacaccagcaagaucgccggcucauuccagaaaacaaaggccagacaagucacaauauccccaaucggagagcuaagagacccgggguucaagggauga

SEQ ID NO: 6103 - RNA, 3138 nt, Artificial Sequence
  Cas9 variant
augaaaccacgaaaccugaacuacauccuaggccuagaccugggcauagcgucggucgggugguccgucguggaaaucgacgaaaacgaauaucccauaagacugaucgacgucggcguacgcacguucgagagagccgaaguaccuaaaaccggggaaucccuagcacuagcacgccgucuagcacgcucaacaaggcgccugauucgccgacgcgccuucagguuacuaaaggccaaacgccuccucaagcaucaucaaaucgucaacgccgaagaacucacccagcuaccuaaccagugcugggaacucagaguaaagggccucgacagccuccucuccaacaccgagugggcagcgguccuacuccaucuccucaaacacaggggguaccugucacaacgaaagaacgaggcacaaaacgcggacaaagaacugggaaaacuccgggaaggcauggacaacaauagcaagcuccugcuagaaaacaacuaccggacucccgcagauaucgcagucaagaaauucgcgguagaagaaggccacaugagaaaucaacgaggagcauacacccacaccuuuaacagacucgacauccucgcggaaaugcaacuacucuucaaaacucaacgagagcucggauccaccuacgccaacggcgaacucgaacaggcauuuugcgagcuacuacuauggcaaaaacaagcgcuaaaccgcucccaaaugcucucccucguaggaaagugcacuuucgaaaaagaagaaaaacgcgccgcaaaggccucauacagcgcagagcgcuucguagcgauacaaaaacuccagaaccuccgcauucuagaaaauggcgaagaaaggggccucuucgacagcgaguucucccuccugcuagaaaacgcguacaaucugaaauccggccucacguacaaacaaguacgcaagauccugucacuaagcgaaaaugcaauauucaaaggucuccccuaccugagcgacgaccuggaaaaacccgaaaagacgcaauuccucgcguucaaguucuaccaccagcuggccgacauccugaagaacaacggcuucagcgacgaauggcagaaacucucccaagaacccacccuccuagacaaacucgggacugaacucucccucugcaaagaggaaaacgaguuuaucgcgcaguucaacggagaauuaccggaagccauguuaucuacccuguucaaccacaccaacuucgacaaauucauccacauaucacuuaaggcccucaacaacauccuaccacucauggaacagggaaacgauuacacuaaagcauggcgcaaagucuacccagagcccacaaagaaagacgagaaaacucuacccccaaucccagcggacgaaauccgcaacccuguaguccuuagaucccugagccaggcccgcaaaguuaucaacgccgucauacgacucuacgggagccccgcacgcauccacauagaaacagcaagagaacucggaaaauccuacgacgaccgucagaaaaucaagaaacaacaagacaaaaacuccgaugaacgcgaccaagcgguaaagaaauuuuuagaggagugccccaacuuugccaacaaagucaaaggaaaagacauccugaaaauacgacuauacaucaaccaagacgguaaaugccuauacuccggcaaaccccuagacccacaccgccuccucgaaaucggcuacguagagauugaccaugcccuaccguucagccgaacgugggacgacucacagaacaacaaaguccugguccucgcaaacgagaaccagaacaaaggcaaccagacgccguucgaauggcucggcaaagacgagcaccagugggcacuauuuguagcgcgcguaaacggaugcagauucccauaugccaagaaacaaagaaucuugacuaagaaacucgacgagcaaggguuccuaaaacgaaaccugaacgacacaagauauguguccgccuaccugaugaaacauaucaaagaaaaccugcaccucgucggaaaaggauccgacaaaguguucgccuccaacggccagguaacgaacuuccuaagacgcugcuggggucucgagaaaaagcgcgaagaaggagaccgacaccacgcccuagacgcuauagucguggccuguuccaccgcaucaaugcgccagaaaauaacgcuauucaaaaaguaccaacgguggaaucuaaaaacaggcaaacacauagaccaagaaacaggcgaaaucauuccgcuacacuuccccgcccccugggacuucuuccgccaagaagugaugauccgcaucuucucagaaaugccgcaggaagacuuaauaaugcaauuacccgaccgcccccaagcaaaccacgaguucguacaaccccuguucguuucccgcgcgccaucccgaaagaugagcggacagggccacgaagcuaaacuccgcagcgcacggaugcuagaagcaacaggaaaaagcaucaaaaaggaguuccuaacagaccuaacgauuaaaaacuuggaacacauggugaacaaggaacgcgaaccggagcuauaccaagcacucguagaacacuucaagaaauauggcgacaaacccaaagaaaaauucuucaagaagggcgggguggaaguuaaaagcauacgaauuuccaaaacccaaaacaaaagcgucaaccucggcaacaaaacaauugcagacaauggcgacaucguacgaacagaccucuuucugaaaaacaagaaauacuacuucgugaacauauacgcguggcaagucaguaaaggaauacugccaaaagaaacgacaacgggaaacauacuagacaacuccuaugaguuccaauuuagccuuuucaaaaacgaccuccucgaaaucccgcaucccaaaaacgaaaacgacagcauccuugcauacuucaucaggcccgacgacgaaaggcgcuggauacuaaaauuccacgacaacgccaaaaucccagacaucuauggcaaaaaggacgaaaccucaauaaggcuuucaauacaaggacaaaaauucaucaagaaauaccaggucgacgagcuuggcaaaaacaucagacccugccgucccaccaagcgacaaggaguacgcuga

SEQ ID NO: 6104 - RNA, 3141 nt, Artificial Sequence
  Cas9 variant
augaaaauauacuccuucgacaucggagucgccagcauagggugggccuucaucgaaaaugaaguccugcaggacugcggaauacggauauucaccaaggccgaaaaucccaaaaacggggccagccuagcuuuaccaagacgcgaagcacgcggcguacgcaaacgccuagcacgccgccgcggccgacuaaacaccauaaaacaacuacugugcaaagaguucggccuucaacuagaagacuaccucuccaacgacggcgagcuuccgaaagcguacaccgccucaaaggccaacccgcuaaagucuccauacgaacucagaacuuuagcacuuucgcagaaacucgacuccaaagaccuaguccgcguuauacuacacaucgcaaaacaccgcggcuacggcaacaaacacgcgaaagacuccaaagacaccgaauccggcaaggucaagaaagcgaucgaguucaaucgaaaaacacucgcggaaaaaggcuaccgcucaguuggagaauaccucuaccgcgaauuuuuccaacaaucgcgcauaucacaaaacaacggcgcuaccgaguucguaaacguccgaaacaaaacgggcaacuacgagcacuguguugcccaagacaugcucaaagaugagcucgagcucauauuccgcaaacagaaagagcucggccuucaccuaagcgacggcuucgaaaaacagcugcuugacaaaaucuucgaacaacgcccacucaaauccuucgcagauaaaguuggaaaaugccaauucaucgcuggcgcuaaacgcgccccgaaggacuccaucagcgcgaucgaguucgucgcgcuaagccgaaucauaaacacccuugccaaccucuccaagaaauccggagaaauguaugacaaagccaugguucucacaauccuagacucaguacucgaaaaaggagaaauguccuacuacgcccuacgagaggcuaucaaccuagacgagaaaauacgcuucgccgacucccgccuggacuacuccaaagagauaaaagagaccgagaaaguaaaauucguggaauguaaaaaccuaaagagcuucaagaaaguacucggcaacugcuacaaaacacucgaacgcaaacacauagacucaauugccgaacgcauagcagucaucaaggacgucgaaaaacugcacaaagagcuggagucauacugcgcgaccgagcagcuaucacucacauccgagcaaauccaggcucugucccaccucaacuucuccucccacauaucacucagccuaaaagcacucgaacaaauacuccccuuuaugcggggcgagagagaagcccgauccagcgacgccgacuacugcauagggaucgacgaauccggagaaagccagugccuccgcuacgacgagagcguagagaaagcuggccucaaagcccucagcaaagacacccucaaaggccaaauccucccgcccuugaacgaguucgaacccuaccuggccaaccccgucgucgcccgggcacuagcagaauacagaaagguccuaaaugcccugcuaaagcaauacggcuccccacacaagauccacauagaauacgcgcgcgaagccaaacuaaacaccaccgaacgccaaaaguacgaaaaggagcaaaaagacaacuacgccgccaaccaagccgcccacaaaaagugccaagagcuaggacuugaaccguccucaacuaaccuccuaaaacucaaacuauggcaggagcagggcggacugugccucuacucaggggcaaaaaucacaaucaguuaccuucaggaccccaccgcgcugcaagucgaccauauuuaccccuacucacgauccuucgaugauucauacaugaacaaaugccucguccugaccaaagcaaaccaagaaaagggaaaccgaaccccguucgaggcuuucggcaccgauagcgcaaaauggggagucauaaccacccuggcccagaaacuuccgcacaagaaaagacgccggauccucaacaccgcguucaacgauaaagaagccggcuucaagcuccgaaaccuaaaugacacaucguacaucgcccggcuuguggcugacuauacugaaaccuaccuagaguuccugucccuugucgaauccgaaaauacaacccugggaaagggucagaaaggauccaaaaagcacaucgcgauagucaacggcgcgcuaaccagcaccaugcgauacuacuuagguuucgccucaaaagaccgugacaaccaccuacaccaugccuuagacgcugucaucaucggcuuuaugaacgauagcgucaucaaggcauucucagacuucaagaaaacacaagaaaccucaaaagccgcauacuacgcgcauacccucucaaaacaagaauacaagaaacaacgagcauucauacagcuacccagcggugaaaacuuccgagcgaacguacuagaaaaagccgaauccguuuucguaucaaaacccccgcgaaaacgaguccgaggcgcacugcacgaagaaucauucuacucccagaacgacaccaaacugcuaaaaucguacgguggcgcagaaggcaucgaaaaagcccugcagcucgguaaaauccgccaaaucggcacaaagaucgucucgaacggugccaugguccgcguagacauauucaaacacagaaaauccggcaaauucuacggagucccaguauacacaauggacuucgcacuaggaauacuucccaacaaggccguaguccagggaaaagauaaaaacgacgugaucaaggacuggcuagagauggacagcucauacgaguucauauucagccuauacaaggacgaccuccuccuaguacaaaagaaagaaauggcagaacccgaacuaugcuacuucguauccuucgacacaaguggagccagcaucaaaguggcgaaacacgacaacaacuucagcacacuuacagaaaaccaaaaacuacuguucagcaacgcaacaaaggaagaagucguagguaaaagcaucggaauccaaaaucugaaagucuuugaaaaauggcagguaucaguccucggagagguaaaacgaacccaauccuacccccgggaaaauaucucccuagccagcaaggccaagaaauga

SEQ ID NO: 6105 - RNA, 3144 nt, Artificial Sequence
  Cas9 variant
augaagcucuuacgauacauccuaggccuugaccucggcaucgcgucgguaggcugggccaucguagagaucgacgagaacgacuucccaauaaggcucauugacauaggaguccgcaccuucgacaaagccgagguaagcaagaccggcgaaagccuggcccucgcccgucgccuagcacgcuccacgcgcaggcugauccgccgucgcgccuuccgacuacucaaaggaaaacgauuacuaaaacaacauaacgucaucaacaaagaagcauuaacaacccuccccacggacugcugggcacuacgcgucaaaggccucgacgagcggcuuuccccaacagaauggagcgcuguacuccugcaccuucucaagcaccgcggcuacuuaucccagagaaagaacgaggcuaaaagcgccgacaaagaaaugggagcgcuacucucaggcguagccuccaaccaccaacuccucgucgaaaaccaguuccgaacaccagcugaaaucgccgucaagaaauuugcccuagaagaaggacacaucagaaaccaacuaggggccuacacccacaccuucaaccgacucgacuuacuagcagaaaugaaacuccuuuuccaaacacaacgagagcuuggcaacccccacacaucaggccaacuagaacaagaguucugcgaacuccucauguggcagaaacccgcccucucaggagacgcgauacuaaaaaugcugggaaaaugcacauucgaaacgaacgaauacaaagccgcaaaacacagcuacaccgcagaacgauucguauggcucaccaaacucaacaaccuacgaauacucgaacacggaagcgaacgcguguuaaacacagacgaacgcucccuccugcucaaccagcccuacgaaaaagccaaacuaacguacacacaagugagaaaacugcuaggacucagcgaagaagcaagauucaacggcguccgcuacggaaaggaaaaagcagaagacgcuacccuaauagaacuaaaagcauaucacgccaucaggaaggccguggaaaaagccgacaaaagugccugggagacccuuaaaaaccaaaccgcacugcuugacgagauaggcacgaccuucuccaucuacaagacagacgaugacauaaccgaacaacucaacggaaaacucucagacacgguacuuaacgcacuccuggagaaccuaaacuucgacaaauucauacaacugucacuaaagagucucuauaauaucgucccacugauggaacaaggacuccgcuacgacgaagccugucaacaaauauacggggaccacuucggaaagaaauccggcgagauaaaccgacuccucccaccaauacccgccgacgaaauacggaauccagugguccuccgaucacuaacucaagcacgcaaagucaucaacgcagugauacggcuauacggcagcccggccagaauacacauagagaccgcccgcgaauuagggaaaucauacaaagaccgaaaggagaucgagaaacgacaagagcaaaaccgagccgaaagagaaaaggccaccgcccaguucaaaacccuguuuccaacauucauaggggaacccaaaggcaaagacauccucaugaugagacuauacgaacaacaaaacggacaaugccucuacucgggcaaaccccucaaccucaacagacuccuggagaagggcuacgucgaaaucgaccacucacuccccuucagucgcacaugggacgacucucaaaacaacaaaguccuugugcucgccggcgaaaaccaaaacaaagggaaccagaccccuuucgaguggcucggcaaagacgagcaccaaugggcccuuuucguagcacgcgucaauggaugccgcuucccauacgcgaaaaagcaacgaauccucacccaaaagcucgacgaacaaggcuucauagaacguaaccuaaacgacacccgcuacaucgcacgauuccucgucaacuucguccgagaaaacuugcacuugaccggcaaaggcaaaaacagagucuuugccuccaacggccaaauaacggccuuccuacgcggacgauggggacuaucaaaagucagggaagagagcgaccgacaccacgcauuagacgcagucgucguagcgugcuccacagucgccaugcaacaaaagauaacccgcuucgucaaauaccaagagggaaaccuacaaacggcagaaagaaucgaucgugaaacaggcgagauuauaccacugcauuucccugacccauggcacuuuuuccggcaggaggucaugauccgcauauucuccgaaaacccccaagaggaccucaucauacaacuccccgaccggcccgaagcgaaccacgaguucguccaaccccuguucgucucccgcaugccaacccgcaaaauguccggccaaggacacauggaaaccauaaagagcgcuaagagacuagacgaaggcaucucgguaagcaaggucccacuaacccaacuuaaacuaaaagaccucgacaauauggugaacagggaaagagagaaagcccucuacgaagcacucaaagcccgccucaacgccuucaacgacgaccccacaaaagccuucgccgagccauucuacaagaaagguggucaacaagucaaagcaguaagaguagagcaagugcaaaagucuggcguaguaguacgcaacggaaacgguguggccgacaacgcaucaaugguccgcgucgacguuuuuaucaaaggcgggaaguacuuucucguccccauauauacguggcaggucgccaaaggaauacugcccgacagagccgucguagcggcaaaagacgaaucggagugggaacucauggacaagaccgcacaauuccuguucucgauguuucccaacgacuuaauccaaguuaagacgaagaaagagaccuuuuucggcuauuacaacggccuagaccgcgccacaggggcgauaaaccucaaagaacccgacuccaacaucaacaaaggcaaaucaggccuccaccgcucuaucggggugaaaacggcccucuccgucgagaaguaccaggucgacgaacucggcaaaaauauccgccccugccggccguccaaacgucaagcagugagguga

SEQ ID NO: 6106 - RNA, 3147 nt, Artificial Sequence
  Cas9 variant
augaaacgucuuggccucgacaucgggacaaacucaauagguuggugccuaauagaggaugauggcgacggaaaaggcagaauaauagauauuggcgcacguaucuucagugacggacgagacccgaaaucgggcgccagccucgccgucgaccgcagagccgcgcgcgcuaugagaagacgacgcgaucgcuaccuggggagaagaaccgcuuuccucaaagcacugaaacgauucggcuuaaugcccgccgacgaaagugccgccaaguuacucgcagaccgggacccauacgagcuacgggccagagcccuagacgagcgccucgaaccucacgaaauuggcagagcccuguuccaccuaaaccaaagaaggggauucaaaagcaaccgaaaagccgagagaaaaaccaaggacgccgaagacggcaaaauagccaauggcgcuaaagcucucgaccaggcuauggcagaaagcggagccgaaacacugggccaauuccucaguucgcgagauaccaagagaguaaggaugggaagcgacgcacaaggcuacgacuuuuacccccaacgucgccacguggaauacgaguucgacacgaucuggagccgacaacaacagcaccacccagcacugcuaacagaagaagcaagaaagaaauuacacgacauacuauucuuccaacgaccacucaaagaacaggaagugggcgugugcaccuucguacacaacgaaugccgccucccaaaagcacacccccucuuccaggaacguagacuuuacgaagaaguaaaccagcuagaaauaaccaccccaggagcacccaaccguaaacuaacaauggacgaacgagacgcucugauccuagaacugcgaucccgcaaagagcgauccuucgacagccucgcuaaacgccuaaaacucgcaccaggccagagcuucaauaaagccucagaaucccgaacacggcuaaggggcgacgaggucuaugcagugauggcccauaagaaaagauucggcgaccgguggccccaccuagaccgggacaggcaaugggcaauaauaaaaagaauaauagaagaagaagaccccgauaaacuucacgcguuccuaaccggggaauggggccucacagacgaacaagcccuggccacagcccgggccccacucccagagcucuacgggcgacuagggccaacggccacagcccgcauacuagaagaacucaaaaaggacguaaucacauacgaugaagcugugcggcgagcaggauggcaccacagcgaugaccgaacaggagaaauccuaccacaacuuccauauuacggcgaauuacuaacaagagacaucccgcccggcacccaagaucccaacgaucccccagagcaaagauggggaaagauaacaaacccaaccguccacauaggccugagacaacucgaaaagcuaguuaacgcaaucauaaaaguccacggacgaccagaccaaaucgucgucgaauuagcccgggaacucaaacuaaacgaaaaagacaaggaggagcacaacagaagaauacgcagggacacagcugcagcccaacucagaucggcgaaauuacaguccgagggcauccccgacaccggcgcaaaccgaaugcuccucagaaucugggaagaacugaauccaggagaaguacuagaccgccgaugcccauacugcggggaacccguaggcaugaggaugcuauucgcaggagaagcagacauagaccacaucaucccauauucccgcagccuagacgacagugcaggaaacaagguuguagcccacagaagcugcaaccgggcaaagggaaauaggacacccuacgaaaaauggguccacgacccggaccgaugggacgucaucaguacacaagucgccagacuccacaaaucaaaacaauggcgauuuggccccgacgccauggcaagagucgagaaagacggagguuucaucgcacgccagcucaccgacacccaauaccuaagccgacucgcaggcagauaccuaagcagccucuacccaaccaaggacgacggcagcguguacguaaucccaggcagaaugaccgcaaugcugcggcgccgauggggccuaaacagccuacuuccugaccacaacuuugucgacaacgaacacucuaacgcaccuaaaaacagacuagaccacagacaccacgccauagaugcggccgucguagcaguaacaacacgcgcccucaugcaagaaaucgcccgcaccgccggacgugccgaggauaaggaccuagacagacuauucgaagaccuuccgcaacccugggaaggcuucagggaagaacuaggcgaaaaacuuguaagggucaccgucucccacaagcccgaccaugggcggaaaggccucccaccaaagaacagagacgucacagcaggcagacuccacaacgacacagcauauggccuaacgggagacguagccgcagacggaaagaccccgaucguaguccaucgcguaccacucaugagccuaaaacccgccgacauaucugauccagaccgaauacccgacccagcccucaggagcgcacuacaccgcgcuaccgauggacuauccgguaaagccuacgacgcagcacuagcaggauucgcaaagacacacccacaguucgcagggauaagacgagucagggugcgcgaaccacuaaccguaaucccaaucgcagaccgagauggucgacccuuuaaagcauacaaaggcgacgcuaacagcagaguagacauauggcgaaugccagacggcaaauggcucucugacguaguuaccauguaugaagcgcacagaagagaccacuccgacagaagaccucaccccgccgccaagaaacugaugagccuccggcaaaacgacaugaucgcagucgaacgagacggcgccccacgccaaaucaugguagugaaacagauauggccaacccaaauaaaccucguagaacacaaagagaccggaaaccuuaaagacagacacagcaacgagacggacccguuucguuucuucgcgccaaccgcaggcggccuaaagaagaugaaagccagacaaguucgcauagacccccuaggccgcaucuucgacccgggaccucgauga

SEQ ID NO: 6107 - RNA, 3147 nt, Artificial Sequence
  Cas9 variant
auggccaacauagccgaaaaccuggucuucggaauagaucuaggcauaggaucaugcggcugggcuguccuaaaccaaaaagcaaaagacgagaauauagucgcgcucggcuccuggugcuucgacgucccagaaacagacaaagaacgaaucccaaccaaccaaauacgacgugcaaaccgccuacuacgacgcguaauuaggcgcagaagaaaucgcauggcugaaauccgcagacuauucgcgagcaaagguaugcucgacacagcggacccagacgcacuggcaaaaauaucggcagacccaugggaaaugcgagcgaaaggccucgacuaccaacucacaccacaagaguucgccgucgcauuaggacacauagcuaagagacgcggauucaagagcgccgcaaaaagaguauccacgaaugccccuuccgaagacuccaagaugcuagcagcacuagagaaaaccaaagaacaaucggcacaauaccgaacuaucggagaaauguuugcccgcgacccagcauacgcggaccgcagacgaaaccgagacggcugcuuugaccggacuaugagcagagaagaccuauucaaagaaacgcaaauacuauucgagagccaaagaagacucggcaacuucagcgcaaccuccgaaacagaacaagcauucaucgacaucgcauuccgacaaaaaccaaugcaagacagcgaacgacuugucgaaaccugccuauucgaaccagacgaaaaacgagcaagcagguucgcccccagcuucgaaagauuccgacuauuaugcagacucguaaaccuacgggucacggauggccuggaggacagaccacugacacccgaggaacucaggcucgcgugcgaagaugcgggaaagacccgaaaacugucgguaaagaaaguacgcagccuaauaggacuacgagacgaccaaagguucacaaccaucccacccgaccaggaacaacacgacaucgcagccagaacaggggacgcgcucacaggcacagcaaccuuccgagcaauccucggagaauccuucuggaggcaacuacuaccccacccggagcaacuagacagggcagccuggauaauuucauuccacgaacuaacagacacaauaauauccaaacuggccacaauaggacugcccucagaggugauggagcugauuagaaaagcgcucgaagacggaaaauucagcaaauucaaaggcgcagcaagccuaagcgacaaagcggcacggaaacuaauaccauuuuuacaggaaggccucacauacgacaaagccugccaaaaggccggcuauaaccacgccgcguccaaauucacacacuacgacucaaucgauacgaaagccaaauucaacagccuaauggaugacgucagggacagcaucacaaacccaguugcccgcaaggcaaucucagaaggcaugaaacaagugugggccaugaggaaccaguggggccuacccggagcaauaugcauagaacucgcacgagacgucgguaacagcgcggagaagcgucgagagaucgaaaguggcauuaagaaaaauacggcgcaacgagagcgcgaacgacaagaagcaaaggaacaccucaaccaaagcgacaucagcucggagacgcugcuacgcuaccgccuguggaaagaacaaggaggccggugcugcuacacagaccaaccaauaaccccaucgcaacucauagcuuccgacaacucgguccaaguagaccacauccucccauggagccgcuucggggacgacucauaccuuaacaaagcccugugcacagcaaaagcaaaccaggagaagaaaaacagaaccccaugggaauggauacacaaccaaaaaggagucgaagcguggaaccacuucacagcagccguagaaucacggaaagaaacaaggggacuaaagaaacgaaacuuucuccuaaaaagcuccaaagaaacggaagaaagauucagaagcagaaaucucaacgacacacgcuaugcagcaaggguaauggcagaggccguccggcuacuauacccgagcggaaauagagcggagaaaggggguguaaaacgcgucuucaccagacccggagcacuaaccgcagcccuccgacaugccuggggcgucgaaucacugaagaaaauuaacgggaaacgccugaacgacgaccgacaccacgcgcuggacgcagcagucguagccgcaguaagcgaaaaagaaauacagaaacucaccaagagcuuccaaaucugcgaacaaaaaggacuagcccgaccgaugcgagauguccccaugccaugggaaggcuuccgacaccagcuagagacugccuacgcagacauaagggucgccaggccagagcgucgccgcgcaagaggaaaaggucacgacgcaacaauaaggcagcuccgugaggaaaaagacggaccaguuguauacgaaagacgagccauaagcgaccuaaaacugaccgaccuagaacgaauuaaagacccagaacgcaacuccgcaauaaucagcucacucaggacuuggauagaaaaaggaaagccggccgacuacccaccgcaaucgccaaagggcgacgaaauacgcaaaauaagagucaugagcagaaacaaacccgcgguaagcgugcgaggcggcacagccgaccguggggaaaugacgcgggucgacguauucacaaaaaugggaaagaaaggaaaaccagaaugguuccugguccccaucuacagacaccaaguaauagaccgcauacaguggccccagcccccaaaccaagcggccgccaacggaaagagcgagaaaaauuggccaacaauggggcuagaacacgaguucagauuuucccuguacccacgaaguuacguccaaaucgucaagcgagacggagaaauaauagaaggcuauuucgccggccuggaccgaaccguagccgcauucucccugcucucaagcagcgaucccacaagcauacagagaggaaucggagcaaaaacgcuagaaagcauacggaaauacaaugucaaccgcuucggcgacauaucgaugguggaacaagaaacgcgcacauggcacggagacgucugcauaagcccagaccaaccagacagcgcauga

SEQ ID NO: 6108 - RNA, 3147 nt, Artificial Sequence
  Cas9 variant
augguagagaaaauccugggcaucgaccuaggcauaucgaguuuaggaugggccgucguagaauacgacaaagacaacgacgaaaacaacaagauaaucgacuguggcguucggcuauucacugcggccgaaaccccaaaagaaaaagaaucccccaacaaagcacgcagagacgcacgaggacucagacgcgucaucaaacgccgacgcguucgaaugaacaccaucaaaaacuugcuaaucaccuacaagcucauagacaagacacuacuugacgaagaaaugggcauguuccacagccaaagcaaccgcguagaugucuggaagcucagacacgacgcccuguaucaccuacuauccggcgaugaacucgcacggguacuuauacacauagccaagcaccgaggcuacaaauuccuuggcgacgacgaauccgacgaagaauccggcaaggucaagaaagccggcgcggaacuuaagaagaaauuccucgaagccggcugccaaucaguaggcgaauggcuuuggaaagaacgaggccugcaaggcaagaaacgcaacaaauccggcgacuacgagauauccaucccccgggacuuccucguugaggaaauacagcgcauauucgaaacgcaacaaaaauucggaucgaccuucgccacgucagagcuccagaaagcauacacggacaucgccuucuacgucaaaccaaugcagagcaucgaagacaugguaggauacugcaccuucuaucccaagauuaagagcaaaaaccaagacggagagaaaagagcccccaaagcgucgccgucagcagaacaauuugucauccucucuaaaauauucagcacaauugucauagacgagaacaaacaggaaaagaaacuaaucgaacugaagucgauagagcagcucauccagaucgcaagauccaaagaaacacuaaaauacaaacaacuccgaaaagaacucaaccuagcaaaagacaucucauucaagagcaucucggacgaggagaaaaccuggaucaacuuagucggcaacgcaaaguucaagaaaauccucggacugaacuacgaaacguuccugaaaaauacagagauauccgacgaaaucgcaaagauccugacguacgacaaaaccuucgaacaaaaagaaacuaaacugaagaaccuccuagucaauaucgacuggaucgacaacaaccacaucgcagaacuggccaaacugagcuucucccaauucaaccaacuuagccucaaagcaaucaaaaucaucucgaaaaucaugauagaaggauacgcccgcuacgacgaagccguacaauacgcguuugaaaauaaccuacuccccaaaccaagccaugaaaaaucaauccuccuaccaccccuuaaagagaccaacaucgccauccucaaccccacagugaucagagcauucgcucaauuccggcaagucgccaacgcccuuguaagcaaguacggcuccuucgacaaaguacacuuugagcuagcaagagagguaaacacaaaggaagaccgaaagaggugggaaaaagaucgcgacaagaacgagaaaaugcaccgccagauaaccgaaaagcucguggaagagggcgugaagcccuccuacaaaaacauccucaagagcaaacugcgcuccgaacaaaaagacacgugcccuuacugccagaaaaaccuccacuaccccaugauauucgaagacgguuacgcagagauagaccacauccuuccacucucccaaucacaggacgacucuuacguaaacaagguacucguacacagcgcuugcaaccaaaauaagaaaaaccgaaccccguucgaaugguuccaagacgagaaaaaggacugggacaccuucaaaucauauauccuaauggaaucaacgcuaggcgagaaaaagagaaacuaccugaucaaagaaaacuucuccgauccccaaucccgaaaagaguucauaucacgcaacuugaacgacacaagauacauguccaaagccaucaaaaccuacugcgaaaaccacuggaaacugucccacgacgacgacaaacuacguauccaaguccguucaggaaaacugacauccacccuucggcaucaguggggccucgauaauaaaaaccgagaaacccacacgcaucacgcaauggacgcgaucaugaucgccuucagcacccaggggauggucaagaaacucuccgacuacuucgcuaagaaagaggccaaagucgagaaagacaaacccguacugaucaccccaaucaaacaauucaaagaagcaguugaacaagccaccacccuggaacgacaggaaucgauccagacuaaggcaggagacaccaucacccuuaaccgucugcucauauccagaccaccacgagcaagcgugaccggugccgcgcacgaacagaccgcaaaacccuacccccguaucaagccuaucaaaaacaaauacaagaggcgcagaauccccauagacgaagacaaauucgaacuauuccgcaacgacaaaguugcaucagguaacgacaaaaacuucuacaacuccucaaccaucccccgcguggacaucuacaagaaagacgacaaauaccacguggucccaaucuaccuaucagacaugacgaaagccgaggucccuaacaaaucauuaggaacaaacccggagggaauggacgagaaguauuucugcuucagcguguucaaaaacgaccuaauagagcucgaaacaaaagcaaccccaaagaaacccucuaagaaacuacuuggauauuucaaacaauugaacggcgcaaacuucauacucaacuccauacacaacggcauaaucgacggcuuuguaugcagccccauaacacucuucaaacaacagaaagacaugugcaagaaaugccugccagaagaccgagcaauaggaaacugcagccaggaaacgcuagaguucugggaagccgaaaauauaaaagucccaaagaaggacuucgaaugcgaccaaggcauuaaauucgccauagcaguccgaaaauauaccaucgacccacuaggcuacuaucacgaaguaaaaggcgaaaaauugcucggcaccauaccgcagggggcaaagaaacacccaaaacgacaaaaauga

SEQ ID NO: 6109 - RNA, 3150 nt, Artificial Sequence
  Cas9 variant
augaucaacgaacggcuaaccuucggaaucgaccuaggaauaggaagcugcggcugggcaguacuccggcacgcagacgcggcuggggagccaggaguaauagaaggacuaggcuccuggugcuucgauguccccgaaacaagcaaagaacgcauacccaccaaccaaguccgccgaagcaaucggcuacuccgucgcguaaucaggagaagaagaaaccgaauggccgaaauaaggcgacuauuccacgcgcaagggcuacugcccagcgcagacgaggaugcacuuaaacgaccacgacucgacccgugggaauuaagagcacgcggacuagaccagugccuaagcgccgaagaguucgcaguagcacucggccacauugcacggcaccguggcuuccgaagcucggcaaaaagaaaagccgcgaacaccucaggggaagacuccaaaaugcucagugcacugcugguaacucgagaaagaacagcccgcuacagaacagucggcgaaauguucgcccgcgaccccgaauauagcgcacgacgucgaaaccgugacggaaucuucgaccgcacagucgcccgagacgaccucauacacgaagugggaaaacuguucgaagcgcaacgagcccgaggauccgcauucgcgagcccggaucuggaagcggacuucaacgcaauagcauucagacaggcagaaaugcaggacagugaacgccuaguaggaaacugcccauucgaacgcgacgaaaaacgagcggcacgcugggcgccaucauucgaacgcuuccgauuacuaacuagacucauaaaccuaagaauagcgacagcagaaggagaacgacgcuuuacaccagaagacuuagcaagagucagcgcagaacucggagcaacagccaaacuccccguaucaagaguaagagcgcucaucggacuccuacccgacgaacgcuucacaacgauaagaguagaagacgaagacagagacauaguagcacgcaccggcgaagcugccccaggaacguggagacuaagaaagacccucggcgaagcccucugggcggaaaugcaggcaaggccggaccaacucgacgccauagcacacgugcucagcuucuucgaagcaacggccaaaauuagaagugaauuggaccggcuaggccuuccagcggcuguaauagaagcacuagauaggggacuagaagacggcgcguucgcaaaauucaaaggcgcggggcacauaucagcuaaggcaugccgaaaccugcugccccaccuacaacaaggacaccgauacgaccaggccugcagacucgcaggcuacgaccacgcggcuuccacccugucacauacagcacaaguaguaagcaaagcaggguucaacgcccucguaacggaacuuggcgaaucaaucgcgaacccaauagcacgaaaggcccuaacagaggggcuaaagcagauacgagccaugugcgcaagguggggccugccuggggccauccauauugaacuagccagggaaguagggaacagcauagagaaaaggagggagcucgagucacagcgggaaacuacaaccaaacgacgccaaacagaacgggacgaaauccgaggacuccuggcccuagaagauguagacgacgauacauugcuccgcuaucgacucuggaaagagcaaggcggaaaaugccuguacaccggcaaggacauccacguaaggcaacuaauagcaaccgacaacuccguacaaguggaccacauauuaccaugguccagauucggggacgacagcuucaacaacaaaacgcucugccucgcaucagcaaaccagcggaaaagaggacaaacaccaugggagugguucucacuaaccggaacaccagaggccugggaaguuuuugcaagccgaguggaaaccagcaaggaucuccggggauuuaagaaacgaaaccuccuccugaaaaacgcugacgagguagcccaaagauucagaagccgaaaccuaaacgacacacguuacgccgcaagacuacucgcagaggcggccaaacucuucuacccagcgggagaccgacaagaaaaagacgggcgcagacgaguauuaacacgaccuggcccgcuaaccgcagcccucaggcacgcguggggacucgaaagccugaagaaagcagacggcaaacgagucuccgaugaccggcaccacgcacuagacgcacucgccguagcagccaucucggaacgugaaguacaacgccugacaaggagcuuccaagaaugggaacagcagggacuggcacgaccacuccgccacguagccccaccauggcccggcuucagaggagacgugcuggccgccuaugcacaagccuucguagccagaccagaaagaagacgugcgcgcggaaaaggccacgacgcaagcauaagacaagucguaggagagggacccgaagcacaaguauucgaacgucgaggauuagccgaccugaaagaggcagaccucgaccgcgucaaagaccccgagagaaaccaagcaauaauagaagccguaagggcguggauacucgccggaagacccgcugacgccccaccacgaagccccagaggagacguaauagucaaacucagaacagcgccugcaaagaaaauaaaacccgcaguccccguaagaggcggcaccgcagacagaggagacaugguccgaauagacgucuucacccgaccgaaccgcaaaggacgagacgaaugguaccuaguacccaucuacccacaccaagugaugaauagaaaagcauggccccaucccccaaugagaagcgugguggcguacaaagacgaggcaggauggacagagauuggcgccgaacacagcuuccgauuuagucuauaccccagaagcuacguacagcuagucaaaagcaacggagauguaaucgaaggauaccuagucagcauggaccgcucaacuggcgcauucagagucuucguccacaacaacccagcagaaauggccaaaggaauaggcgccaaaacacuccucaaccucagaaaauucaacguugaccgauucggagugcggaccgaagucaagucagaaguuagaacuuggcacggcgaaguaugcacaucaccagucccacccgacuga

SEQ ID NO: 6110 - RNA, 3150 nt, Artificial Sequence
  Cas9 variant
augcaacuauccaaacucaacuacauccucggucucgaccucgguaucgcaagcguaggcuggagcguaauagaaauugacgaaacugaaaugccaauacgccucauagacguaggcguccgaacguucgaacgagcagaggugcccaagaccggcgaaucccucgcccuagcccgacgccucgcacgcuccacccgccgacucauacgccgccgcgccuuccgccuccuaaaagccaaaagacuccucaaaaaccaccaaauuguaagcgccgacgaacuauccacacuccccaaccauugcugggaacuccgcgucaaaggacuagacgagcgccucaccugucaagaaugggccgcaguucuccuacaccuacuaaaacaccggggcuaucugagccaacgcaaauccgaagcucaaaacgccgacaaagagaugggagcacuacugagcggggucgcgaacaaccacaaacuauuaagcgaaaaccauuacagaacccccgccgagauagcaguaaagaaauucgcccuugaagaaggucacaugcggaaccaacgcggagccuacacacacaccuucaaccgguuagaccuccuagcggaaaugcgccuccuguuccagacccaacgcgagcuuggcagccccuacgccuccggagagcuggaacaagaauuuuguaaacuucugauguggcagaaaccugcgcuaagcggagacgccaucuuaaaaaugcucggcaaaugcacccucgagcccaccgaauacaaagcggccaaaaacacauacacagcagaacgcuucguauggcucaccaagcucaacaaccuacgaauccuugaaaacggauccgagcgggcguugaacgcagacgagcgggcccuacuacucaaccaaccauaugaaaaggcgaaguucaccuacgaacaagcccgcaaacuucuccaacuaaacgaagccgcaagauucaacagcgugagguacggcaaagaaaacgccgaaaaaucaacuuuaauggagaugaaagccuaccacgccauacgcaaagccguugaaaccgccgacucauccgcaugggccacacuaaagacgcagccccuacuccuugacgagaucgguaccgccuuuagcaucuacaaaaccgaugaagacaucaaaacccaacuucaaggcaaacuagcagacaacgucaucgacgugcuacuagaaaaccugaacuucgauaaauucauacagcuaagccucaaggcucucuacaaaauacucccccucauggagcagggccuccgguaugacgaggcgugcagccaaauauacggggaccacuucggaaagaaggaacagaaaaacgaccgccuguuaccacaaauacccgcggacgagauccgaaacccuguaguacuacgaacucucucccaagcccgcaaagucaucaacgccgucauacgacucuacggaucacccgccaggauccacaucgaaacagcacgugaacuaggaaaauccuauaaagaccguaaggaaaucgaaaagcggcaggagcaaaacagagcugaaagagaaaaagccgucgacaaguucaaggaacucuuccccaacuucauaggagaaccaaaagcuaaagacauacuaaccaugcgucucuacgaacagcaaaauggucagugccucuacaguggaaaaucacucgaucuccaccgucuccucgagaaaggauacgucgaaaucgaucaugcauugcccuucagccgcacaugggacgacucguucaacaacaaaguccuaguccucgccggugaaaaccagaacaaauccaaccagacaccauuugaauggcuaggcaaagaugaacaaaagugggcguuguucacggcaagagucaacaguugcagauucccauauucaaagaaacaaagaauccuaaccaagaaacucgacgacgaaggcuucauccaacgaaaccuaaacgacacccgcuacauugcacgauuucuagucaauuucgucaacgacaaccuacaccugaccgggaaaggcaaacgcagaguauucgccaguaacggacaaaucaccgccuuccucaggggaagguggggccuaacaaaaguccgagaagaaucagaccgccaccacgcgcucgacgccgucguaguggcgugcaguacagucucaauucaacagaaaaucaccagguucgucaaauaccaagagggcaaccugcaaaccgccgaacgaaucgaccgggaaaccggcgaaaucaucccccuacacuucccagaccccugggccuucuuccgcgaggaagucaugauccgaaucuucuccgaaaugccccaagaagaccucguaaucaaacuuccagaccgaccacaggccaaccacgaguucguucaaccccuauucguaucccgcaugccaacacgcaaaauguccggacaaggacacauggaaaccauaaaauccgccaagcgccucgacgaaggaauuagugucucuaaagucccucuaacccaacuaaaacuaaaagaccuagaaaacauggugaaccgggacagggagaucgccuuauaugaagcccugaaggcccgacucaccgaguucaaagaugacccagccaaggccuucgccgaaccguucuauaaaaagggagguguucaagugaaaagcguccgugucgaacaaguccagaaaagcggagucgugguccgcaacggaaacggggucgcagacaacgcaaguaugguacgaguagacgucuuuauaaaaggaggaaaauacuuucucguaccgauauacaccuggcaagucgcuaaaggcauccuacccgaccgcgcagucauagccuacaccccugaaaacgaaugggagcucauggacgacagcgcacaauuccaauucucaaucuaccccaacgaccuaauaaaacuuaccacuaaaaaggccaucuucuucgguuacuauucaggcuucaaccgccucacaggcgcuaucaauaucaaagagcacgaccuccaaaucucaaagggagacaaaggggugcaccuaggacucggcguaaaauuggcucugagccucgaaaaauaccaggucgacgaacuagggaaaaacauucgcccaugccgucccacacaacgacaaaacguccgcuga

SEQ ID NO: 6111 - RNA, 3153 nt, Artificial Sequence
  Cas9 variant
augucgucauacagguuuagcuucgaccuaggcacgaacucaaucggcugggcgguauucgaacucgaccccaaaacccgacccguagcgcucgcggacugcggaguccgcauauucccagacggccgaaacccaaaggacaaacaaucccuugcuguagcccgccgagaggcaagagccgucaggcgacgccgcgaccgcuaccucaaacgacgaucagagcuaauggagagacuugucgccaagggacucaugcccgaaagucgcgacgaccaaaaggcccuagaaggacucgaccccuacgcacuaagagccgcaggccuggacgacgcccucccgccccaccacuucggcagagcccuguuccaccucaaccagcgcagaggauucaaguccaacagaaaaacggauagaggagaaaacagcgaaacaggcaucacaaagaucggcaugaagaaacuacacgaggcauuacuaagcgagggcugucgaacacuaggggaacuucaacacagacaccacgaggccaaccaaacacccgccauggacacuaacccgaaaagcguucgcagcaagcuccguggcgaaggugcaaaagcagucuacgacuuuuauccaucccgcgacgcaguugaggacgaguucaacaaacugugggacucccaaaaacgcuuccaccccgaccuacucaccgacagcgcacgcgacgcaauaagggaugcaauauucuaccaacgcaaauugaaaacgcccgacgcagggcggugcuccuucaacccagcagaagagagaguagcaagagccaugcccauagcgcagcacuucaggauacuccaauucguaggagaccuccgccugauagacaacgaccuuguaagacacccccucaacaacgaucaaaagaaagcacuauaccgcgaccuccuagcaaaagggaaacucaccuucaaagcaaugaggaaaacaauaggcaucggaagcgaauacgcauucucccacgaauccgaaaaacaaagcgaguuccgaggagacgaaacagccgcccgccuggcaggccccaaauacuucggcccgaaauggagagaacuguccuucaacgaccaaagugaaaucguagaccgacuccuacacgaggaaaacgaagaaacgcugauacaguaccuccaggacagauucggcuucgaccacgaccgaugcgagguaauagccgacgcaccccuaccggacggacacacucggcuaggcaagacagcccuagaaacucuaguagagauaaugcgagaugaccaccuaccauacgaccaagccugcaccaaagcaggauacgaacacgcccugccaccagaugggguaauacucgaugaccucccauauuacggaauugcgcuagagagacacguggccuucggagacggaaaauccgaaaacccagaaaaacgguauggaaaaauagccaacccaacuguccauauagcccucaaccaacuacgaaaagucauaaacgcucucauagcccgauacggucacccagaccaagucguaauggaaauagcccgggaccuuaaacagagcaaagccaaaagggaugacaucagcaaagagcaaaagaagaaccaagacagaaacgaccaacgcaggaagaaacuacaagaagcacacaucgccgucaacgcugaaaacaugcugcgcaugcgccuaugggaggaacuggaugaagacaacgcagcagcgcgagcuugccccuucaccggagagacaaucucaauggcucgguuauucagcccugaaguagaaaucgaacacauacuaccauucucgcgaagccuggacaacagcccagcaaacaaaacacuaugcauggucugggccaaccgggcgaaaggaaacagaacaccaugggaagccuuuggccgcgaccgcgagcccggauucgacuggcccgaaaucgccgccagagcagcacgacuccccaaaaacaaaucauggagauucgguccagacgccauggagagauuggaacgagaaggagacuuccuugacagacaacugacagauacucaauaccuauccagaauugcacgugaauauguuacaaaaaucugcgauccaaaccaaguguggguaacaccaggaagacuaacagccuggcucaggcgcaacuggggccuaaauggaauacuccccaccggcaacgccacaaagaaccgcgacgaccaucgucaccaugcaauagacgcgauuguaguaggacucacagaccggggaauacucaaccgagucagccgaagugcagcccuagcagaagcagaggaccuggaccgaagcaucgccgaaaugccagaccccuucgacggauuccgcgacaacauccgccacaucuuagagcaaaucauaguaucccacaagcccgacgccggauuuguuccaggucauccaaaaggaaauacaaccccgggcgcccuacacaacgacaccgcauacgggauaauaaaaaccgacgcgaaaggcaugucugaaguagucacaaggaaggauguacugucguucaagggcacaaaagagauagagagcauccgcgacgccgccacccgacaaucccuuuuagacgccguagcaggaguacccagcggacuggcauucaaagaagcccugcgcgacuggagcgucagaacagguacaaaacgaguuagagugacauuuaacaugagcgucauaccgauccaggacagagacggaaaggcauacaagggcuacaaaggggacggcaaucugugcgccgaaauauacgaacguccagacggcaaauggggcgacgaaaucauaucccgcuuugacgcaguacaaccaggcuucaccccacaguggcaacgagaccauccagcagcgcaccggguaaugcgccuauucagggaugacaugauaauggcggaaauagacgguguaaugacugugugccgaauaguaaaaaugagcccugguaaaguaguauucacaccacaccacgaggcaaacacagauagcagaaacagggacaaagacgacccauucucauuccacacaugcucuggagaaagccuccggaaacgaaaagcccaaaaacuauucguagacccgcucggaaaaauaagaggguacagagcaaaggaaggcuga

SEQ ID NO: 6112 - RNA, 3153 nt, Artificial Sequence
  Cas9 variant
augggcgaaaacaugaucgacgaaucccuaacauucggaauagaucuagggaucgggaguuguggaugggcagugcugcggcgacccucagccuucggcaggaaaggagucauagaagguaugggguccugguguuuugacguccccgaaacaagcaaagaacgaacaccaacaaaccaaauccgcaggagcaaucgacugcucaggcgaguaaucaggaggcgacgcaacaggauggccgcaauaagacgacuacuacacgccgcaggccuccuacccagcacggacucggacgcccugaaacgacccggccacgacccaugggagcucagagcccgagggcuugacaaaccauuaaagcccgucgaguucgcaguuguccucggacacauagcaaagcgacgaggcuucaaaagcgcugcaaagagaaaggccacaaacaucagcucggacgacaagaaaaugcucacggcacucgaagcgaccagagaaagacuaggaagauaccgaacggucggagagauguucgccagagaccccgacuucgcauccagaagaagaaacagagaaggaaaauacgaccgaacaacagcaagggacgaccuugaacacgaaguccacgcacuauucgcggcgcagcgacgacucggacaaggcuuugccagcccugaacuugaagaggcauuuacagcaucagcauuccaccaacgacccaugcaagacuccgaacgauuagucggguucugucccuucgaaagaaccgagaaacgugccgcaaaacuaacucccagcuucgaaagguucagacuauuagcucgccuacuuaaccuacgcauaacaacaccagacggagaacgcccacucacgguugacgaaauagcauuagucacacgagaucucggaaagaccgccaaacugucaaucaaacgaguacgcacacuaauuggacuggaagacaaccaacgcuucacuacaauuaggcccgaagaugaagaccgagacauaguggcacgcaccggaggagcaaugacaggaaccgccacacuucggaaagcccucggcgaagcccuauggacagacaugcaagaacgcccagaacaacucgaugcaaucguccagguccugagcuucuucgaagccaacgagaccaucacggaaaaacucagagaaauaggacugacccuagccgugcuagacguacuacugaccgcguuggacgcuggcguauucgccaaauucaaaggagccgcacacaucagcacaaaagcagcacgaaaccugcuaccacaucuagaacaaggacggcgguacgacgaggccugcaccauggcgggcuacgaccacgcagcaucgaggcucucucaccacggacaaauaguagcgaaaacacaauucaacgcgcuagucaccgaaaucggggaaagcaucgccaacccaauagcacgcaaggcacuaauagaaggacuaaagcaaauaugggccaugcguaaccacuggggacucccaggaagcauccacgucgaauuagcaagggacgucggaaacagcaucgaaaaacggagagaaaucgaaaaacauaucgaaaagaacacagcauuacgugcccgcgagcgccgcgaaguacacgaccucuuagaucuagaagacgucaacggagacacccugcuaagauacagacucuggaaagaacaggguggcaaaugccuguacacgggaaaagccauacacauccgacagaucgcggcaaccgacaacucaguacaaguagaucacauacucccaugguccagauucggagacgacuccuucaacaacaaaacccuaugcuuagcauccgcaaaccaacaaaagaaacgaaguacgcccuacgaauggcuaucaggccaaacaggggacgccuggaaugcauucguacaacgcaucgagacuaacaaagagcuccgcggauucaagaaaaggaacuacuuacuaaagaacgccaaagaagcggaagaaaaauuucgaagcagaaaccugaacgacacaagauacgcggcccgacuauucgcagaagcagucaaacuacuauacgcauucggagaaaggcaagaaaaagggggaaaccgccgaguguucaccagaccaggggcacucaccgcagcccuacgccaagccuggggcguagaaagucuaaagaaacaggauggcaaaagaauaaacgacgaccgccaccacgcacuagacgcacuaaccguggcugcaguggacgaagcagaaauacaacgucucaccaaaaguuuccacgagugggagcaacaagggcuagggcgcccacucagaaggguugaaccaccaugggaaucauuuagggcagacguagaggcaacauaccccgaaguauucguagcucgaccugagaggcgccgagcuagaggggaaggccacgccgcaaccauaaggcaagugaaagaacgcgagugcacccccauaguguucgaacggaaagcaguguccagccucaaggaagcagaccucgaaagaauaaaagacggcgaacgaaacgaagcaaucguggaagccauacgguccuggauagccacaggacgcccagccgaugcaccaccaagaagccccagaggagacaucaucaccaaaauccgccuagccacaaccauaaaagcagccgugccagugcgcgguggaaccgcaggaagaggagagaugguacgcgcugacgucuucucgaaaccgaaccgccgaggcaaagacgaaugguaccugguuccuguuuacccacaucagauaaugaacaggaaggcguggcccaaaccaccaaugcgaagcauagucgcaaacaaagacgaagacgaauggacagaaguggggcccgaacaccaguucagauuuagccuuuauccacgcuccaauaucgaaauaauacgcccgucaggggaggucaucgaaggauacuuugucggccuacaccgaaacacaggugcgcucacaauaagugcacacaaugaucccaaauccauacacucagggauagguacaaagacacuccucgcaauaaguaaauaccaaguggacagauucggaagaaagucacccguaagaaaggaggucagaacauggcacggcgaagcgugcaucagcccaacacccccgggauga

SEQ ID NO: 6113 - RNA, 3153 nt, Artificial Sequence
  Cas9 variant
augaaaauccuaggguucgacaucggaaucgcgagcauagggugggcauucguagaaaacggagagcuuaaagauugcggaguccgcauauucacaaaagccgagaauccaaagaccggugacucacucgcuaugccccgacgugaagcccgcuccguccgccgacgacuggcccgccgaaagggccgccuagaaacauuaaagcgacuccucgcuaaagagugggaucuaugcuacgaagacuacaucgcugccgacggcgaacucccaaaagccuucaugggcaagaacuugaacaaccccuaugugcuacgcuacgaggcacuacaaaggcuuuuauccaaagaggagcuaguccgcguagugcuccacauagccaaacacagaggcuacgggaacaagaacgccaaaauaaccaagagcgaggaaagcaaacgcgagcaaggcaaaauccucuccgcacuagccaccaaugccuccgcgaucgccagguacagaacagugggcgaauacuucuacaaagaguucugugaaguaaucaagaacccccaaggccucagcaccaacgaacacuauacacaaagcaaaguccgcguccucaaaccuaucaggaacaagggcggagaguauacaaacugcauccuccaagaggaccuccaacgagagcuccgcugcauauucgaauaucagaaaggcuucggauuccccauaacccaggaguuccaagauaagauucucaagaucgccuucuaccaacgcccguuaaaagacuucucccaucuagucggaaagugcacauucuacccagacgaauuucgggcgcugaaaugcucgcucuccgccguagaguucaucacccucuccaaaacuaucaacguacucacauauauaucgaaagaaucaggggaaguguacaguaaaggccaauacgaacagaugcuagacuccguauucaaggcagucugcgaaaaaggcagccuuaguuucgcgcaacuccgcaaaauccugcacauagacgaacgaauccgcuucaaagaaguugacuacauggcccgcaaaagcaagaacacaagcggagacagcacccacaagcagaaaaccagcaaccccgaaacaaagaaauucauugaacacaaaaaccucaagaaauucugcgaaauucucucagaaaucgccgaagaccgagcccucgccgacaguaucgccagagacaugacccuaaucaaagacgaagaaaaacuagcucaaaaacuacacggcuacgggaaauucagccaggaacagaucacacaacucagcgcccucaacuucucccaccacaucaaccucucccucaaagcccugagugaaauacuccccuuuaugcgcgaaggcaugcgauacgaugaagcaugcaaacuugccggccucaaggcacggcacaacgacaagaaaagcaaauuccucccaccuuucugcgaaagcauuuaugcagaugagcuaacaaaccccgucguacaccgggccaucgcagaauacagaaaaauccucaacgccuuaaucgcuaaauacggguccguccacaaaauccacaucgagcuaaccagagacgucggcaaaaacuuccaagaaagagagaaauacaagaaagagaucgagucaaacuacaaagcgcgaguacaagccaugcaggaaugcgagaaacuaggccucacacugagugagggaaacauccuaaaacuacgccucuuccgagaacaaaacgaaaucuguguauauucaggccgcaaaauaacccuggccaaccucaaagaacaaggagcccuggaaauagaccacauacucccauacagccgcucaagcgacgacucuuacaugaacaaagugcuaguguuuaccaacgaaaaccagaacaaaggaaacaaaaccccauacgaggcauucggcggagacagccagaaauggggagagauagagagccuagcccucagauccggauaccccaagaagaaagccaaacguauccucgacaaaggcuucggggacagggaagccggauucaaaucacggaacaucguagacagcggcuacaucgcgcgacuaaucgccaacuacacaaaagaauaucucaaauuccuaccacuagacagccacgaaaacaccgcccugauugccggugaaaaagauuccaaaauccacgucgaagcagucaagggcaugcucacugcgacaaugaggcacuucugggggcucggcuccaaaaaccgcuacgaacacacacaccacgccgucgacgccauuaucaucgcauauaucaaugccgccaugauacagcgauucucccaguucagacaaaaccaagagucacuaaaggccagauucuaugccaaagaacuagcaaaagaagaguucaagacccaacgagcuuucuucgaaccuuucagaggguuccgagaacaaguacucgccaaagucgggcagaucuucgucucgcgucccccgcgcaagcgcgcccgcggcgcacuacacgaggagaccuucuacuccaucgacgauaagaaacugagcgagacuuacgggggcaaagaaggcguacaacgcgcgcucagccugggcaagauacgccaaauugguacuaagauagucgcaaacggccccauggugagggucgacauauucaaacacaaacagucccggcgauucuacgcagugcccaucuacaccauggacuucgcccucggaauacuaccaaacaaagcagugguaucaggaaaggacaccaaauccaaagucaucaaagacugguuagagauggauagcugcuacgaguuuugcuuuagccuauucaaagacgaccugaucgaaguccaaaaaucugacauggagaagcccgagcucgccuacuucguaucacucgaugcauccgacggcagaauuaaaguacgccaccacugcaacgacaucacaaaaaucaacgagaaccagaaaaagcuauucucagaagcaaucgagaaagagguugucggccgaggaucaauccaaaaccucaaagucuucaaaaaguacaaaguaagcccccugggagaaauaaaagaagccaaauacgagccccgacaacccaucgcccucaagacgucgccaaagaagcaccgaaagcagaacaacgcacaguga

SEQ ID NO: 6114 - RNA, 3156 nt, Artificial Sequence
  Cas9 variant
augaacaacuacauacugggucucgacauuggcauuacaagugugggauacggaauagucgacuccgacacgagggagaucaaagacgccggcguucgccucuuccccgaagccaauguugacaacaacgagggcaggcgcucuaaacgcggggcccgccgccucaaacgaagacguauucaccgccuagaccgcgucaaacaccuacucgcagaauacgaccuccucgaccucacgaacauacccaagagcaccaacccguaucaaacaagagucaagggacucaacgaaaaacucagcaaagaugaacucgucauugcacuccugcacaucgccaagcgccgcggcauccacaacgucaacgucaugauggacgacaaugauucggggaacgaacugucaaccaaggaccaacucaagaaaaacgccaaagcgcuuuccgauaaauacgucugcgaacuccaacuggaacgcuucgaacaggacuacaaaguccgcggggagaaaaaccgguucaaaacagaggacuucgucagggaagcccggaagcuacuagaaacgcaaucgaaauucuucgaaaucgaccagaccuucaucaugcgguacaucgagcuaaucgaaacgcgacgugaguacuucgaaggcccgggcaaaggaucaccguucggaugggagggcaacaucaagaaaugguucgaacaaaugaugggccacugcacguacuucccggaggaacuccgcagcgugaaauacagcuacuccgccgaauuauucaacgcccucaacgaccucaacaaccucgucaucacccgcgacgaagacgccaaacucaacuacggagagaaauuccaaaucaucgaaaacguauucaaacaaaagaaaacccccaaucuaaaacagauagcuauugaaaucggcguucacgaaacugaaauaaaaggauacagaguuaacaagucaggcaagccagaguucacccaauucaagcuauaccacgaccucaaaaacaucuucaaagaucccaaauaccuaaacgacauacaacuaauggacaacaucgccgaaaucaucaccaucuaucaagacgccgaaucaauaaucaaagagcucaaccaacuaccagaacuacuauccgaaagagaaaaagaaaagauaagugcucucucaggguacucggguacacacaggcucucacucaagugcaucaacuugcugcucgacgaccucugggaguccagccuaaaccagauggagcuauucacgaaacucaaccucaagcccaagaagaucgaccuaucgcagcaacacaaaaucccaagcaaacucguagacgacuucauccuauccccggucgucaaaagagccuucauccaauccauacagguuguaaacgccaucauagacaaauacggccugcccgaagacauaaucaucgaacucgcgcgcgagaacaacucugacgaccgccgcaaauuccuaaaccaacuccaaaaacaaaaugaagaaacgcgcaaacagguagagaagguacuacgcgaauauggcaacgacaaugcaaaacgaaucguucagaaaauaaaacuccauaacaugcaagaaggcaaaugccuauauucacuaaaggacaucccacuagaagaucuccuccgcaacccacaccauuacgaggucgaccacauaaucccgcgguccguagccuucgacaacucaaugcacaacaagguacucguccgcgcagacgagaacagcaagaaaggcaaccgaaccccguaccaauaccuaaacuccucggaaucaucacucucguacaacgaguucaaacaacauauccuaaaccucucgaaaacgaaggacagaaucacgaaaaagaaacgcgaauaccuccucgaagaaagagacaucaacaaauucgauguacaaaaagaguucaucaaccggaaucuaguggacacgcgcuaugccacacgugagcucaccagccuucucaaagccuacuucuccgccaacaaccucgacgucaaagugaaaacaauaaacggaaguuuuaccaacuaccuccggaaagucuggaaguucgacaaagaccgaaacaagggauacaaacaccacgcugaagacgcccucauaaucgcaaacgccgacuuccuauucaagcacaacaagaaacuccgaaauaucaacaaaguccuagacgcccccuccaaagaggucgacaagaaacgagucacaguccaauccgaggaugaauacaaccaaaucuucgaagacacccaaaaagcccaagcaaucaagaaauucgagauacgcaaauucucccacagagucgacaagaaaccaaacagacaacugaucaacgauacccuauauuccacacgcaacaucgacggcaucgaauacguugucgaaucaaucaaagacauuuacuccgucaacaacgacaaagugaaaacaaaauuuaagaaagacccacaccggcuacucauguaccggaacgacccacaaaccuucgagaaauucgaaaagguguucaaacaguaugaaucagaaaagaacccauucgcgaaguacuacgaagaaaccggagaaaagauccgaaaauucagcaaaacuggucaaggaccuuauaucaauaaaauaaaauauuuacgagaacggcuaggcagacauugcgacgugaccaacaaguacauaaacagccgaaacaaaaucgugcaacuaaagaucuacagcuaccgguucgacauauaucaauacggcaacaacuacaagaugaucaccaucuccuacaucgaccuagaacagaaauccaacuacuacuacauaaguagagaaaaguaugaacaaaagaagaaagacaaacagauagacgacagcuacaaauucaucgggagcuuuuacaaaaacgacauuauaaacuacaacggagaaauguaccguguaaucggcguuaaugauucggaaaagaacaagauucaacuagacaugauagacauaucuaucaaagacuacauggagcuuaacaacaucaaaaagacaggcguuauauacaaaaccauaggcaaaucgaccacucauaucgaaaaauacaccacggacauccucggcaaccucuacaaggcugccccacccaagaaaccucagcuuauauuuaaauga

SEQ ID NO: 6115 - RNA, 3159 nt, Artificial Sequence
  Cas9 variant
auggaaaacaaaaauuugcacuacauccucggccuggaccuaggaauagccagcgucggcugggccguagucgaaauagacgagaaagagaacccccuccggcuaauagacguaggcguccguaccuucgagcgcgccgagacccaaaaaggcgagucacucgcacucagcaggcgcucagcccgauccgcaagacgacuuacacaaaggcgcguagcccggcucaaaaaggcgaaacguuuacugaaaucagaaaauauccugcucucaacagacgagagacuaccccaccagguauggcaacuccgagucgagggacucgaccgcaagcuggaacgacaggagugggcagcaguccuacuccaucucauaaaacaccgcggguaccucucccaacgcaaaaacgaaagcaaaagcgaaaacaaagaacuaggcgcacuacuauccggagucgccucaaaccacgaguuauuacagcaagcaacauacaggaccccugcagaacuggccgucaaaaaguucgaaguugaagagggucacauccgaaaccaacagggagcuuauacccacacauucagucggcuagaccuacucgcagaaauggagcuccucuucucccgccaacaacacuucgggaaccccuucgccagcgagaaacuccuggaaaaccuaaccgcccuccucauguggcagaaacccgcccucucaggcgaagauauucucaaaaugcuuggcaaauguacauucgaagacgaauacaaagcggcuaaaaauacuuauaccgcagaaagguucguuuggaucaccaaacucaauaaccuacggauacaagaaaacgggcuagaacgagcgcucagugacaacgaacggcuaaugcucauagaacaacccuacgaaaaagccaagcugacauacgcccaaguccgaucgauccucaaccucucggacgaugccauauucaaaggcguccgcuacucgggagaggauaagaaggccaucgaaacaaaaaccacacucauggagaugaaagccuaucaccaaauacgcaaaguucuagaaggcaauaaucucaaggcugaguggguagcccuaaaagcgaacccgacccuccuagacgaaauaggcaccgccuuuaguuuguacaaaacagacgaagacauaagcgcauaccuagcagggaagcucucacaaccuguccucaacgcccuccuggaaaaccugaguuucgacaaauucauacaacugucgcuaaaggcccucuacaagcuccuaccccugaugcagcaaggucucagguacgacgaagccugcagggagauauacggagaccacuacgguaaaaagaccgaggaaacacaccacuuucucccccaaauccccgccgacgagauacggaacccuguaguacuccgcacacucacccaagcccgcaaggucauaaacggagucguacgccucuacggcucaccggcacggauccacauagagaccggcagggagguaggaaaaagcuacaaagaccggcacgaacuaaagaaacgccaagaagaaaaccgaaaacagagggagaagaccauaagcgaaaucaagacacucuucccaaacuucagcggcgaaccgaaaggcaaggacauacugaaaaugcgccucuacuaccaacagaacgccaaaugcuuauacuccgggaaaccgcucgaacuccaucgccuuuucgagcaaaaguacgucgaaguggaccaugcccuaccccuuagccgcacgugggacgauuccuucaacaacaagguacugguacucgcgaaugaaaaccagaauaaaggaaaccugacacccuucgaauggcucgauggcaaaaacaacuccgaacgauggagaacauucaaggccuuagucgaaacaucggcauuccccuacgcaaagaaacagcggauacuaucacaaaaacucgacgaaaagggauucaucgaacgaaaccucaacgacacacgcuacguagcacgcuuccugugcaacuuuaucgcagacaacaugcaucucaccggagaaggcaaacgcaagguauucgcaagcaacggccagauaaccgcgcugcugagacgccgcuggggccuggcaaaaagcagagaagauaacgaccgccaccacgcacuagacgcaguccucguagccugcagcaccguagccaugcagcagaaaaucacgagguucguacgguucaaagcuggagacgucuucaccggagaacgcaucgacagagaaacaggagaaaucauaccucuucacuucccuacaccauggcaauucuuuaagcaagaagucgagauacgcaucuucagcgacaaccccaagcucgagcuagaaaaccgccugccggaccggccacaagcaaaccacgaguucguccaaccacuguuuguaagcagaaugccaacccgaaaaaugacaggacaaggccacauggaaaccgucaaaagcgccaaacggcucaacgaagggaucucaaugaucaaaaugccccuaaccaagcucaaacuaaaagaucucgaacuaauggucaaccgcgaacgcgaaaaagaccuauacgacgcccucaaaacacggcucgaagcauucaacgacgaccccgccaaagcauucgcagaaccauucaugaaaaaggguggugccaucguaaaaagcguccgcguagaacaaguacaaaaaucaggcguccucguacgccaaggcaacggcguagcugacaacgcgagcaugguaaggguagacgucuucaccaaggaugguaaauacuuccuagugccgaucuacacauggcaagucgcaaaagggauccugccgaacaaagcagugauacaaggaaaagacgaagaggacugggaggacaucgacgacgcaacauuccaguucucacuccaccccaacgaccucaucucagucaagaccaagaaagacgaguuccucggauauuucaacggucuaaaccgacacacaggcggaauuaacauccgcacccacgaccuagaaaaaucaaaaggaaaacaaggcauauucgaaggaaucggcguaaaaauagcucucucauucgaaaaauaccagauugaugaauugggcaaaaacauccggcugugcaagcccagcaaacgccaacccguccgauga

SEQ ID NO: 6116 - RNA, 3159 nt, Artificial Sequence
  Cas9 variant
augaaaaacacgucacucaauuacguucugggacucgaccucggaauaagcucagugggaugggcaguagucgaaauugacgaaaaggaaaauccccuaucccuaaucgacguaggaguacgaacguucgaacgcgcggagacccaaaagggcgaaagccuagcccucgccagaagacucgcacgcagcgcccgcaggcucacccaacgacgcguagcaagacugaagaaggcaaaacgccuccuuaaauccgagaacauccuccugaguaccgacgaaugccuuccgcaccaaguauggcaacucaggguagagggucucgaacgcaagcucgaacggcaagaaugggccgccgugcugcuccaccucauaaaacaccggggauaccucucccagcguaaaaacgaaagcaaauccgagaacaaagaacucggcgcacuccuauccggggucgcaaacaaccacaagcuccuccaacaaacaaccuacaggacaccagccgaacuagccgucaagaaauucgaagucgaagaaggacacauccgcaaccaacaaggauccuacacgcacacguucagccgacuugacuugcuguccgaaauggaacuccuauucucgaggcagcaacacuucggaaacccauucaccuccgaaaaacuacucgaaaaccugacagcacuccuaauguggcaaaaaccugcacucagcggggacgccauccuuaaaaugcucggaaaaugcacuuucgaaaacgaauacaaagcagcaaaacacacauacucagcagaacgauucaucuggauaacaaagcucaacaaccuccgaauacaagaaaacggauuagaaagagcacucaaugauaacgaacgccucgcacuaaugaagcaacccuacgaaaaagcaaagcuaacguacgcccaaguacgcagcauccucaacuuauccgacgaagcgauauucaaaggacuacgguacagcggcgaagacaagaagacgagcgagaccaagaccgugcuaauggaaaugaaagcauaccaccaaauccgccuagcccucgaaaagaacgaccugaaaaccgaaugggccgaacucaaagucaacucgucauuacucgacgaaauaggcacagccuucucacuguauaaaaccgacgaagauaucagcaccugucuagcgggcaaacuaucccaaccaguguuaaacgcacuucuagaaaaccuuaacuucgacaaauucauucaacucucucuaaaggcccuacacaagauacugccgcucaugcaacagggacuccgauacgacgaagcaugcgcagaaauauacggcgaccacuacgggaagaaaaccgaagaaaaccaucuucugcucccacaaauuccagcagacgaaauccgcaacccgguuguccuacggacccuaacucaagcacgaaagguaaucaacggagucgugagacuguacagcucaccagcaaggauccauaucgaaacuggacgagagguaggaaagagcuaucaggaccguagagagcuagaaaagcgccaagaagaaaaccggaagcagcgcgaaaaagccaucagcgagauaaaaacccucuucccaaacuucucgggggagccaaaagccaaagacaucuuaaaaaugcgucuguacuaccaacaaaacgcuaaaugccuauauagcggaaagccccuagaacuccaccgucuccuugaacaaggauacguagaaauagaccacgcccugcccuucagccgaacaugggaugacagcuucaacaacaaaguccucguccuagccaacgagaaccaaaacaagggaaaccucacaccuuuugaauggcuggacggcaaaaacaacagcgaacgauggaaggccuucaaggcccuagucgaaacauccgccuuccccuacaccaagaaacaacgcauccuaucccagaaacucgaugaaaagggcuucaucgaacgcaaccucaacgacacacgauauguagcgcguuuccugugcaacuucauagcggacaacaugcaccucacgggggaaggaaaacgcaaaguuuuugccuccaacggccaaauaacggcgcuccuacgcggcagauggggacucgcuaaauccagagaggacaacgacagacaucacgcccucgacgcaguagugguggccugcaguaccgugucuaugcaacagaagaucacgcguuuugucagauucgaagaaggcaacgucuucacgggcgagcgcaucgaccgcgaaacaggcgaaaucauaccgcugcacuuccccgccccguggaaauucuuccgugaagaaguggaaauacgaaucuucagcgauaaccccaagcuagagcuggagaaccgacugaucgcacgcccccaagcgaaccacgaguucguacagccacuauucgucagccgcaugcccaccagaaagaugacaggccagggccauauggaaaccauaaaaucagcaaaaagacuaaacgaaggacucagugugauaaaaaugcuccugacgaagcuccggcucaaagaccucgaaagcaugguaaaucgagaaagagaaaaagaacuguacgaagcccucaaagcgcgccucgaagcguucaacgacgaacccgccaaagccuucgccgaacccuucaugaagaaaggcggagcuaucgucaaaagcgugcgagucgaacagguccagaaauccggcguccucgugagggacggcaauggcguggccgacaacgcaagcaugguacggguggacguauucacaaaagggggaaaauacuucuugguacccauauacaccuggcagguagcaaaaggcauccuaccaaacaaagcugugauacaagguaaaaacgaagaagacugggaaguuauggacgacgcaacauuccgcuucagccuacaccaaaacgaccuagucaagcuggugacaaagaagaaaacaauauucggcuacuucaacggccuaaaccgugcaacagggaauauagacauaaaagaacacgaccuagagaaaagcaaagugaaggauggaauccaccaaagcauaggaaucaaacuggcccuauccuucgaaaaauaccaagucgacgaacugggcaaaaacauacgccuaugcaaaagcagcaagcgacaagccguccgguga

SEQ ID NO: 6117 - RNA, 3159 nt, Artificial Sequence
  Cas9 variant
augauaggcgaacacguccgcggaggcugccuguucgacgaccacuggaccccaaacuggggagcguuuagacucccgaacaccgucagaacauucacuaaggccgaaaacccaaaagacggaagcucccuagcggaaccacgccgacaagcgagaggacuacgaaggcgacuacgccgaaaaacgcaacgacuagaagaccugagacgccuacuugcaaaagagggaguacuaagccucagcgaccucgaaacacuauuccgagaaacacccgcaaaagacccuuaccaacuacgcgcagaaggccucgaccgcccacugucguuccccgaauggguaagaguccuauaccacauaacgaaacaccgaggauuucaauccaaccgacguaaccccgucgaggacggacaggaacgcucacgccaggaagaagaaggaaagcuauuaagugggguaggcgaaaacgaacgucuacuccgugaaggaggauacaggacagccggcgaaaugcuagcaagagacccuaaauuccaagaccaccgacguaaccgggccggagacuacucgcacacacuaagccggucccuacuguuagaagaagcacgaaggcucuuucaaucccaaagaacacuaggcaacccucacgcguccagcaaccuagaggaagcauuucuacaccucgucgccuuccaaaauccguucgccuccggagaagacauaagaaacaaagccggacacuguagccuagaaccggaccaaauacgcgcaccaagaagaucugccuccgcagagacguucaugcuccuacagaaaacgggcaaccuacgccucauccacagacgaacaggggaagaacggccacugacggauaaggaacgagaacaaauccaccuacucgcguggaaacaagaaaaagugacccauaaaacacuacggcgacaccucgaaaucccagaagaguggcuauucacgggacuaccauaccacagaucuggcgacaaagcagaggaaaaacuauucguccacuuagcgggcauucacgagauccggaaagcccuugacaaagggcccgacccagccgucugggacacgcuacgaucgagacgagaccuacuggacuccaucgccgacacccucacauucuacaaaaacgaggacgaaauacucccccgacuagaaagccucggacuaagcccagaaaacgcuagagcccuagcaccccuuagcuucagcggcacugcgcaccuaucccuauccgcccuagguaagcugcucccccaccuagaagaaggaaaaucauacacacaagcccgcgccgacgccggcuacgccgccccaccgcccgaccggcaccccaaacuaccuccccucgaagaagccgacuggcggaaucccgucguauuccgcgcacuuacacaaacccgcaaagucgucaacgcccuagucagacgguacggcccaccauggugcauccaucucgaaaccgcucgagaacugucucaacccgcaaagguacgaaggcgcaucgaaacagaacaacaagcuaacgaaaagaagaaacaacaagccgagcgagaauuuuuagacauaguaggaacagccccagggccgggggaccuccucaaaaugcgccuauggcgagaacaaggagguuuuugccccuacugcgaagaauaccucaauccaacccggcucgccgaaccgggauacgcagaaauggaccacauccuuccauacaguagaucacucgacaacggguggcauaacagaguccucgugcacggaaaagacaaccgcgauaagggaaaccgcaccccguucgaggcauucggaggagauaccgcacgcugggaccggcuggucgcuugggugcaagcaagccaccuaagcgcacccaaaaagcgcaauuuauuaagggaagacuucggcgaggaagcagaacgcgagcuaaaagaccgcaaccucacugacacgagauucaucaccaagaccgcggccacccuccuacgggaccgucucaccuuccaccccgaagccccgaaagacccgguaaugacacuaaacggaagacucacagccuuccuccgaaaacaauggggccuacacaaaaacagaaagaacggcgaccugcaccacgcacucgacgccgccguccuagccguagcgucccgcuccuucguauaccgacugaguagccacaacgcggcguggggagaacuaccaagaggccgagaagcagaaaacggcuucagccuaccauaccccgcauuccgcucagaaguauuagcacgucugugcccgacuagagaagaaauacuccuacgauuagaucaaggaggcguaggauaugaugaggcguuccgaaacgggcugagaccaguauucgucagccgcgcaccaagccggcgccugaggggcaaagcacacauggaaacacuccgauccccaaaauggaaagaccacccagagggcccccggacagccucacgcauuccgcucaaagaucugaacuuagaaaaauuagaacgaauggucggcaaggaccgagaccgaaagcuguacgaagcacuucgugagcgccucgccgcuuucggaggaaacggcaagaaagcauucgucgccccauucagaaaaccaugccgaucaggcgaaggaccacucguacgcucccuaagaaucuucgacagcggauacagcgggguagaacuucgcgacggaggagaagucuacgcaguagcggaccacgaaucaauggucagaguagacgucuacgccaaaaagaaucgcuuuuaucucguccccguauacguagcugacguagcccgcggcaucguaaagaacagagcgauuguugcccacaaaagcgaggaagaaugggaccuaguagauggcucguuugacuuccguuuuagccuauuccccggagaccucgucgaaauagagaaaaaggacggggcauaccuaggauacuauaaaucgugccaccggggcgacggccgccuccuacuugaccggcacgacagaaugccacgagaauccgacugcggaaccuucuacgugucaacccgcaaagacguacuaaguaugucaaaauaccaaguagacccgcucggcgaaauccgccuaguaggaagcgaaaaacccccauucguauuauga

SEQ ID NO: 6118 - RNA, 3162 nt, Artificial Sequence
  Cas9 variant
augaaacgcaacuacaucuugggccuagacaucggaauaaccagcgugggcuacggaauaaucgacuacgagacccgugacguaaucgacgcagggguacgucucuucaaagaggcaaacgucgagaacaaugaaggccgaagguccaaacgaggggcccggcgccugaagcgacgccgccgacacaggauccagcgcgucaagaaacuccucuucgacuacaaccugcugacagaccacagcgaauuguccgguauaaacccauacgaggcacgcgugaaaggacuaucccaaaaacucagcgaggaggaguucagcgcugcacugcuccaccucgccaaacgccgugggguccauaacgucaacgaaguugaggaagacaccgguaaugaacucagcacaaaagagcaaaucucccggaacagcaaagcccucgaggagaaauacgucgccgaacugcagcuugagcgccucaagaaagacggggaagucagagggagcauaaaccgguucaaaaccagcgacuacguuaaagaggccaaacaacuccucaaaguccaaaaagcauaccaccaacucgaccagagcuucauugacacguacaucgaccuacuggaaacccgccgcacauacuacgagggacccggagagggaucucccuucggauggaaagacauaaaagaaugguacgagaugcucaugggucacugcaccuacuucccggaggaacuacgcucagucaaauacgcauacaacgccgaucuauacaacgcccucaacgaccugaacaaccucguaaucaccagagacgaaaacgagaaguuagaauacuacgagaaauuccagaucauagaaaaugucuucaagcaaaagaagaaaccaaccuuaaaacagaucgccaaagaaauacucgugaacgaggaggacaucaaaggauaccgcgucacauccaccgggaaaccggaguucacaaaccuaaaagucuaucaugacaucaaagacaucacagcgcgcaaagaaauaaucgaaaacgcugaacugcucgaccaaauagccaaaauacuaaccauauaccaauccagcgaggacauccaagaagaacuaacaaacuuaaacucagaacuaacccaagaagaaaucgaacaaaucucaaaccucaagggauacacggguacgcacaaccucagccucaaagcaauuaaccucauccuagacgaguuauggcacacaaaugacaaccaaauagccauauucaaccgacucaaacucgucccuaaaaaggucgaccucucacaacaaaaagaaauaccaacaacccucguagacgacuucauccuaagcccagucguaaaacggaguuucauucagagcaucaaagugauaaacgcaaucaucaaaaaguauggccugccaaaugacauaauaaucgagcuggcgagagagaaaaacagcaaagacgcacagaaaaugauaaacgaaaugcagaaaaggaaccggcaaacuaacgagcgcauagaagagaucauccgaaccacaggcaaagagaacgcaaaauaccucaucgaaaagaucaaacuacacgacaugcaagaagggaagugccuuuacucccucgaagccaucccacucgaggaccuacuaaacaacccauucaacuacgaggucgaccacaucaucccaaggagcgucaguuucgacaauagcuucaacaacaaagugcuggucaaacaagaagaaaacucaaagaaaggcaaccggaccccauuccaguaccuaagcuccuccgacagcaaaauuagcuacgaaaccuucaagaaacacauccuuaaccucgcaaaggggaaagggcguaucucaaaaaccaaaaaggaguaucuacucgaagaacgagacaucaaccgauucuccguacagaaagacuucauaaaccgcaaucucgucgacacacgauacgcaacacgaggccucaugaaccugcucagauccuacuuuagggucaacaaccuggacguaaaagucaaaagcaucaacggcggcuucaccuccuuccuccgccgaaaauggaaguucaaaaaggagcgaaacaaaggguacaagcaccacgccgaggaugcccuuauaaucgccaacgcggacuuuaucuucaaagaauggaaaaagcucgauaaagcaaagaaagucauggaaaaccaaauguucgaggaaaaacaagcggaaaguaugcccgagaucgaaacagagcaggaauacaaagagaucuucauuacaccccaucagaucaagcacaucaaagacuucaaagacuauaaauacagccacaggguggacaagaaacccaaccgcgagcuaaucaacgacacacuauacucaacacggaaagacgacaaaggaaacacccuaaucgucaacaaccuaaacggccucuacgacaaggauaacgacaaacucaagaaacucauaaacaaaagucccgaaaaacugcuaauguaccaucacgacccccagacguaccaaaaacugaaacucaucauggaacaauacggcgaugagaaaaacccccuauacaaauauuacgaggaaacaggcaacuaccuaacuaaauacuccaagaaagacaacgggccggugauaaagaaaaucaaauacuauggaaacaagcuaaacgcccaccuggacaucaccgacgacuacccgaacucacgcaacaagguaguaaagcucagccugaagcccuaccgauucgacguuuaucucgauaacgguguauacaaauucguaacugucaaaaaccuggacguaaucaagaaagagaacuacuacgaaguaaacaguaagugcuacgaggaagcgaagaaacucaagaaaauaucaaaccaagccgaguucaucgccagcuuuuacaacaacgaccuaauaaaaaucaacggugaacuguaccgagucaucggcguaaacaacgaccuacucaacagaaucgaaguuaacaugauagacauaaccuaccgagaauaccuagaaaacaugaaugauaaacgcccgccccgcaucaucaaaaccaucgccaguaaaacccaaaguauaaagaaauacuccaccgacauacucggaaaccucuacgaagugaaaucgaagaaacacccacagauaaucaagaaaggguga

SEQ ID NO: 6119 - RNA, 3162 nt, Artificial Sequence
  Cas9 variant
augaagcgcaacuauauccucggcuuggacaucggcauuacauccguaggauacggcaucaucgacuacgaaacacgcaacgugauagacgcugggguccggcuauucaaagaggcuaacgucgagaacaacgagggccgcaggagcaaacguggcacacgacgccucaaaagacgccgacggcaccgccuccagcgggucaaaaagcuccuguuugaccacaacuuccucacagacaacuccgaacucagcggcaucucgccauacgaggcaaggguaaaggggcuaaaccaaaagaucuccgaggaagaguucagcguggcacuccuucaccuggcaaaacgcagggguguucacaacguaaacgaaguagaagaagacacgggaaaugaacucagcaccaaggaacagauaagcagaaacucaaaagcccucgaagaaaaauacgucgccgagcuccaacuagagcgacucaaaguagacggagaagucaggggcgccgugaacagguucaaaacaagcgacuacguaaaagaggcccagcaaauacuaaagguacaaaaggcauaccaccaauucgaucagagcuucaucgacacauacaucgaccugcuggagacgcggcguacauauuacgaaggcccaggggagggcuccccauucggcuggaaggacauaaaagagugguacgaaaugcucaugggacagugcaccuacuuccccgaagaacuccggucggucaaguacgcauauaaugccgaccucuacaaugcccucaacgaccugaacaaccucguaauugcccgugaugagaacgaaaagcucgaauacuacgaaaaauuccaaaucaucgaaaacgucuucaagcaaaagaagaaaccgacccucaaacaaaucgccaaagaaauccuaguaaacgaggaagacauaaagggguaucgcgugacuagcaccgguaaacccgaguucaccaacuucaagguauaccaugacauaaaguccauaacaucucgcaaggaaauccucgaaaacgcggaacugcuaaaccaaauagccaaaauacucaccaucuaccagagcucggaagacauccaaggcgaacucgcccgacuauacagugaguugacucaagaggaaaucgagcaaauaucgaagcucgcaggauacacagguacacacaggcuaucacucaaagccaucaaccucauuauagacgaacucuggcacaccagcgacaaccagauggaaauauucaaccgacuaaaacuugugccaaagaaggucgaccucucccaacaaaaggagauuccaacaacgcuaguugacgacuucauccucagccccguaguuaagagaucauucauccaaagcaucaaagugaucaacgccauaaucaaaaaguacggauucccgaaugacauaaucaucgaacucgcccgcgagaaaaauuccaaggaugcccaaaaguucaucaacgaaaugcagaaacgcaaccgacaaacaaacgaacgcauagaggagauuauccgcacuacaggcaaagagaacgccaaguaccuaauagaaaagauuaaacuccacgauaugcaagagggaaaaugccucuacagccuggaggcaauaccgcucgaagaccuacucaacaacccauucaauuacgaggucgaccauaucaucccccgcagcgucagcuucgacaacucuuucaacaacaaaguacuggucaaacaggaggaaaacagcaagaaaggcaaccgaacaccauuccaauacuuuucaagcagcgacucaaaaauauccuacgagauuuucaagaaacacauacuaaaccucgcuaaaggcaaaggacgcaucucuaaaaagaagaaagaauacuuacucgaggaacgcgacauaaaucgcuuuucgguccaaaaauacuucaucaaccgcaaccucgucgacacacgauacgccacccgugagcucaugaacuuacuccgcagcuacuuccgcgucaacgaucuggacauaaaagugaaauccaucaauggaggguucaccucguuccuccgcaagaaauggaaauucaagaaagagcgaaacaaaggguacaaacaccacgccgaagacgcccuaauuaucgcaaacgcagacuucaucuucaaagaauggaagaaacuugacaaaacaaacaaagugauggaagaccaaaucgucgaagaacaacaggccgaaagcaugcccgaaaucgagacagagcaagaguacaaagaaaucuucauuacaccccaucagauccaagacauaaaagacuuuaaagacuacaaauacucccacagggucgacaagaaaccuaaccgggagcuagucaacgauacccuguacagcacccgcaaagacgauaaaggaaacacacucaucgucaacaaucucaaaggccucuacgacaaagacaacgacaaacucaagaaacuaauaaacaaauccccagaaaaacuccucauguaccaccacgacccacaaacauaccagaagcugaaaguuauaauggagcaauacucgaacgaaaagaacccccuuuacaaauaccacgaagaaacaggcaacuaccucaccaaauauagcaaaaaggacaacggcccagucauaaagaaaaucaaauacuacggaaacaaauuaaacguauaccucgacaucacccgugacuaccuuaaaucaaggaacaaaaucguuaaacugucccucaaaccguaccgcuucgaugucuaccucgacaacggcgucuacaaauucgucaccguuaaaaaccuggacaucaucaagaaagaagacuacuacgaaguagacagcgauucuuacgaggaggccaagaucgugaagaaagucucagagcaagcccaauucgucgccucguucuacaauaacgaucuaauaaaaguagacggcgaacucuucagagugaucggcguaaacaacgaccuccucaaccgcaucgaagugaacaugguggacauaacauauaaagaauaccuagagaacauaaacgacaagaaaagcucaagaauaaucaaaaccaucagcaguaaaacacagucaaucaagaaauacagcacagacauccucggaaaccucuacgaagcaaaaagcaaacaacgcccacaaaugaccaugaaaggcuga

SEQ ID NO: 6120 - RNA, 3162 nt, Artificial Sequence
  Cas9 variant
augaaacgcaacuacauacucggucucgauauuggcauuaccucagucggcuacgggaucaucgacuaugaaaccagagacgucaucgacgccgggguccgccucuucaaagaggcuaacguggaaaacaacgaaggccgccggagcaagagaggcgccggccgccucaaacgcagacgccgccacagacuccagcgagugaagaaacuccucuucgacuacaaccuccucaccgaccacucggaacuauccgguauaaacccauacgaggcccgagucaaagggcucagccaaaaacuaucugaagaagaguucucagccgcacuccuccaccucgccaaacggcgcgggguucauaacgucaacgaagucgaagaagacacaggaaacgaacugagcacaaaagaacaaauaucgcgaaacagcaaagcgcuugaagaaaaguauguggccgaacuccaacuagaacgccucaaaacugacggagaagugcgcggcaguauaaauagguucaagaccuccgacuacguuaaagaagccaaacaacugcuaaaagugcaaaaagaauaccaccaacucgaccaauccuucauugacacguacauagaccuacucgaaacgcgcagaaccuacuacgagggaccaggcgaaggcuccccguucggcuggaaggacaucaaagagugguacgagaugcugaugggucacugcacuuacuucccagaggaacuucgaucggucaaauacgcuuacaacgcagaccucuacaacgcacugaacgaccuaaacaaccuggucauagcccgcgaugagaacgagaagcucgaauauuacgaaaaauuccagaucaucgaaaacguguuuaaacaaaagaagaaacccacccuuaaacaaauagaaaaggaaauccucgugaacgaagaagacaucaaaggguaccgcgucacauccacaggcaaacccgaguucaguaaccuaaaaguguaucacgacaucaaagauaucaccgcgcgaaaagaaaucaucgaaaaugccgaauugcucgaccaaauagcagaaaucuuaaccaucuaccaaucaucggaagacauccaagaagaacucguaaaacucaacagcgaacucacccaagaagaaaucgagcagaucuccaaccucaaaggauacacgggcacccauaaccuaagccucaaagcaauaaaccucauccucgacgagcuauggcacacaaacgacaaccaaauggcgauauucaaccgucucaaacucgucccgaaaaagguagaccuaagccaacagaaagaaauaccaacaacccucguggacgacuucauccucucacccguugugaagcguagcuucauccaauccauaaaagucaucaacgccaucauuaagaaauacggccuacccaacgacauaaucaucgagcuugcaagagagaaaaacagcaaagacgcacagaaaaugauaaacgaaaugcaaaagcgaaaucgacagacaaacgaacgcauagaagaaaucauccgcacaaccgggaaagagaacgccaaauaccucauagagaaaaucaagcuccacgacaugcaagagggaaaaugcuuauacucccucgaagccauaccccuggaggaccuccucaacaacccauuuaacuacgaagucgaccauaucaucccaaggagugucagcuucgacaacucauucaauaacaagguccuaguaaagcaggaagaaaacuccaagaaaggcaacagaaccccauuccaauaccucagcagcuccgacagcaaaaucagcuacgaaacauucaaaaagcacauacugaaccuggcgaaggggaagggacgaauaaguaaaaccaagaaagaauaccugcuggaagaacgcgacaucaaucgcuucagcguccaaaaagacuucauaaaccggaaccucguagacacccgguacgcuacacgggagcuaaugaaccuguugcgaucauacuuccguguaaacaacuuagacgucaaagucaaaucaauuaacgggggauucaccuccuuccuaagacgaaaguggaaguucaagaaagaacgaaacaaaggauacaaacaucacgccgaggacgcccugaucaucgcgaacgccgacuuuaucuucaaagaauggaaaaagcuagacaaagccaaaaaggucauggaaaaccaaaccgucgaagaaaaacaagcagagucuaugucggagaucgagacggaacaagaauacaaagaaaucuucaucacgccccaccagauccaacacaucaaagacuucaaggacuacaaauacucacacagaguagacaaaaagccaaaccgugaacuaauaaacgacacgcucuacuccacccgcaaagacgacaagggaaacacccucaucguaaacaaccuaaacggccucuaccauaaagacaacgacaaacucaagaaacugaugaacaaaucacccgagaaacuccucauguaccaccacgacccccaaacauaccagaaacuaaaacucaucauggaacaauacggcgacgagaaaaacccccucuacaaauacuaugaagaaaccgggaauuaccuuacaaaauacucuaagaaagacaacggaccagucaucaagaaaauaaaauacuacggcaacaaacucaacgcccaccuagacauaacugaugacuaccccaacucacggaacaaagucguaaaacucagccuaaaaccguaccgauucgacgucuaccuagauaacggcgucuacaaauuuguaaccgucaaaaaccuaaauguaauuaagaaagaaaacuauuacgaaguaaacucgaaaugcuacgaaaaagcgaagaaacuuaagaaaaucagcgaccaagcagaguuuauagccuccuucuacaacaacgaccucauuaaaaucgacggcgaacuauaccgcguaaucggagucaauaccgaccugaucaaucgcauagaagucaacauggucgauauaaccuaccgggaauaccuugagaacaugaacgacaaacggucaccccgcaucuucaaaacaaucgcuagcaaaacccagagcaucaaaaaguacagcaccgacauucuaggcacccucuacgaggugaacagcaagaagcacccccaaaugaucaugaaaggcuga

SEQ ID NO: 6121 - RNA, 3162 nt, Artificial Sequence
  Cas9 variant
augagcggaaugguguucggcauagaccuaggcauagcaagcuguggaugggcaguauuaagacaaccacaaagagacggagacccaggagaaaucguagaccuagggucauggauguucgauguacccgagacagacaaagagcgaaccccaaccaaccaggugcgcagaggaaacagacugcuaaggcgggugauccggcgacgagcucaaagaaugguggagauccgccgacucuuccacgaccacggacuacuggcaggucacgcacccgaagcacugaaaagagcggggcuagacccaugggacuuaagggccagaagccucgacaaggugcuggaaccggccgcccuggcagucgcgcucggccauauagcgaaaagacgaggauucaaaagcgcagcccggaggaaagaagcaaacacggcgggagacgaccagaaaaugcugaaggcccuagaagccacacacgaaagacuagggcgcuaccgcacgauaggcgagauguucgccagggauccagacuucgaaaguaggaaaagaaacagggacgggauguucgacagaacgcaaggacgggacgaccuccuacacgagguaggggaaauauucaaagcacagaggagacugggcucggcccuagcgacagcagagcuggaacaagccuucacagcaauagcauuccgacaacucccgauccaagacagcgaaaggcuaguaggacuaugccaauucgaaccgaaggagaaaagagcagccagauucgcacccagcuucgaacgauucaggcugcugcaaaggcucacgaaccuuagaguaguuacggucgaaggggaacgaccgcuaacagcagacgaaauagcagccgccgcggcagaccuagggcgaacagccaaacuaucgguaaaagaaguacgaaaacgcauaggacucgccgccgaucaccgauucgcagcguucaaagcggaugaagaggaccgagacauaaucgcccggacaggagaagcgcuccacggaacguacagacuaagaaaagcucucggcgagggacugugggccgagaugcugccaggacagcuggaugcaauagcacacgcacucagcuuuuucgaaacgcaagauguaauacugaaagaguuagacaagcuagaccucccugcaggagucagggacgcgauagccacuggacucgacgcaggcgcauucgcgagauucaagggaacgggacacaucagugcaagagccgcaagagcguuacuaccgcaccuggaggcaggccucagauacgaccaagccugcacgaaagcaggauaugaucacgcagcaagccgaugggcaaaaagggagcaaguugcagauaaagcagcauucaacaggcuaguaacugauaugggagcagaaauagcaaacccgauagcaagaaagagccuaacagaggcguugaaacagcuaugggcgaugagaaaucgaugggggcuaccugacgcaauacacauagaacuagccagagacguaggaaacagccuagagaaaaggagggaaauagaaagggcaaucgagaaaaacaccgcggcccgcgaaagagaaaggggagaagcaagagaccuccuaggcauagacgacguguccggcgauacacugcucagauacagacuuuggaaggaacaagcagggaggugccccuauacggaugcccccaucccacccggcgcgauaauagcgacggacaacagcuuccaggucgaucacauacuaccguggagccgguucggcgacgacaguuucgcaaacaaaguucucugcgcaacggccgccaaccaaaggaagaaagggcaaacuccaugcgaauggauaacagcggcccaaggcgaggaaggaugggcaacuuucguggccaggauagaaggaaacgccgccuucagaggccccaagaaaaggaauuacguacugaaaaacgccaaagaagcagaggaaagauucagagcccggaaucuaaacgacacaagguacgcagcacgacuccuagcagaagcgguaaaacuuuucuacccagaaggggaaaggcaggacaaaggaggaguccgccgcguguucacaagaccaggcggacuaaccgcggcauugagacaugcauggggcguagaagcccucaagaaaagagacggaaaacgaguagacgacgcccgacaccacgcgcucgacgcguuaguagucgcagccauaggagaaggagagguucagagacugacacgaucauaccaagagugggaacaacaaggccuggcccgaccacugcgcagaguagacccgccguggggagacuuccacaguuucagaagagaagucaaagacgcuuacgacggcauauucgucgccaggcccgagaggaggagagcaagaggagaaggacacgcggcgacaauuaggcaaguaagagagcgggauggagcggcugugguguucgaacggaaggcaaucgcggacuuaucagaaaaacggcucgcagacauaaaagacccggaaagaaaccaagcaauuguagaggcgauaagacaauggauaguagacggaagaccggcagacagacuacccagaucaccggccggagaugaaauaagaaaaguucgccucagaacgaaggggaaaccagccguccaagugcgaggaggcgcagcagaucgaggcgaaauagucagaguugacguuuucacgaaacccaauaagaaaggaaagaacgaguucuacuuaguacccauauacccacaucaggugaugaacaaggcggaguggccgaccccgccaaugagagcagugguagcauacaaagacgaaagcgaguggacguuacuugacgagaacuucggauuccuauucucacuguucccaagaaguuacguugaagugacgaaaccgggaggagagguacuauccggauauuuccaaggcauggacagaagcacgggggcgauaagccuauucaaccacagggacucccgaucccuuacugacgacagcggcaacuccacacgcgggauaggagccaaaacacuguugacaaugaagaaguacucaguggaccgcuucggaaagagagcagagguaaaauccgaaguaaggacauggcacggggucgcaugcacguacccaacaccaccaggauga

SEQ ID NO: 6122 - RNA, 3165 nt, Artificial Sequence
  Cas9 variant
augaaacuaaccccgcuaaacuacauacuaggacuagaccuuggcauagcaagcguugggugggcgguagucgaaaucgaugaacaagaaaacccccuuggccucaucgacgucgggguccgcaccuucgaccgagccgaaguugccaaaacaggagagagccuggcccuggcaagacgucucgcccggagcagccgacgacucguaaagcgccgcgcggaccgaauaaagaaaguuaaacgccuauugaaguccgaaaacauucuacucagugcagacgaacagcuaccaaacgacgucuggcagcuccggguuaaaggacuagaucagaaacucgagcgacaagaaugggccgcuguacuacuacaccuacucaaacaccgcggauaucuuucccaacgcaagaaugagucgaaaucagaaaacaaagaacuuggagcacuacgaagcggcgucgccgcuaaccaccagauacuccaaagcgccgaguacagaacccccgccgagaucgcggugaagaaauuccacguugaagagggccacaucagaaaccaacggggagccuacacacacaccuucagcagauuagaccuccuugccgaaaucgaacuacucuucacccgccaaacagaacucggaaacccccacacaagugccaaacuucucgaaaaccuaaccgcccuacuaauguggcaaaaaccggcacucgcgggggaagccauccucaaaaugcucggaaaaugcaccuucgaacccaccgaauauaaagcagcgaaaaacuccuacagcgcagaacgcuucguauggcucacaaaacucaacaaccuccgcauccuggagcaaggagcagaaagagcccuaacagacaacgagcguuucgcucugcuggaccaacccuacgagaaagcgaaguucaccuacgcucaggcacggaccaugcucgccuugcccgacgaagcgaucuuuaaaggcguccgcuaccaaggcgaggauaagaaagcaguugagacaaaaacaauccuaauggaaaugaaagcauaccaccaaauacgaaaagcccuagaaaacgcagaccuaaaggccgaguggaaugaacucaaaaacaacagcgaacuccucgaugacaucggaacagcauucagccuacacaaaaccgaugaagauauaugccgcuaucucgacggaaaacugucggaaagcauacugaacgcccuucucgaaaaccuaaacuucgacaaauuuauccaacucucacuaaaagcccuacaacaaauccucccgcucaugcuccaaggccagcgauacgacgaggcaguaagcgccaucuacggagaccacuacgguaagaaaucggcagagauuaaccgccuacucccaacaauccccgcggacgaaauacgcaaccccgucguucuacgaacacuaacacaagcacgcaaaguaauaaacgcggucguccgccucuacggcucacccgcacgaauccacaucgaaacgggccgggagguaggcaaaaguuaccaagaccgcaagaaacuggaaaaacaacaggaggacaaccggaaacaccgcgaaucagcaguccaaaaauucaaagaauacuucccaaacuucgugggcgaacccaaaggaaaagacauucuuaagaugaggcuguaugaacuacaacaggcaaaaugccucuacuccggcaaaagucuagagcuccaccggcuccuagaaaaaggcuacgucgagguagaccacgcccuacccuucucacgaaccugggacgacucauucaacaacaagguccucguccucgcuaacgaaaaccaaaauaaagggaaccuaacaccguacgaauggcuagacgggaaaaauaacuccgagccguggcagaauuuugucgcgcgcguccagacaucaggcuucucccacacgaagaaacaaagaauacugagucacaaacuugacgagaaaggguucauagaaaggaaccuaaacgacacccgguacguagugcgauucuugugcaacuucaucgccgauaacaugcuucuaaccggaaaagggaaacguaaagucuucgccagcaacggacaaauaaccgcacuacuaaggggaagauggggccuccagaaaguacgugaugacaacgaccgacaccacgcgcucgacgcagucguaguagcaugcuccacagucgcaaugcaacagaaaaucacgcgauucguacgauaugaagaaggcaacguuuucagcggcgagcgcaucgaccgcgagacuggcgaaaucauccccuuacacuuccccaguccaugggcuuucuuccgagaaaacguagagauccgaaucuucucggaaaacccaaaacuagagcucgaaaaccgccucccagacuacccccaguacaaccacgaguucgugcaaccccucuucgugucgcgcaugccaacacgcaagaugaccggacaaggccacauggaaaccguaaaaucagcaaagcgccuggacgaaggacugucaguccugaaaguaccacucacacaacuaaaacugaacgaccuugaacgaaugguaaaucgcgaacgcgaaauggcgcuuuaugaaucacucaagguucgccucgaacaauucgacaacgaccccgccaaagcguucgcagaaccauucuacaagaaaggaggcgcacucgucaaagccgugagggucgaacaaacacagaaaucaggaguccucguccgcgacggaaacggaguagccgacaacgcaagcaugguaaggguggaugucuucacgaaagcuggcaaauacuuucuagucccgaucuacaccuggcaggucgccaaagggauccuacccaacaaagcgguaacagccaacgucgacgaaaucgacuggcucgaaauggacgaaucauaucaauuuaucuucaccauguaccccaacgaccucgucaaaguaaaacuaaagaaggaagaguucuucggauacuauggaggccuagaccgggcgacuggagcuaucgucauaaaagaacacgaccuagaaaaaucgaagggucgccaaggcauauacagaauaggggugaaacucgcgcucucguucgaaaaauaccaaguggacgagcuagggaaaaacauccgccccugccgcccaacuaaacgacaacacguccgcuga

SEQ ID NO: 6123 - RNA, 3165 nt, Artificial Sequence
  Cas9 variant
augagaauccuaggcguagaccuaggaguggccucagucggcugggcacucgugaacgacaaaaacaacaaaauaauagacagcggcguaagaaucuucacccaaucgaccaaccgagaaggaaaaacccuggccgccguccgccgauccuuccgcggcgguagacgcguacuaagucgccggaaacaacgacuaaaucaacugaaaaaguuguucauagcgcacaaacuccuaagcaaauccgaguucaaacaucucuucaacuccaaaaacaggcucgacaucuggcaacuccgcgcgaaaggccuggagcaacagcucaacaacaaagagugggcccgcgugcuauaccacaucgccaaacggagagccuaccagucaaacaggaagucggaagagucgggaaauacagacaaaaagaagguacucuccggaaucagcaaaaacgaaaagaaaaugaacgaacucggcuacaaaacgauaggagaaaugcuguacacggagaaccgauaccccgauaaccgcauuagacgcaauaagaaagaccaguacaaacacagcaucagcagggaccuccucaggaaggaaauugacguccucuucgaaagccaacgagauuucggcaaccaauucgccaccgacggacuaaaggaacacuacaaagacaucgcguucacccaaaggccaaucaaauucaaagccgaccucguagguaaauguacuuucgaaacgcaagaguaccggggcgcaaagaacugcuucuccguugaaaaaucaacacuccuaagcaaaaucaacaacaccgaccuuaucgauaaguccaccggggagaucaagcggcuauucgagaucuccgaguucgacaaacuccuugacaucuucuacucaaucaaagaggugaaauacacaacacuccgaaagcagcucaaaaucaccgacgcguucaaauuuaaacagcucgauuaccaccagaacuucgaguauaagacaaacaucaaggccaaaaucgaagacuucuacaagcucgaggacuggcuaacccccgaacaaaaaguacuccuagaaaaacaaguccucgacgacaagaaagaaaaauucaaaugcuacaaauacagcucaauccgcucgauccuaucccuuuccgagagccaaaaauucaauggggucaaauacgacaccaaagucgaaaacaccguauucgggaaacuaaaugguuaccacuccaucaagaaagagcuaaacaaagaaguuuuugaccuacucuucaucgacaaagacaaauucaacaagauagccgagauacucuccuaccaaaaagacgacaaauccgccacgcaggacuuaaagaaacaagucuucaacgacuucaauauggacaaaaccauagugaacgaagcaaucaacucccuacuaaacauauccuucaguggcuucaacucccucucccucaaagccaucaacaaacuccugcccuaccucugucaaggauuaaaauaccacgacgcuguggcccacucggaauauaaacaccacucccaguucaaagcagccaauccacagcaguaccuacgaccccugaacaaagaagaaaacuaccaaaucaccucgccuaccguaaagcgcgucuucucacaauuccgcaaaguacucaacgcagugaucagaaaacacggcuccuucgaugcaaugcauaucgaaauggcacgcgagcucaagaacagcaaaaagauaaaguucgaaauucagacgggacaaaaagaauaugcacaagagaaagaagccauccgcgucaaauuccuagaaaucuucaaauacgagggcuccggccgcgaccuacucaaacugcgccuauacgagcagcaacacgggaaaugcauauacaguaagaaagaaaucgagauaaacaaacuccucgaggacggauaugucgaaauagaccacauucuaccauggagucggacauucgauaacucacuaaacaauaaagcccucugccugagcgcggagaaucagaacaaagccaaucagacuccguuugaauaccucaccaacuccgacaaaaacagcaaagacuccaaagaguggcaggaauacaagaacuacguaagcucauucgcaggaaucaaacaggccaaaaagcacaagcuccucaacaccacucuaccgccccggcgcgguaacgauuucuccgacgacauaaagaaccccgaguccggauuccucgcacgaaaccuaaacgacacugccuacgccuccagguucaucaagaacuucguacagaaccaucuucaauucucgcagaacgacaccauaaaacagaaaguuaaagugcggucuggcgcacucaccaaccagcucagauacaacuggggcaucgaggaaaagaaucgugauaacaaucuacaucacgcagaagacgccaucauucucgcguucgccacacagggugaaguacaacgcaugucaacaauaagcgcgaaacgcgaagacuucaaauaucagaccgcaaaggagcgcaaaaucaaauuuacgcccccuuucuccgacuucaagucaguccuggacgaauccguaggcgacaucuucgugagcuucgcaccccgccgcaaaaucuccggcgccgcccauaaagccaccaucaagccaaaggacaccggcggaaaguacaaauuucccguaaacaacgggauggcagaaaacggugucauccagcgcguagacgucuucaaaaacgcuaaaaacaaguaccaauucauuguguucuaccccgcagauuucuacaaggacgacuuccccgaacuagaccuaaaagggaacgaaaucgacaagaacguacaauuccucuucucccuguucaaggacgaccuaaucgaguucaagacaaagaaaaccaaaacuaaagacagcaaacaucuccucgcauauuucaaauauauacgaagcgacggaaaaaucgccuuccagcaaaacuacaaagccgaaaucgaacgaaaggaaucggacaacaagaaaggcuacaaagacauccugcuagcaaccggauccggccuggcaucacuaaagaaauaccaggugagcguccucggcgacaucgccgaagucaaaaacgaaaaacgacuaccccugauaaaacaaauguauaaaucaaaacccaaaaagaaauga

SEQ ID NO: 6124 - RNA, 3165 nt, Artificial Sequence
  Cas9 variant
augaaccagaaauucauccugggccuagacaucggaauaaccuccgucggauacggccuaaucgacuacgagaccaaaaacaucauagacgccgggguucgcuuguuuccggaggcaaacguagaaaacaacgaaggcaggcggagcaaacguggcucgcggcgccugaaacgcagacgcauccaccgacucgaacgagugaagaaacucuuagaagacuacaaccuccucgaccagagccaaauaccccaguccacaaaucccuacgccauacgaguuaaagggcuguccgaggcccucucgaaagacgagcuagugaucgcccuacuacauaucgccaaacgccgcggcauccauaagauagacgucaucgacuccaacgacgacguagguaaugagcugucaaccaaagaacaacugaauaagaacaguaaacucuuaaaagacaaauucgucugccagauccagcucgaacggaugaacgaaggccaagugagaggagagaagaaccgauucaagaccgccgauaucauaaaggaaauaauccaacuccuaaacguccagaaaaacuuccaccaacucgacgaaaacuucaucaauaaauacauugagcuaguagagaugcggcgcgaauacuucgaaggccccggaaaggggucaccauacggcugggaaggagacccaaaagcaugguacgaaacccucaugggucacuguaccuauuucccagacgaauugcgcuccgugaaauacgcauacagcgcggaccuguuuaacgcccucaacgaccugaacaaucuagucauccaacgcgacggccucucaaaacucgaauaccacgaaaaauaccacauaaucgaaaauguguucaagcaaaagaaaaagcccacccuaaagcaaaucgcaaaugaaaucaacgucaacccagaagauauaaagggauaccgcaucaccaagucgggaaaaccccaauucacagaguucaaacucuaccacgaccugaaaucuguccuauucgaccaaagcauccucgagaacgaggacguccucgaccaaauagccgaaauccuaaccaucuaccaagacaaggacagcauaaaaagcaaacucacugaacucgacauccuguuaaaugaagaggacaaagagaauauagcccaacucacgggauacacaggaacccaccgccucagccuaaagugcauacgcuuaguacucgaggagcagugguacucuagccguaaccagauggaaauauuuacgcaccuaaacauaaaacccaagaagaucaaccucaccgccgcgaacaagauaccaaaggcgaugaucgacgaguucauccuauccccaguaguaaagcgcacauuuggucaagccauuaaccucauaaacaaaaucaucgaaaaguauggagugcccgaagacauuauuaucgaacuagcucgcgaaaacaacagcaaagacaaacagaaguucaucaacgaaaugcaaaagaaaaacgaaaacacacgaaagcgaaucaacgaaaucaucggcaaguauggaaaccagaacgcaaaacgccucgucgaaaagauccgccuccacgacgagcaggagggcaaaugccucuacagccucgagucaauaccccuagaagaccuccuaaacaauccaaaccacuacgaagucgaccacauaaucccgcgcagcguguccuucgacaauagcuaccacaacaaaguacucgucaagcaaagugagaacucgaaaaagagcaaucucacacccuaccaauauuuuaauuccggaaaauccaagcucucuuacaaucaauucaaacagcacauucucaaccugagcaagagccaagaucgcaucaguaaaaagaagaaagaauaccuacuagaggaacgugacaucaacaaauucgaagugcagaaagaguucauaaaccgaaaccucguagacacccgcuacgccacuagagaacucacgaacuaccucaaggcauacuucuccgccaacaacaugaacgugaagguaaaaacgauaaacggcucuuucacagacuaccuacgaaaaguauggaaguucaagaaagaaagaaaccacggguacaaacaccacgcggaagacgcccucaucauagcaaaugcagacuuccucuucaaagaaaacaagaaacucaaagcgguaaacagcguacuagaaaaacccgaaaucgaaucaaaacagcucgacauacaaguagacucagaggacaacuacucggaaauguucaucauaccgaaacagguacaagacauaaaagauuuccgaaacuucaaauauagccaccgcguggacaagaaacccaaccgacaacugauuaacgacacacucuacuccacucggaaaaaggacaacagcacguauauagugcagacuaucaaggacauauacgcgaaggacaacaccacccugaagaaacaauucgacaaaaguccagaaaaauuccugauguaccaacacgacccccgcacauucgagaaacucgaaguaauaaugaaacaauacgcgaaugagaaaaacccccucgccaaauaccacgaagaaaccggggaauaccucacaaaauacucaaagaaaaacaacgggccaaucguuaaaucccugaaauacaucgggaacaagcuaggaagccaccuagaugucacgcaccaauuuaaaagcucaaccaaaaagcuagucaaauuaucaaucaaaccauaccgguucgaugucuaccuuacagacaaagguuauaaauucaucaccaucuccuaccucgacgugcuuaagaaagacaacuauuacuacauccccgaacaaaaauacgacaaacugaaacucggcaaggcgaucgacaagaacgcgaaauucauagcauccuucuacaaaaacgaccuuauaaagcuagacggcgaaauauacaaaaucauaggcgucaacucggacacccgaaacaugaucgaacucgaccucccagacaucagguacaaagaauacugcgaacucaacaacauaaaaggcgaacccaggaucaaaaagaccaucggaaagaaagugaacucaaucgaaaaacucacgaccgacgugcucggaaacguguucacaaacacacaauacacaaagccccagcuacuauucaaacgcggaaacuga

SEQ ID NO: 6125 - RNA, 3165 nt, Artificial Sequence
  Cas9 variant
augaaacuaaccccacucaacuacauccucggccucgaucucggaauagcaucgguugguugggcagucgucgaaaucgaugaacaagaaaauccucucggccuaauagacguaggaguccgaaccuuugaccgagccgaaguaccgaaaacgggagaaucacuagccuuggcaagacgccuugcccggagcgcaagacgccucguaaaacgacgcgcagaccggaucaagaaggccaaacgccuccucaaagccgaaaacauccuccucuccgcugacgaacaucuacccaacgacguauggcaauuacgcguaaaaggucuggaucaaaaacuggaaaggcaagagugggccgcaguacuccuccaccuccuaaaacaccguggguaccugagccaacgcaaaaacgaauccaagagcgagaacaaagaacugggcgcccuacuuucgggggucgaaacgaaccaccagauucuccagucugcggaguacagaacccccgccgaaaucgccgucaagaaauuccacgucgaagacgggcacauccgaaaccaacgaggcgcguacacgcacaccuucucccggcuugaccuacucgccgagauggagcuacucuuccagagacaaaccgaccucggcaacccccacacgucagccaaacuacuagaaaaccucaccgcacuucucauguggcagaaacccgcccucgcaggagaggccauccuaaaaaugcuugguaagugcacauucgaaccaacggaauacaaagccgccaagaacagcuacuccgccgaacgcuucgucuggcucacaaaacuaaacaaccuacgcauauuagaacaaggcgcagaacgggcacuaaccgacaacgaaagauucgcucuacuagaucagccguacgaaaaagcgaaauucaccuacgcccaggcaagaacgaugcucgcccucccagacgaggcaaucuucaagggcguccgauaccagggcgaagacaaaaaggccguagaaaccaagaccauacucauggaaaugaaggccuaccaccaaauccgaaaagcccuagagaacgccgaccuaaaggcagaauggaacgaauuaaagaacaauucggagcuccuagacgacaucggaaccgccuucucccuacacaaaacagacgaggacauaugcagauaccuggacggcaaacucagcgagucaauacugaacgcguuguuagaaaaccugaauuucgacaaauucauacaacuaucguuaaaagcgcuccaacagauccuaccgcuaaugcuacaaggccaacgcuacgacgaagccgucagugcaauauacggcgaccacuacggcaagaaaagcgccgagaucaaccgccuacuccccacaauaccagcagacgaaauacguaaccccgucguacuuagaacacugacacaggcacgaaaagucaucaaugccguagugcggcuguacggauccccagcaagaauccacaucgaaaccggacgcgaagucggaaaauccuaccaagaccgcaagaaacuagaaaaacaacaggaagacaacagaaaacagcgcgaaagugcagucaagaaguucaaagaguauuucccaaacuucguuggagagcccaaaggcaaagacauacuaaagaugcgauuguacgaacuacagcaagccaaaugccucuacagcggcaagucacuagaacuacacagacuccuggaaaaaggauaugucgaggucgaccacgcacuaccguucagccgaacaugggacgacucauucaacaacaagguccuuguacucgcuaacgagaaccaaaacaaaggcaaccugacgccauacgaauggcuagacggcaaaaacaacucugagcacuggcaaaacuucgucgcaagaguacaaacaaguggcuuuagucacacuaagaaacaacguauccuaagccacaaacucgacgaaaaaggguucauagaacggaacuugaacgacaccagauacguggcacgauuccucugcaacuuuauagccgacaauaugcuacucaccggaaaaggcaagagaaaaguauucgcgagcaacggccaaaucacggcacuccucaggggccgauggggacuccaaaaaguucgagacgacaaugaccgacaccacgcacucgacgcaguaguggucgcaugcucaaccgucgucaugcaacagaaaauaacccgauucguccgauacgaagaagggaacguguucagcggugaaagaaucgaccgcgaaaccggagaaaucauuccccuccacuuucccagcccaugggcauucuuccgcgaaaacguagaaauaagaauauucagugaaaacccgaaacucgaauuagaaaaccggcucccagacuacccgcaauacaaccacgaguucguccagccacuauucguaagccgaaugcccacgcgaaaaaugaccggccagggacauauggagacaguuaaauccgccaaacggcucgacgaaggacucagcguacuaaaagucccgcucacccaguuaaaacuauccgaccuagagcgcaugguaaaccgcgaaagggaaguaacccucuacgaaucccugaaagcgcggcucgaacaauucggaaacgaccccgcaaaagccuucgcagagccuuuccacaaaaagggaggggcaguaguaaaggccgugcgcgucgaacaaacccaaaagagcggaguccuaguaagagacggcaacggcguagcagacaacgccucuaugguacguguagacguguuuaccaagggcggcaaauacuuccuagucccgaucuacacauggcaaguggcaaaggguauacucccgaauaaggcagucaccgccaauguggaugaaauagacuggcucgaaauggacgaaucauaccaauucaucuuuacaauguaccccaacgaccugguaaaaguaaaacucaagaaagaagaguucuucggcuacuacggagggcuagacagagcgacaggcgccauugugauaaaagaacacgaucucgagaaaagcaagggcaagcagggaaucuaccgcauaggagucaagcuggcucuuagcuucgagaaauaccaaguagacgaacuagggaagaacauaagaccaugccggccaaccaaacgucaacacguccgcuga

SEQ ID NO: 6126 - RNA, 3165 nt, Artificial Sequence
  Cas9 variant
augaaagaaaaauacauccucggucucgaccucggcaucaccagcguagguuacggcaucaucaauuucgaaacaaagaaaauaauugacgccggcguacgacuauucccagaagccaacguagauaacaacgaaggcaggcgguccaaaagaggaucccgcaggcucaagcgccggaggauacaccgacuggaacgcgucaaauuacuccucacagaauacgaucuaaucaacaaagaacaaauccccaccuccaacaaccccuaucaaauacguguaaaaggccucuccgaaauacuaaguaaagacgagcucgcgaucgcccuccuacaccucgccaagcgucgcggcauacacaacaucaacgucaguuccgaggacgaagacgccagcaacgaacucagcaccaaggaacaaaucaaccgcaacaacaaacugcucaaagacaaauacgucugcgaaguacagcuccaacgccucaaagagggccagauacgaggagagaaaaaccgauuuaaaaccaccgacauuuuaaaagaaauagaucagcuucugaaaguacagaaggacuaucacaaucucgacauugacuucauaaaccaauacaaagaaaucgucgaaacccgacgcgaauacuucgaaggccccgggcaaggcucacccuucggcuggaacggcgaucuaaagaaaugguaugagaugcucaugggccacugcacauacuucccccaagaacuccgaagcguaaaauacgcauacuccgcagaccuguucaacgcgcucaacgaccucaacaaccucaucauccagcgcgacaacuccgagaaacucgaauaccacgaaaaauaccacauaaucgaaaacguguuuaaacagaagaagaaaccaacgcucaaacagauagcaaaagaaauuggcgucaaccccgaggacaucaaaggcuaccgaaucaccaagagcgguacgccacaauucaccgaguucaagcucuaccacgaccucaaguccaucgucuucgauaaaucaauccucgaaaaugaggccauucucgaccagauagccgagauacucaccauauaccaagacgagcagagcaucaaggaggaacugaacaaacuacccgaaauccuaaacgaacaggacaaggccgaaaucgcaaagcucauuggcuacaacggcacccaccggcucagccucaaaugcauacaucuaaucaaugaggaacuauggcagacuucacguaaccagauggagaucuucaacuaccuaaacaucaagcccaacaaggucgaccuaagugagcaaaacaaaauacccaaggacauggugaacgacuucauacugucaccaguagugaagaggaccuucauccaaagcauaaacguaaucaacaaaguaaucgagaaauacgggauccccgaagacaucauuaucgaauuggcacgcgaaaacaacuccgacgaccgcaaaaaguucaucaacaaccuacagaaaaagaacgaggcgacaagaaaacgcauaaacgaaauaaucggccaaaccggcaaccaaaaugcgaaacgcauuguggaaaagaucagacugcaugaccaacaggaagggaaaugccuauacucucucgaaagcaucgcacucauggaccuccucaacaacccgcaaaacuacgaaguagaccacaucauaccucggagugucgccuucgacaacuccauccacaacaaagucuuagucaaacaaauagaaaauuccaagaaaggcaaccgcacaccauaccaauaccucaauagcagugacgccaaacucucauacaaccaguucaaacagcacauacuuaaccugucuaaaaguaaagaccgaauuuccaaaaagaagaaagauuaccuacucgaagaacgcgacauuaauaaauuugaaguacaaaaggaguucaucaaucgcaaccuagucgacacgcgcuacgccacacgcgagcuuacgagcuaccugaaagccuacuucucggcaaacaacauggacguaaaagugaaaaccauaaauggcuccuucacaaaccaccuccguaagguauggcgauucgauaaauaucgcaaccacggcuauaaacaccacgcagaagacgcgcucauaauagccaacgcggacuuccucuucaaagaaaauaaaaagcuccagaacaccaacaaaauauuggaaaaaccuacgauagagaacaacacaaagaaagugacaguggaaaaagaagaggacuacaacaacguuuucgaaacaccgaaacugguagaggauauaaagcaguacagagacuauaaauucucccaccgcgucgacaagaagcccaaccgccaacucaucaacgacacccuguacuccacgcgaaugaaagacgaacacgacuacaucguccagaccaucaccgacaucuacggcaaagacaacaccaaccugaagaaacaguucaacaaaaacccagagaaauuccucauguaccaaaacgaccccaaaaccuuugaaaaacucucaaucauaaugaaacaauacuccgacgagaaaaacccgcuagccaaauacuacgaagaaaccggcgaauaccucacaaaguacucuaaaaagaacaacggcccaaucguaaagaaaauaaaacuccuugggaauaaagucggcaaucaucuagacgucacgaacaaauaugaaaacucaaccaaaaagcuagugaaacuaagcaucaaaaacuaccgauucgacguuuaccuaaccgaaaaaggauacaaauucguaacuauagcauaccucaacguauucaagaaggacaacuacuacuacauccccaaggacaaguaccaagaacuaaaggagaaaaagaaaaucaaagacaccgaccaauucaucgccucauucuacaaaaacgaucuaaucaaacuaaacggagaccuauacaaaaucaucggagucaacagcgaugacaggaacaucaucgaacuagacuacuacgauaucaaauacaaagacuauugcgaaaucaacaacauaaaaggggaaccucgaaucaagaaaaccaucggcaaaaagaccgaaagcaucgaaaaguucacaaccgauguuuuggggaaccucuaccuacauagcaccgaaaaagcuccccaacucauuuuuaaacggggcuuauga

SEQ ID NO: 6127 - RNA, 3165 nt, Artificial Sequence
  Cas9 variant
auggaaaacaaaaaccuaaacuauauccucggacucgaccucgguauagccagcguaggcugggcaguaguagagauagacgagaaagaaaaccccuuacgacucauagacgucggaguacgcacauucgaacgcgcagaagucccaaaaacaggcgagagcuuagcacucucacgacgccucgccaggagcgcccggcgacucacccaacgacggguggcccgucuaaagaaagcgaaacgccuacuuaagucggaaaauauacuucuauccacagaugaacgacuaccccaccaggucuggcaacucaggguagaaggccucgaccacaaacucgagcggcaggagugggccgccguccuccuccaccucauuaaacaccgcggauaccucagccaaagaaagaaugaaagcaaauccgaaaacaaagagcuaggggcccuacucuccggaguagacaacaaucauaaacugcuucagcaagccacguaccgaagccccgccgagcuagcagucaagaaauucgaggucgaagaaggccacauccgaaaccaacaaggggcguacacacacaccuuuagccgccuagaccuccuagccgagauggaacuccucuucagccgacaacaacacuucggcaacccguucgcauccgagaaacuacuagaaaaccuaaccgccuuacugauguggcagaaacccgcacucuccggcgaagcaauacucaaaaugcucggcaaaugcacuuuugaagacgaauacaaagcagccaaaaacacguauucggcggaacgguucguuuggaucacaaaacucaacaaccuccgcauacaagaaaacggacuugagcgcgcccuaaaugacaacgagcgcuuagcacucauggaacaacccuaugacaaaaacagacuauucuacucacaaguccgcucaauccucaaacucagcgacgaggcaaucuuuaaaggccucagauacuccggcgaggacaagaaggccaucgaaaccaaagccguguuaauggaaaugaaagccuaccaccaaauacguaaaguccuggaaggcaacaaucuaaaagcagaaugggcagaacuuaaagccaacccgacucugcuagacgagaucggaacugccuucagccuauacaagacggacgaagauaucucagcguaccuagccggaaaacuaucccagccgguuuuaaacgcucuccuggagaaccucagcuucgacaaauucauccaacuaucccugaaggcccuauauaagcugcucccccucaugcaacagggacucagauacgacgaggcuugcagagaaaucuacggggaccacuacggcaagaaaacggaagaaaaucaccacuuccugccgcagauccccgcagacgaaauaagaaaccccgucguccuacguacacucacccaagcaaggaaaguaaucaauggaguaguccgccuauacgggucccccgcacgcauccacaucgagaccgggcgugaggucggcaaaucauauaaggaccggagagagcucgaaaaacgucaagaagaaaaccgaaagcaaagggaaaaugccauaaaggaguucaaagaauacuucccccacuuugccggugaaccgaaagccaaagacauacucaaaaugcggcuauauaaacaacagaacgccaagugccuauacagcgguaaaccaaucgaacugcaccgcuuacuugaaaaaggauacgucgaagucgaccacgccuugcccuucucacgaacaugggacgacagcuucaauaacaaaguauugguacuagcgaacgagaaccagaacaagggcaaccucacccccuucgaauggcucgacggcaagcacaacagcgagcgguggcgagcguucaaagcccucgucgaaaccuccgcguucccguacgccaaaaagcaacgaauccuaucccaaaaacucgacgagaaaggauucaucgaacgcaaccuaaacgacacacgcuacguagcacgauuucucugcaacuucaucgccgacaacaugcaccucacaggcgagggaaaacgaaaagucuuugccuccaacggacaaaucacagcgcuacuacgcagccgguggggccucgccaagagccgcgaggacaacgaccggcaccacgcacuagacgcaguggucgucgccugcagcaccguagcaaugcaacagaaaaucaccagauucgucagauucgaagccggagacgucuucacaggcgagcggauagacagagaaacuggggaaauaaucccacuacacuucccaacgcccuggcaauucuucaagcaggaagucgaaauccgaauauucagugauaacccuaaacuugaacucgagaaccgccuaccggaucgaccgcaagccaaucacgaguuuguccaaccccucuucgucagccgaaugccgacaagaaaaaugaccggccaaggucacauggaaacaguaaaaagcgccaaacgccuaaacgaagguauaucagucaucaaaaugccccuaaccaaacugaaacuaaaggaccuagaacugauggucaacagggaacgcgaaaaagaucuauacgauacacuaaaagcccgccuagaagccuucaacgacgaccccgccaaagcauucgcagaaccuuucauaaagaaaggcggagccauagucaaaucgguaagagucgaacagauacaaaagucuggaguguuggucagggaaggaaacggcguggccgacaacgccuccaugguccgagucgacgucuuuacaaaaggaggaaaauauuuccugguccccauuuacaccuggcaagucgccaaggggauacucccaaacaaggcagcaacccaauacaaagacgaagaagacugggaggucauggacaacagcgccaccuuuaaauucagccugcaccccaacgaccucguaaagcuaguaacaaagaagaaaacaauacuaggauacuuuaacggccugaaccgggcaaccggaaacaucgacauaaaagaacacgaccucgacaaaagcaaagguaaacaaggaauauucgaaggugucggcaucaaacuagcgcucucauucgaaaaguaccaaguagacgaacugggaaagaacauccgauuaugcaaaccaaguaaaagacagccaguaagauga

SEQ ID NO: 6128 - RNA, 3168 nt, Artificial Sequence
  Cas9 variant
augaacaacuacauccugggacuagacaucggcaucacaagcguuggcuacggcaucgucgacagcgacaccagggaaaucaaggacgccgggguucgucuguuucccgaggccaacgucgacaacaacgaagggcgccgcuccaaacgaggagcccgccgacucaagcgacgucgaauccaccgacuagaccgcgucaagcaccuccuggccgaguacaaccuccucgaccuaaccaacaucccgaaauccaccaacccauaccagauacguguaaagggccugaacgaaaagcucagcaaggacgaacucguuaucgccuuacugcacaucgccaagcgacgaggcauccacaacgucaauguuaugauggacgacaacgacuccggcaacgaacucagcaccaaagaccagcucaagaaaaacgcgaaagcacugucggauaaauacgugugcgaguuacaacuagagcguuucgaacaagauuacaaaguacgcggcgagaaaaacagguucaagacagaagacuucgucagagaagcacguaagcucuuagaaacccagucaaaauucuucgaaauagaccaaacauucaucaugcgcuacaucgaucucguagaaacacgcagggaauauuuugaggggcccggaaaaggaagccccuuuggcugggaaggaaauauaaagaaaugguuugaacagaugaugggccacugcaccuauuucccggaagaacuccgauccguaaaguacgccuacuccgccgaacuauucaacgcccuaaacgaccugaacaaccucgugauaacacgagacgaggaagcuaaacuaaacuacggcgagaaauuccagaucaucgagaacguauucaaacaaaagaaaaccccuaaccuaaaacagaucgccaaagaaaucggugucuccgaaaccgauauaaagggcuaccgagucaacaagagcgggaagccugaguucacccaguucaaacuguaucacgaccuaaagaauauauucgaagacuccaaauaccugaacgacguacaacuaauggacaauaucgccgaaauaauaaccaucuaccaagaccccgaaaguauaaucaaagaacucaaccuccuacccgaguuguuaagcgaaaaggagaaggagaaaauaagcgcacucuccggauacgccggcacccaccgacugucccuuaaaugcauaaaccuacuccuagacgaccuaugggaaucgagucuuaaccaaauggaacuguucacaaaacucaaccuaaaacccaagaaaaucgaccuuucacagcagcacaaaaucccaaucaagcuggucgacgacuucauccucagcccugucgucaaaagggcguucauccagucuauccaagucguaaaugcaauaauagacaaauacggacuuccagaagacauaauaauagaacucgcccgcgagaauaacagugacgaccgccgcaaauuccugaaucagcugcaaaagcaaaacgccgaaacacgaaaacaaguugaaaaaguccuacgcgaauacggaaacgauaacgccaaaaggauaguacaaaagaucaagcuccacaacaugcaagaaggcaagugccucuacagccucaaggacauaccccucgaggaccugcuaaagaaccccaaucauuacgaaguagaucacaucaucccaagauccguagcauucgacaauucaaugcacaacaaaguacucguccgagccgaagaaaacagcaagaaaggaaaccgcacacccuaccaguaccucaacucuucagaaagcagccucucauacaacgaguucaaacagcacauacugaacuuaucaaaaacaaaagaccggauuaccaagaagaaacgcgaauaucuccuggaagaacgcgacauaaacaaauaugacguccaaaaggaguucauuaaccguaaucuaguagacacccgcuaugccacgcgcgaacucacaucccuccucaaagccuacuucagcgccaacaaccucgacgucaaaguaaaaaccaucaacggguccuuuacgaacuaccuccgcaaggucuggaaauucgacaaggaccgcaacaagggauacaaacaccaugccgaagacgcccugauaauagccaacgccgauuuccucuucaaacacaacaagaaacuacgaaacaucaacaaaguccuugacgcgcccucaaaagagauagacaaaaagcgagucacaguccaaucagaggaugaguauaaccaaauguucgaagacacccaaaaagcucaagcuauaaagaaauucgaaauaagaaaauucucccaccgggucgacaagaaacccaaccgacaacugaucaaagacacacuuuacagcacccgaaacaucgacggcauugaauacguagucgaaucuaucaaagacauauacagcgucaauaacgacaaaguuaaaaccaaauucaagaaggacccccaccgacugcucauguacagaaacgacccucaaacauucgaaaaauucgagaaagucuucaaacaauaugaauccgagaaaaacccauucgccaaauacuacgaagaaacaggcgaaaagauccgaaaguucuccaaaaccggccaaggccccuauaucaacaaaauaaaauaccuacgcgaacgccucggccggcacugcgacgucacaaacaaguacaucaacagucgaaacaaaauaguccagcuaaaaauauacagcuaccgguuugacauauaccaauacggcaacaacuacaaaaugaucacuaucucguacaucgaccucgaacagaaaucuaacuacuacuauauaagccgagaaaaguacgaacaaaagaagaaagacaaacaaauagacgacuccuacaaauucaucggauccuucuacaaaaaugacaucauaaacuacaacggagagauguacagagucauaggcgugaacgacagcgagaaaaacaaaauccaacuagacaugaucgacaucagcaucaaagacuacauggaacucaacaacaucaagaaaacaggcguaauauacaaaacuaucggcaaauccaccacccacauagaaaaauacacgaccgacauccuggguaaucuauauaaggccgcaccgcccaagaaaccgcaacucauuuucaagcgcggcauggaauga

SEQ ID NO: 6129 - RNA, 3168 nt, Artificial Sequence
  Cas9 variant
augaccccaaucucagaaagucuccucuucggguuagacgucggaaucucgaguugcgggugggccguccucaaacacucagacacgacuggccacauagaagcgcuaggaagcuggugcuucaaugcccccgaaacgaagaccgaacgaaccccaaccaaccaaauacgacguucgucacgccuacuacggagagucguaagacgaaggcgcaaccgcaugacagagauccgcaggcuauucgcaagacacggccucauugacaacgaucgucccgacgcacuccgacagccagcaauagacccaugggaaaugcgagggcaaggacucgaccgacaacucacccccgaagaauuugcgguagcucucgcacauaucgcgaaacacaggggcuucaaaaguagugcaaaacgagugaaauccaacgccagcccagacgacuccaaaaugcuagcggcacuagagaaaacaaaagaacucucagcccaauacaggacaauaggagaaauguucgcgcgagacagcgcuuacguccagagaaggcgcaaccgagacggacuauuugacagaaccaucucacgagacgacuugaucgacgaagcaaaaauacucuucgaccgacaaagaaagcuaggaaaccccguagccagcacugaaauagaagaagcauucacacgaauagccuucuggcaaaaccccaugcaagacucaggcguccuaguagccuccugcccauuugaaccaaaagagaaaagaagcagccgcuucagccccagcuucgaacgcuuccgccuccuaugcagacucauuaaccuacgggugaccgacggacccgaagaaagaccccuaacagaagaagaacucagauuagccuacgaacacgccggcaaaacccggaagcucaccgccgccgcaauaaggaaacucauaggacuacgagacgaccaacacuucacuaccauaccacccgagcaggaaaaacaggauauaacuagccgcaccggcgagaccuucgccggaacggccaccuucagaagcgugcucggcgaaucccucuggcgccaacuacuaccacacccugaguggcuagacaaugcagcguggauaaucagcuuccaugaacucacggaaacaauaaucaagaaacugggagaaaucggacuacccguagaggcauacgagcuaaucugcgacgcacuaaagagcgauaaaagucccuucgcaaaauucaaaggagccagcucccuauccgacaaagccguacgcgcacuuauaccauaucuccagcaaggacucaccuacgacaaagccugccaaaaagcugguuacgaucacgccgcaucaagauuuucgggacgugcaacaaucgacaccaaagcgaaauucaacgcccucauggccgaaguacgagacaguaucgccaacccaauagcgaggaaagcacuuagcgaaggaaugaaacaauuaugggccaugcgaaacagauggggccuaccaggggccaucuguaucgaacuagcaagagacguaggcaacucccucgaaaaacgaaaagaaauagaacgcaaccugaaaacaaccgccaaacaaagagcuagagagagagaagaagcgugcgagcugcuuaaccuaaaagaagucagcagcgauauccuacuccgauaccgacucuggaaagaacaaggagguagaugcugcuacagcgggaaaagcauuacccccgacaugcucauggcgcaagacaaccgcauacaaaucgaccacauacuuccuuggagccgguucggcgacgacucauacuccaacaaaggccucugccuagcuaaggaaaaccaggccaagaaaaaccaaacccccuacgaauggauccacgggcaaggcaccacagcacaaaaagagcagugggacaaauucguagccgacgucgagagccggaaaaacacgaaaggccugaaaaagcguaacuucuuguuaaaaggaucgaaagagauugaagaaagauuccggagccgcaaccugaaugacacacgcuacgccgcuagacucaugguagaagcggcaagacuccucuacccugcaggccaacgcggcgaaaaaggaggcacacgacgcgucuucacaagaccaggcgcacugaccgccgcacuucggcacgcauggggcgucgaaucccugaaaaagauagauggggaaagacuccacgacaaccgccaccacgcccuagacgcagcaauagucgcagccgucuccgaggcagaaauacaaaaacucaccaaaucuuuccaggaaugugaacaaaagggccucaguagacccaugcgcgacguagccccacccugggacggauuccgagaccaacuaaaagagaaauacgaaacaauauucguagccaggccggaacgucaacgggcccgcgggcagggacacgaggccaccauacgacaaguccgcgaagaggaaaccggcccagugauauacgaacggaaagccguaagcgcccuaacccuagcugaucuagccaagauaaaggacccggaccgcaacgccggacucauagccagcuugcgacaauggaucgaagcagggaaaccagccgacaaaccaccccguaccccaugccaccaaagcgccgccggacacgaaaucagaaaaguacgccucgcgacgauuaucacaccggcagugcccguccgcggcggcauggcaaaaagaggagaaaugacccgcgucgacaucuucaaaguuaucggcaagaaaggcaaacccgagugguacaugaucccaauauacccccaccaaaucaugaaccgaagccaauggcccgcgccaccaaacaaagccgugguagcaggaaaaucugaggcggacuggcccauuaugggcgccgaagcacaauuccaauucucauuguacccaugcagcuaugucagacucuucaaagagggaacaguaaucgaaggauacuucugcggcugccacaggagccgugccuauauaacccucgcacuuaguacaggcgcagccccgcuucagaaaggaaucggcauaaaaacucaagagcauauccagaaauucagcguaaaccgcuucggagagcuaucacccguaaaacaagaaaccagaacauggcacggcguagccuguaccucgcccgaucaacacgacuga

SEQ ID NO: 6130 - RNA, 3171 nt, Artificial Sequence
  Cas9 variant
augaaggcccuaaacuacauccucggcuuagaccucggcaucgcaagcguaggcugggcggucgucgaaaucgaccagaacgagcuuccaauaaggcucaucgaccuuggaguaagaaccuucgaacgugccgaaguccccaaaacaggagauucccucgcccucgcgagacgccuggcccgaucaucccgccgacucguacggcggcgcgcagucagacuacuaaaagccaagcgccuccuaaaacaagagggcauccuccaagccgacgacuuucacucaucacaccuaaagccccucccuaacaacccaugggaacuacggguaaaaggcuuaaaccaccuccucgauagaaaagaaugggccgccguacuccuacaccuacuaaagcaccggggguaccuaucucaaagaaagaacgaaagcaaaaccgacaacaaagagcucggcgcacuucuaaagggaguguccgaaaaucggcaacuauuacaagcccaggcuuucagcacuccggccgaaauugccaucaagaaauuccaacaagaagaaggacacauccgcaaccagcgaggagccuacucccacaccuucgaucggaacgaccuacuagccgagcuacgucuacucuuccagaagcagagagaguucaacaaccccuacacaucgcaaagccucgaacaagcaaucgcggaacucuuaauguggcaaaaacccgcccugucgggcgaagccauccuaaagaugcuuggcaaaugcacguucgaacccuccgaauacaaggccccgaaaaacuccuacagcgccgaauauuuugucuggcugaccaagcuaaacaaucuccgcaucuuagaaaacggggccgaccgcggacuaacggcagaggagcggcaacuccugaucaaccaaccauucgaaaaggcaaaguucaccuacgcccaagcccgaaaacuacucgaacugucagaccucgccauauucaagggcguccgguacgggaaagacaacgcagagagcgccacacugauggaaaugaaggcguggcacgccauacgcaaagcacucgaauccaacggacucaaaacagaguggaacggccuaaagaccaaacccgaacuucucgacaaaauaggcaccgcauucagcaucuacaagaccgacgaagauauaucucaauaccuaaacggagaacucagccccgcaguccuaaacgcccuacucgaaaaccuaucauucgauaaauucauacgccucucccuacaaucacucgccaaaauacucccccugauggaacaagggcuacgcuacgaugaggcuugcaaacaggucuacggugaccacuacggcaagaaagaacagcuugaacuccgguuccuccccaaaauucccgucgaagacauccgaaacccaguuguucuccguacccuaucucaagcccgaaaaguaauaaauggagucguccggcuauacgguagcccagcccgaauacacaucgaaacuggacgagaaguugggaaaucuuucuccgaaagacgcgacauaagcaaacgacaagaagaaaaccgcaaugaaaggcaacgcgcagucgaaaaguuuaaagaauuuuucccccacuucguaggagagccuaaagcgaaagacauacuaaaaaugcggcuuuacgaacaacaacacggcaaaugccuauacucagguaaagaacucgaccucaacaggcuacucgagaaaggcuacgucgaaaucgaccaugcacugccuuucagccgaacgugggacgacucguucaacaacaaaguccucguccuagcgagcgagaaccagaacaaaggaaaccaaaccccauacgaauggcuaaacggcaaagaaaacgccgagcgcuggaagcuguuccaggcacuggucaacggauccagguucccauacagcaagaaacaaaggaucuugacaaaguaucuggaugaagauggauuccgagaacgcaaucucaaugacacccgcuacguugcacgcuuccucugcaacuucauagaggacaauaugcaacucgugggccagggaaagaagcgagucuucgccuccaauggccagauaacagcacugcuacgacgcucauggggaauccaaaaaguacgagaagacaacgaccgacaccacgccguagacgccguuguagucgccugcucaacuagagcgcuucagaagaagaucacugacuauguaagguacaaagagaugaacgucuucacaggggagaaaaucgaccaagaaacaggcgaaaucaucaaauuccacuuccccgaacccuggaaguucuuccgccaagaaguggaaauacgugucuucuccgaaacaccagcagaagacguaguaauagcacuacccgaccgaccacaagcaaaccacgaguucauccagccccuauuugucucccgggccccaacgagaaagaugacaggacagggccacauggaaaccaucaaaagcgcaaaacgccucgcagaaggucucagcguaagccggguaccacucacccagcucaaacucaaagaucuagaaaacaugguaaacagagaacgcgaaaaagcccucuacgaggcacuuaaagugcgacucgaaaaguucaauaaugaccccgcuaaggccuucgcagacccguucuacaagaaaggaggacagcaagucaaagcuguacgcgucgaacaaguccagaaaagcgggguucucguccgacaggaaaacggggucgcagacaacgccuccaugguaagagucgacgucuucaucaaaggaggaaaauacuuccuaguaccgauuuacacauggcaagucgccaaaggaauccuaccuaaccgcgcggcaacccaggggaaagaggaagaauauugggacauaauggacgagacagcaauauuucaauucagcuuauaccaaaacgaccucaucaaacugguaaccaaaaagaaaacaauauucggguacuucaacgggcucaacagagcaacaagcaacaucaauauaaaagaacacgaucucgacaaaucaaaaggcaaagacgggauauaccucgaggugggaguaaaacuagcccucucacuggaaaaauaucaagucgacgagcuaggaaagaacauccaaccuugccgcuccaugaagaaaagacccccuguucgauga

SEQ ID NO: 6131 - RNA, 3171 nt, Artificial Sequence
  Cas9 variant
augcccaaacagaaaucgacccgguacaggcuagcgcuugaucuaggcagcacaagucucggcugggcgguccucagacucaacgaacaacacgaacccaacgcaauaauccgcgcggggguaagaauauucagcaauggaagaaaccccaaagauggcagcagccuagccgugacaaggcgugcggcccgagcuaugcgccgcaggagagacagacuccugaaaagaaaagcacgaaugaugaacaaacugguagaguacggguuuuuccccgccgacgucgcagaacgaaagaaacuagagagaauaaacccauaugaauugcgagccaaaggacuagacgccccguugacccccggggaguucgcacgcgcccuauuccacauaaaccaaagacgaggauucaaaucaaaccgcaaaacagauaagaaagaaaacgacagcggcgcgcucaaagccgcaaucucacaccuccggcaacaacuacacgaaagaaaagcccgaacagugggagaauggcucuggcaacgacuacaagcaggucuuggcacaagagcgcgcuauagagaaaguagagucgcacaagcaaauggaaaaacccgaauagaaaaauccuacgaccucuacguagauagacaaaugaucgccgaagaguucgacgcccuaugggcagcccaggccgcauucaacccccaacaauucucagaacaagcucgaggggaauuacgcgacguacuguuauuccagcgugaccugcgaccgguacguccaggacgaugcacccuacucccagacgaagaaagggcaccgcucgcccuaccgucaguacagagguuccgaauccuacaagaagccaaccaccucagacuacuacaccccgaucuccgcgaagaaccucucucccuugcccaacgggacgccguggucgacgcauuagaacacaauucaaaaaggacauucgaacaacuaaggaaauuacugaaacugaacggcacuguaaaauucaaccuugaagacgagaaacgaaaggagcuaaaaggcaacgcaacgagcgccacccucagcaaagacggccucuucggcgagaacugguggaaccuagacgaggcgcuacaagacgcgauaguauggcaacucguaucagagcaauccgaagaaaaacuacagaacuggcuccaagccaacacgggagucaacgcaacacaggcagagacgaucgccaacgcgggccucccugagggcuacggcagucuaagcuacaaagcgcucgcaagaauaaucccugcccuacgaggcacagaaguagcaaacggaaucgacgugccacgaacuuacgaccaagcaguccaagcagcaggauucgcccaccacuccgaucuggacagcggcuucgauuucgaacacagccaugacgaaguggagagaauaggcgagcgcgucauugccagcacaggcgaaguaaaaccaguauucgcguuuaaacaacuacccuauuacgggaaagcacucaggcgacacgucgcauucgcaaaagaacacccacgcaaugaagaggaacgcuacggaaaaauagccaaccccaccguucacauagggcucaaccaacuacggguaguaguaaacgcacuaauccgaagauacgggcguccaaccgaggucguaguagaacucgcacgcgaccuaaaacagucccgggagcagagacaagaagaacaaaagagacaagcggacuaccaaaagagaaacgaacauauacggagagaaaucgcgagcaugcacgggugcgccgaggaacguguaagccacgccgacguacaaaaauggaucuuaugggaagaacuaaguuucgacgucgccgaccgaagauguccguacagcggaguccaaauaucggcccaaaugcuucuaagcaaccaaguagaaauagagcacauccuacccuuuucccaaacacuagacaauagccuaaauaaucgaacggucgcaaugagacaggcaaacagaaucaaaggaaacagaacgccauggcaagcgagggaggauuucgagaggcaaggguggucauacgauuccauacuccaacgagcagaacggaugccaaaagccaaacgauaucgcuucucacgagacggauacgaacggugguuaaaagaggacaaagauuuucucgcccgagcccuaaacgacacccgguaccucagccgagucgccaaaacauacauggagcuaguauguccccugggcacacgggucauccccggucaaaugacagcccuacuuagagcgaaauucggccuaaacgauguccugggccuaaacggagagaagaaccgagacgaccacagacaccacgcgguagacgccugcgugaucggcgucaccgaccaaggccuacuccagagauucgcgcaagccagcgccgaugcccgaggcaacggguuggaaaaacucgucgaaaacaugcccguaccaugggcaacauaccgcgaccacguaaaacgagccauccaaugcaucugggucucccacaaacccgaccauggguacgaaggacccaugauggaagaaaccgcguacggaaucagaaaagacggcucaauccgacagaaaacuaaagccgacggcucuaccgggcgagaaaucacacaucugauccgaaucacggagccaacacaaaaccugagacacggcguggacgcacagggccaaccguuagcauacaagggcuacgucggaggaucuaacgacugcaucgaaaucacgcagaacgaacaggggaaaugggaaggaaacgucauaacaacauuccaagccuacgacaucguucgcagacucggaucaaagcaaggacccagacgccugcgccauccaacccucgcccaaacacuagacguguacggcaagccaaagaagcuagugaugcgauugaugauagacgacugcguaagacuggaacucgauggcaacaagaaaacacuacgagucgucaaaauaacaggcaacggacaaguuuuuauggcaccaguucacgaagcaaacguggacaaacgaaacagcgacaaaacagacccauucgcguacguaucgaaauacgcaggcucauuccaaaaagcaaaagcacgcaggauaacgaucucccccaucggagaacuacacgauccuggauuuuga

SEQ ID NO: 6132 - RNA, 3174 nt, Artificial Sequence
  Cas9 variant
augucagacaaaucgaaaauacucggcuucgacauaggaaucaccucgaucggcugggccuacgucgagggggaagaacugauagauugcggcguacggauauucaccaaagcugagaaccccaagaccaaagagucucuagcacugccccgcagagaagcacgaggaguccggcggcgccuggcgaggcgaaaggggcgacucaacgccauaaaacaacuaaucugcaaagaguucgggcucaacuaccaagacuacaucgcccaggacggcgagcucccaaaggcguacgcaggaaagcucaucaaccccuacgagcuaagaucaaaggcacuccgcgagaaacucgaaaaagaagaacuagcccgcgucauccuccacauugcaaaacaccgaggauacggaaacaaacacgcaaaagagacagacgacgccgaaucgggcaagaucaagaaagccaucucgaacaaugagaaaauacuuaacgaaaaaggcuaccaguccgccggagaauaccucuaccaagaguucuuccaaaaagaaaggcuucaggaagaaaagaaaggcaacaacaccacgaaagaguucaaaaacguacguaacaaagccggggacuacgaacacugcaucgcacaaacgcaaaugcaaaacgaacuccgccucaucuucgaaaaacagcgagaauuuggacuaaacuucuccgaagaguucaaaaagaaaguccucgaaacggccuucuuucagcgaccacucaaagacuucagcgacaagauaggagacugcacauucauagaaggugcgaagcgcgcgccuaaagacagccucagcgccauagaguucgucgcccuagguagaauaaucaauacacucaaaaaccugcaaaacaccagcggcgaagucuacagccgagacaagaucaacgaaaucuugcagauaguacucgacaagggcgaaaucagcuacaagaaacuaagagaaauacuagacaucgaauccuccgugcgguucaaagacucaaaauuagacuauacgaaagaacuaaaggaagccgagaaaaccaaacucuucgaaucgaaaaaccuccagaaauucaagaaggcgcucggaucauucgaaggcauaucaagggaaauacuagacagcaucgcgaaggaaauaaugauuacaaaagacaaagagaaauuagcaaaagaacucaagaaauucccccuagaugaaacccagauccagaaccucuccaaccugagcuucagccaaacuaucaacuuaagccuggaggcccucagccaaauccugccauucaugcguggcgagcgggaggacaaaugccuccgguacgacgaggccgucgagaaagccggccuaaaggaagucgccaaaaacaaaaguaaagacgacuuccuaccaccccucgaaaauuacgaacccuaccucgcaaaccccgucgucgcaagggcgcucuccgaauacaggaaaguccuaaaugcccuccuaagaaaauacggaaaaaugcacaaaauccacauagaguucacccgagaaguuggaaaaagcaaggaggaacgcaacaagauagaaaaagagcagaaggaaaacuucgccaaaaaccaggaggcacaaaaacaaugcgaaauccuaggacuuccaauaaacggcgccaacauccuaaaaaugaaacuguggcgcgaacaacaggaaucuuguguauacagcggaaaagagauagccauagacgaccugaaaaaccccgccauccuacaagucgaucacauauacccauacucgcgcuccuucgacgacuccuacaacaacaaaguccuaguguucaguaaggaaaaccaaaacaaacuaaacaaaacacccuucgaggccuucggagaaaauaaagacaaaugggagaaaauccugagccuugccuccaaacugccgaaacccaagcggcaacgcauauacaacaugcaauucaaggacaaggaacagggcuuccucacacgcaacauaaacgacacuggcuacaucgcgagacucgucucccaauggaccaagaacugccucagcuucgaaaagcuauccgaggacgaaguaagcaucgcaggagaaaaaggcagcaagguccacguggagguaaucagcggaagccuaacggcgaugcuacgccacuacuggggacugggcgacaagaaccgggacaaccaucuccaccacgccguagacgcaaucauaauagcauacucaaacgagaaagugauaaaagcguuuucagacuacaagaagcacagagaacaaaacaaagcgaaguucuaugccaaagaaaucgccgaauccgaauacaagaaacaaaaaguauucuuugaaccaacuaaccacuuccgccaaaaaguccuagagaaaauugacucgauuuucgucagcaaaccaccgagaaaacgagccaggggcgcccuccacgaagagacauucuacagcuucgagcgacuaugcaacgacaaagaauacgccaagaaagaaaagauggacuacggcggcaaagcuggcauccagaaagcaaucgcccuaggcaaaauccgacaaguaggcacaaaaaucgucucaaacgguaccaugguccggguagauaucuuccaacacaaaucgaacggaaaauucuacggcguccccaucuacacaauggacuucgcucucggcguacucccaaacaaggccguagucaguggcaaagacaagcaaggcgucauaaaagacuggcuggaaauggacucaaacuacgaguucugcuucagccucuucaaggaugaccuuauccucguccagaaaaaggaaauggagaaagccgaacucugcuacuacaccgacuucaacagcaacaccgcgggaauaaaauucgaaaagcauaacaaccucuacgucaaccuaaacgaaaacgagcgaaagcuguucacaagcaaagaggucgucaaaggcggcaagaaaaacgucuggaaagacaagacaccuaaagaaaucgagcaauuggagaaaaaucgaaaaaucauagggggauucguaacgaucgaagaccucaaaaccuucgaaaaauaccaagugagcccccugggcgaaguccaaaaggcagacuucgcgccacgacaagccaucacgcucaaguccucgcccaaacaccgcaucaacaaauga

SEQ ID NO: 6133 - RNA, 3174 nt, Artificial Sequence
  Cas9 variant
augagcaaucgaguuccauaccgacuagcccuagaccuaggaacaaacagcaucggguggugccuauuagaucuaaacggaaacggagacccgugcggcguccggcggaugggcguacgaauauucccagacggcagagauccaaagagcaaggaaagccuagcggccgaccgccgacucgcgagaagcaugagacggcgcagagacagauaucugaggcgacgcagcgcacuaaugaaugcucuagucgcagcgggacuaaugccagcagaucgugcaacgagaaaagcacuagaaagcgaggacccgugcgaacucagagcgagggcccuguucgaaccgcuaacagcggggcaaguuggacgggcucucuuccaccugaaucaaagaaggggcuucaaguccaacagaaaagcggcgggggaagagaacgaagcagggaaaauaaaggcuggaauaagcgcacuaaaagcagaaaucgaagcaagcggagaaacaacacucggggcaugguuagcagccagacaucgaaaaagagaaacagucagagcccgacucgacggggccggggccaaagccucauacgaguucuacccggaacgcggacugguucaugacgaauuucaagcaauacggacagcccaagcacugcaccauccagcgguuacagcagaacaaugggaccgaguagaaagcgugauauucagacaacgaccacuaagacccgugcgaccaggaaaguguacgcucuuucccgaucaggaaagagcacccugggcgcuaccgguggcgcaagaguucagaauccuaacagaaauaggaaaucuaaagcuauacagaccaggagaggaaccccgugaacucucagcggaucaacaugcccaacuauucgcaaaacucugucggagcgcagaccugacauucgagaaaauccgaaaagaacuaaaacuagacccgggacucaagguaaaccuggaaggggaaaagagagauaggcugaaaggggaugcagucacaucugcacuaagcgcaaagaaaagauucgggcccaaauggaacgcacuuacgccagacgacaggagagacauaguagggagacuaauagaagcggaagacgaggcugaacuggcgggguggcuagagagcguacacggucuaccaagcgaaaacgcagcacauacagccgcaucgccaggacugcccgacggguacugccgccucuccgagaaagcacuggucaaacugguaccacugaugcgcgaacaacgccugcgauacgacgaagccguauuggcgcugaaccuccaccacagcgauuuuaggccagaaggacugcuagacgaacugcccuacuauggagaaccauuggagagauucauagcauuuggaucaggggagcccagcgacccaccagaacagcaccuaggacgauuccccaacccaacgguacacaucgggcuaaacgagcuaaggaaacugguaaaccggaucguagaacgauggggcaaaccggcagacaucgugguagagcucgcacgugaccuaaaaagaagcagagacgaaagagacacgauucaacgagaacaagcgcaaaaccaaagaaagaacgaggaccgauucgccaaaaucaaagaacuggggaucgacccacgacccgacucaaugcucaggcucagacucugggaagaacuaccgaaaguaggaguaggacacguaugcguguacacuggcgagccaaucgguauaaggagacugcucgagggagacgucgacaucgaccacauacugccguucagccgaacgcuaagcgacggcgcagacaacaagaucguaugcgugcgcagagcaaaccgcuucaaaagggaccgaagcccaugggaggcguucggcgucacggcaguagacggcuacgacugggcagccauagcgcagcgggcggaggagcuucccaaaaauaaacgauggcgcuuccugccagacgccauggauagauucgaaggcgagcggggcuuccucgacagacagcuagucgagacucgucacuuaucccgcguggcaagacaauaucuagcaagcaucguagaccucaacaaaguaaggguagcaccaggcaagcugacagccaugcuccgagcaagauggggacuaaacaaaauacugagcgacggcaaccucaagaaucgcuccgaccaccgccaccacgcgaucgacgcagcaguauugggcaugauagaccaacggcuaguacaacugguagcacaagcggcagcgagggcggaagcaaacgaacuagagagauuauucgacggacugccagacccauucgacggacuagccgcaacgagcuucggggaucaaguaagagaaaagauccgcgggaucacagugagccacagagcggagcacggcuggcaaggcagaaugcacaacgacacggcguacggaccgguagaggcagucaacggagugcacacagucguaacacgcaaaccacuaucaggccuaacggcaaaagacuucccgaacauacgagauagggugcucgcaaaagcacuugaggaccacguggccgcagaagccgcggccggucgaucauucggggacgcguuagggagcuucaaauggggaggacaacccguacgaagaguacgcaugcuagacguacuaggaaaccccaucccaauccaagacccaagcgguacaguauucaagguguacaaaggagacagcaacgcaugguaugagauccuaagggaccccagagggagauggacgggaaagaucgugagcacauucgaggcauacagacuccacagggaguggcuagcggaaacugguggcgacagcggaagggggagcgguguguuccuagacugggcagccaaaaggguuguaggcgaagccggaaccccacucuuccgauuauucaaaggagaccuccucgcucugggagaagccccagacaggagaaucguacgcgucguaaaguucagcgaaggccagguagcucuggcacuacacuuagaggccggaaaccuaaaagcaagagaugccgacaaaggagacccguucaaguaccaauacuguagccccgacagccuaagaaagcaggcagcacgcccugcagggguagacuuacucggguacguacaugacaaaggaccacuagaguga

SEQ ID NO: 6134 - RNA, 3174 nt, Artificial Sequence
  Cas9 variant
augcgccgccucggacucgacauaggcacaaacagcauaggauggugccucauagaagacgacaagaaaauuguggacauagggguacgaauauucucggacggccgcgaccccaaaagcggagcaucgcucgccguugaucgcagagacgcucgcgcuaugcgacgccgacgggacagauaccucggacgcagaucggcguuccuacaggcgcucgucguccacgguuuaaugccagccgaugccgaugaggcaaaacuggucgccgaucgcgauccuuaccaacucagagccaaagcucuccacgucgcacucgaacccuucgaaauaggcagagcacuuuuucaccuaaaccagcgccggggauucaaaucgaacaggaaagcagacagaaaagccaacgccggggaagacggcaaaauagccgaaggcgcaaaagcucuggaucaagcgaugucggaggccgguguagacacacuaggccaauuccucgcgcuuaaagaaacaaagcgaguucgacucggcagcgacggacaggccuacgacuucuacccccaaaggcgccacaucgaauacgaguucgacagaauauggaaaguccaaucugaauaccacccagcgcuucuaaccgaagccgcacgagccgcacuucaccgcauccuauuuuuccaaagaccccuaaaagcacaagaagucggcuucuguaccuucgcaggaguuaacggaauagccgccaacgagagacgccuacccaaagcgcacccacuauuccaacaacgaagacucuacgaagaaguaaaccaacuccgcauagucuccgccggagcugccgaccgcccauuaacacuagacgaacgugaccgcuuaauacuccgguuacaagaccggaagaaagugaguuuugauacccuggcaaagaaagaccuccgacuggccgauggcgagagauucaacaaagaaagcgaaaaccgaaaagaacucaucggggacgagguucgcgcagaaauguccgacaagaaaagguuuggaacgcgauggguacacuucggccucgaugagcaacuccggauacuugcaaaacuacaagacgaagaaaacccagaagcacuuuuggacuggcuccgaagcgaguauggucuugacgaagcugccgcagaaagugucgcgaacgccagauuacccgagggcuauggcagauucggagaaaccgcaacucgacuacugcuagacgcccucaaagcagaagucauuaccuaugacaaagcugcccuacgcgcuuucggacaucacucggacuuccguaccggagaaguccuagaucggcucccauacuacggagaacuucucacacgcgaaauagcaccuggcaaaccugaauauggcgacccccuggagcgccaauacggaaaaaucaccaacccaacgguacacaucggacuccggcaacucgagaaacucgucaaugcagucaucgcaguacacggacgccccgaucagauaguaguagaacucgcacgugaacugaagcucaacgaaaaggaaaaggacgaacacaaacgaagaaucaagagagauaccgacgccgccaucgcaagggggcgaaaauuagccagcgaaggcuucauagacaacggagcaaacagaaugcucaugcgcaucugggaagaacuaaaccccgccaauccccucgacagacgaugccccuacugcgccgaaccgaucggaaucagagcccuauucuccggagaggcagacaucgaccacauaauccccuacucacgcagccuagacgacaacgugggaaacaaaguagucgcccaccggucuugcaaucgcgccaagggcaacaagaccccauacgaaaaauggggcccccacauagaccccgaaagaugggaacgcauaagugaccaaguagcacgccugcauaaaucgaaacaguggcgcuucggcccagaugccauggagagaauagacagagacggcggguuucucgcccgccaacugacagacacacaguaccuaaguagagucgccgggaaguaccuacgcucccuguauccaacggcacagucaggccgcguagacguaaucccaggaagaaugacagccaugcuccgucggaaauggggccuuaacagccuccuccccgaccacaacuacgucgagaacgaacacucaaacgcacccaaaaaccgacuagaccacagacaccacgccaucgacgccgcaguagcagccgucaccacccuuagccuaaugcaacaaauagcggacgccgcaggccgagcugaagacaagaacuuagacagacuauucgaagacauaccacaaccguggccaggcuuccgcgaagaacuaggagaggcuuuacggucaacaacagugucgcacaaagccgaccaugggcggaaacgacgaccaucccgcgacagagaugucaccgccgcaagacuacacaacgacaccgcauacgggcugacaggagacguggccgcagacggaaagacucccaucguaguccauagaguaccacuagcaagccucaaacccgcagaccuaauagacccacuccgcauaccagacccgguccugagagacgcacuuuacgcagcaacccgagaccgcacgggcaaggaguucgaacaggcauuaacccaauucgcccgccaccacccccucuucaaaggaaucagacgaguaagaguccgggaaccacucaaugucauaccaauaagagacgcugccggccgugcguacaaggccuauaaaggagaugccaacgcacgcuuugacguguggagacuaccaaacggaaaauggguaucagacauaguauccauguucgaugcgcacugcauggcugacaaaucagaccguaggccccacccagccgccaagaaaguccucucacucaggcagaacgacauggucgcaauagaaagaaguggaguaacacagaucgccagagucguaaaauucucuaccaacggcuccaucgcacucgccgccgacaacgaagccggagccuuaaaagcacgcgacgccgccccaaacgacguugaccccuucaaauacauauucucaucuggaggaggccucaaaaaccucaaagcacgccagguacgcguagauccccugggccgcguguuugauccaggcccucgcgaguga

SEQ ID NO: 6135 - RNA, 3177 nt, Artificial Sequence
  Cas9 variant
augaagaacuccuacauucucgggcuggauguagggaucgcaagcgucggguacggacuaauccacucugacucaaaaagcgucaucgaugccggcguccgccuuuucccggaagccaacguagaaaauaacgagggccgacgagcaaagcgaggcuccaggcgccuaaaaagaagaagaauccaucgccucgacagagucaaguaccuccucgcgcaguaccaccucaucaucgacgacaaaauuccaaaauccacaaaccccuacgcgauacgugucaagggacucuccuccgcacucuccaagagcgagcucgucauagcacuccuccaccucgcaaagcgccgagggauacacaauguaaacguuguaauggacgaaaaugaaagcacuaacgagcucucuaccaaagaacagcuaaaagaaaaugcaaagcagcuggagaaccgguacgugugcgagcuccaacuggaccggcucaacgaacaauacaaggugcgcggcgaaaggaaucgcuucaaaacagaggacuucguucgcgaagcccgccagauacucaccacccaacaaaaauaccacgauauugacgagcacuucaucgagcaauacacucauuuacuggaaacccgaagagaauacuaugaaggacccggcaagggaucgcaauacgggugggagggagaccuaaaacaaugguacgaaaugcuaaugggaagaugcaccuauuuccccgaggagcuccgaagcgucaaguacgccuacaccgccgauuuguucaacgcgcuaaacgaccuuaacaaccucguaauagcacgcgacgaaaacgagaaacuagaauacuuugaaaaauaccacauuaucgaaaauguauucaaacaaaagaaaagccccacccucaaacaaaucgcgaaggaaauugaugucaaagaauccgacaucaagggauaccggaucacaaagaacggaaaaccccaauucaccagcuuuaaacucuaccaugaccucaacaaaauauuccucgacaagaaaaaccucgaaaacauagagcugcuggaugagaucgccuucauccucacacucuaccaagacccccucagcaucaaggaagcgcucgaucaacuccaagaccuccuuacugaaagcgaaaaagaggcgaucgcccaccuuaacggcuacaccggcacccaucgccugucgcucaagugccuccaccuacuaauagacgaaauguggcaaacaucccgcaaccaaauggaaguuuucacggcccucaaccucaaaccccaaaaauaccaacucucuaaacaaaaacaaauccccaagaaaaugguggaagaguucauacucucccccgucgucaaacguagcuucauccaaucaaucgaaauagucaacaccaucauaaagaaguacggucucccggaagaaauaauaauagagcuagcgcgcgaaaagaacuccgaagacaggcguaaauuccuuaaccgaauccagaaggaaaacgaaaacacccgcaagcaaguagaagagguaauaagagaauauggcaaccgaaacgccaaagggcuaguagagaaaaucaagcuacaccaaaugcaagaaggaaaaugccuauacucgcuacagaacauaccccuagaugaccuccuccggaaccccucccacuacgaaaucgaccacauuaucccccgaucagucaguuucgacaauuccuuuaacaacaaggugcucguaaaacaagaagaaaacuccaaaaagggcaaccgcacgccguaccaguaccucaacuccaacgaaagcguccucagcuacguccaauucaaacaacacaucuugaaccucagcaagucgaaagaaagaauaagcaagaagaaacgagaguaccuccucgaggaacgggacauaaacaaauuugaggugcaaaaagaguucaucaaccgaaaccugguagacacacgcuaugccacccgcgaacucguccaacuguuaaaaucauacuucagcgccaacgaccucgacgucaaagugaaaacaaucaacggcucuuucacgaacuaccucagaaaagcguggaaauucgacaaaagccgcaacaaaggcuucaaacaccacgccgaagacgcucugaucaucgccaacguauccuaccuauucaaacaaucaaaagaacugaaagaagccaacgccauccuagaaaacaacaaccugagccucaacaaaaacaaagacuccaaaaaccucuugacggagcaggacuaccgaaaaauguucgaaaucccuaagcagguccaggacauaaaggacuacaaggacuucaaauacagccaccguguggacaagaaaccaaacagacagcugauuaacgauucccucuacagcacgcgagaggucaacgaaaaccacuacaucguacaaacgguaaaagacaucuacgcaaaagauaacacaaagaucaaagaccuuuuccucaaaacccccgaaaagcucuuaauguaccaacacgacccccaaacuuucgagaagcucaugcucgucauaaaacaauacggcgaggagaagaauccguucgccaaauacuaugaggaaaacggcgaauaccucaccaaauaugcaaagaacgagaaaggaccaacaauuaaacgucugaaguacaucggcaaaaagguuggaacccaccuugacauuagcacaaacuucucaggcgccaaacgcaaagucguacaacuaucgauaaagcccuuucgguucgacguguuccacagcaaagcaggcuaccacaugcugacgcugacauacauggacaucaagaagaaagaaaaacacuaccaaauacucaaaaacgaauaccaagcccugaaagaacgcuacaaaguacccucagacgcgcaauucaucggcagcuucuacuauaacgaccucaucucgaucaacgacgagcucuuucgcgucauagguguuaacaacuccacccgcaacgucguagaacuaaacaugguagauaucaacuacaaagacuacugcgaccucauggggaucaaaaagacaccacggauauucaaaaccaucaccaagaaaacgggaaaaauagagaaguacagcacugacauccucggcaaccaauucaaggucaagcccuccaaaagcccccagcucaucuucaaacgagguguccuauga

SEQ ID NO: 6136 - RNA, 3180 nt, Artificial Sequence
  Cas9 variant
augcgucgccucggacuagacauugguaccaacucaaucggauggugccuaacgcaaggaccaggagacgaagccgacggaauaguagacauaggaguaaggauauuuucagacggaagagacccccaauccggcaccagcuuagccgucgacagacgagacgcaagagccgccagacgccgacgcgacagauacauaggcaggagauccgcauuccuagacacacucgucgcccauggacucaugccagccgacgccgacgaagcuaagcuaguggcagcuuuagacccauacacacuaagagccagagcccuagaagccccacugacaccacacgaaauaggcagagcacuguuccaccucaaccagagaaggggauucaaaaguaacaggaaagcagaaaggaagaccaacgacgccgaugacgggaaaauugcuaccgccgcauacgcccuagacagagccaugcucgauggcggauucgacacgcuagggcaauuccuaaacgcccaagagacaaaacguguaagaauggacggcgaggcccaaggauacgacuucuacccccaacgccgacacguagaauacgaguucgauagaaucuggacagaacaggcaaaacaucaccccgcacucuuaaccgaaacagccagauacgcccuccaccgcauccucuuuuaccaaagaccccuaaaggcacaggucguaggcaagugcaccuucguacacuccgaggacagacucgcaaaagcacacccucucuuccaacaacgaagacuauacgaagagguaaaccaacuagaaguaacaacccccggcgaagccaaucgcaaacuuacacuugacgaaagagaucgccuggucagagaacugucccauaagaaagcaaucgcuuuuaccagccucgcugcaaaaauaaaacuagaaccuggccaauccuucaacaaagcgucagagaccaggacacaacuggcaggcgacgagguacgagccguacuaggcgacaagaaaagguucggccccgccugggagcacuucgaccgagaccgacaauggacaaucgucgaacgucuccucgaggaagaagacccagacgcucuccacgcauuccucacccaagacugcggccucgacgacgaacaugcagcagccacagcaaagaccagccucccagaaggauacggccgccucggcgcaaccgcaaccgcacguauccuagcagaacugcaggccgaagugaucacauacgacgaagccgucagacgauguggguggcaccacucagaccaccgaacaggagaaauccuaccccaacucccauacuacggagagcuccuaacacgggauauaccaccggggacacaagacccaaacgacccucccgaaaaacgcuggggccgaaucacaaauccaacaguccacaucggccuaaaccaggucagacaauuaguaaacgccauagucgcaguucacggccgaccagaccaaauaguaguggaacucgcgcgcgaacuaaaacucaacgaaaaagacaaagaagaacacaaccgcagaaucagacgggacacagccgccgcuaucaaaaggucggagaaguuaacacaagaaggauuuccagacaccggggcgaacagaauguuacuaagacucugggaggacuuaaacccagcaaacccacuagaucgcagaugcccauacugcggagcgcccauaggcaugcgagcgcuauucgcgggagaagcagacgucgaccauauaaucccauacuccagaucacucgacgacucagcaggaaacaaaguaguagcccaccggagcugcaacagagccaagggcaauaggaccccguacgagaaguggagcgaugacccagaccggugggacgccauaaccgcccaaguagcacgacuacaccgcagcaagcaguggcgcuuuggaccagacgcaauggcccgcgucgaaaaagacggcggauuucuaucacgacaacuaaccgacacacaauaccuaucacggcuugccggacguuaccucucaucccuguacccgacaaaagaagaagggucaguauacgucauccccggaagaaugaccgccaugcugcgucgucuauggggacucaacgacauacucuccgaucacaacauagucgagaacaaacauuccaacgccccaaagaacaggcuagaccacagacaccaugcaauagacgccgccgugguagcagucucaacccgaucacuaaugcaacgaauagcacgaacagcagggcaagcugaagacaggaaccuagacagacuauucgaaggucuagauccaccguggccaggguuucgugaccaacucagagaccgacuacuugcggugacuguaagccacaaagcagaccacgggagaacaggcacccccgucccaggcaaagaugcuacagcaggccgacuacacaacgacaccgcguacggauuaaccggggaaaccagcgccaagggacuccccauagugguccaccgagucccccugacgagucugaagcccgcagacaucacagaccccgaccgcauaccagauccagugcuccgugaugcaauagaacgcgcgaccgccgggaaaaugggcaaggacuucaccgaugcuuuggcaaaauucggccgcucaggggcccaagaaacagaucgaaaaggagaaagacuguucaggggaacaagacggguccgcguacgcgaacccuugggcguaauaccaaucgcagaugcauccggacgagucuacaaggcuuacaagggugacagcaacgcgagauucgacgucuggcgacucccugacggaaaaugggucucagacauaguuuccauguucgaugcacacaggccagaccaaggagaccgacgcccacaucccgccgccaagaaaguucucucccuucgacaaaacgacaugaucgccauagaaagggacggcgcaccacgcgaaaucguaagagucgucaaguucagcacgauaggaucugugcaacuggccgcaacaaccgaggccgguccacuaaaagcucgcgacgccagcccacccgauguggaccccuuuagauacauaaacuccucagccggcggacuaaagaaaaucaaagccaggcaaguacggaucgauccacucgggaggaucuucgaccccggcccccgcuga

SEQ ID NO: 6137 - RNA, 3180 nt, Artificial Sequence
  Cas9 variant
augauagaaagaauccucggcguagaccuaggcaucagcagccuagggugggcgauaguggaauacgacaaggacgacgaagccgcaaaccgcauaaucgacuguggcguacgccucuuuaccgccgcagaaaccccuaaaaagaaagaguccccaaacaaagccagaagggaggcccgaggcauaagacgcguacucaaccgacgaagagugagaaugaauaugauaaagaaacuguucuuacgcgccgggcuaauacaagacgucgaccuagacggcgaaggagggauguucuacagcaaagcaaauagagccgacguaugggagcugcggcacgacggacuguacaggcuucucaaaggagacgaacucgcgcguguccuuauacacaucgcuaaacaccgcggcuacaaauucauaggggacgacgaagccgacgaagaauccgggaaagugaagaaagcaggggugguucuccggcaaaauuucgaagcagcaggcugcaggaccgugggcgaguggcuuuggagagaaaggggcgcaaacggcaagaaacgcaacaaacacggagauuacgaaaucagcauccacagagaccugcucgucgaagaaguagaagcgaucuucgucgcacaacaagaaaugaggagcaccaucgcaacagacgcacucaaagcagcuuacagggagaucgccuucuucguucgacccaugcaaaggaucgagaaaaugguaggacacugcaccuacuuuccggaagaacgaagggcccccaaaucagcgccaacggccgaaaaauucaucgccauauccaaauucuucucuacuguaauuauagacaacgaaggcugggaacagaaaaucauagaaagaaaaacccucgaagaacuauuagacuucgccguaagcagggaaaaaguagaguuccgacaccuaaggaaauuccucgaccuaucagacaacgaaaucuucaaaggacugcacuacaaaggaaaaccgaagaccgcgaagaaaagagaagcaacucuguucgaccccaaugaaccuacggaacucgaguucgacaaaguggaagcagaaaagaaagcauggaucagccugcgcggcgccgcgaaacuaagagaagcacuaggcaacgaguucuaugggagguucgucgccuuaggaaaacacgcagacgaagcaaccaagauacucacuuacuacaaggacgaaggccagaaaagacgcgaacucacgaaauuaccccucgaagccgagaugguagaacgacucguaaaaauaggauucagcgacuuccugaaacucagccuaaaagcaauacgcgacauccucccagcaauggagagcggcgcgcgcuacgacgaagccguccucaugcuaggggucccccacaaagaaaaaucagcgauccugccaccccugaacaagaccgacauagacauacucaacccgacggucauccgcgcauucgcgcaauuccggaaaguagccaacgcacucguccgaaaauacggggccuucgacagaguacacuucgaacuggcgagagaaauaaacacaaaaggcgaaaucgaggacauaaaagaaagccaacggaaaaacgagaaggagcgaaaagaagccgcagacuggauugcagagaccucguuccaagucccgcuaacacgcaaaaacauccuaaagaaaagacuauacauccaacaagacggcagaugcgcauacacgggggauguaaucgaacuagagagacucuucgacgagggauacugcgagauagaccacauccuaccacgaucacgauccgcagacgacagcuucgccaacaaggugcuaugccuagccagggcaaaccaacagaaaacagacaggacacccuacgagugguuuggccacgacgccgcccgcuggaacgcauucgaaaccagaacgucggcacccaguaaccgcgugcgcaccggcaaaggcaagauagacaggcuacuuaaaaagaacuucgacgaaaacucagagauggccuucaaggaccgaaaucuaaacgacacacgcuacauggcacgggccaucaaaaccuacugcgaacaauacugggucuucaaaaacucacacaccaaagcacccguacaggucagaaguggcaaacuaacgucgguccuacgcuaccaauggggcuuggaaagcaaggaccgagaaucccacacacaccaugcaguagacgcgaucaucauagcauucagcacccaaggaaugguacaaaaacugucagaguacuaccgguucaaagaaacacaccgcgagaaagagagaccaaagcuagcaguaccccucgccaacuuccgcgacgcaguggaagaagcaacccgaaucgaaaacacagaaacaguaaaagaaggagucgaggugaaacgccugcuaaucucgcgcccacccagagccagaguaaccggacaagcccacgaacaaacagcaaaaccauacccccgcauaaaacaagucaagaacaaaaagaaauggcgacucgcgccgaucgacgaagaaaaauucgaaaguuucaaagcagaccgagucgccuccgcaaaccagaaaaacuucuacgaaaccagcacaaucccccgagucgacgucuaccacaagaaaggaaaauuccaccuggucccgauauaccuacacgaaaugguccucaacgaacuaccgaaucucagccuaggcacaaacccugaagcgauggacgaaaacuucuuuaaauucagcauauucaaggacgaccucaucagcauccagacacaagggacaccaaagaaacccgcgaaaauaaucaugggauacuucaaaaacaugcacggcgcaaacaugguccucagcucaaucaauaacuccccaugugaaggauuuaccugcacaccaguaucaauggacaagaaacacaaagacaaaugcaaacucugcccagaagaaaaccgcauagcaggaaggugccuccaaggcuuccucgacuacuggucgcaagagggccugcguccaccaagaaaagaguucgaaugcgaccagggugucaaauucgcgcuggacguaaagaaguaccagauagauccacuuggauacuacuaugaaguaaagcaagagaaaagacugggaaccauaccacagaugcgcucagccaagaaacuggucaaaaaguga

SEQ ID NO: 6138 - RNA, 3180 nt, Artificial Sequence
  Cas9 variant
augucgaaaaggcucagauauagacuggcccuggaucucggaacgaacucgaucggauucugccuacuggaccuaaacggcgauggaagaccaugcggcgugagaagaaugggcguaagaauauucccggacuucagcaaacuacaacaaucauuagcagcagacagacgcuuagcgcgaaguaugagaaggagacgagaccgcuaccuacgaaggcgaaaggcuuuaaugaacgcacuuguggcggcagccuugaugcccgcagacccuaaagcaagaaaagcacuggaggcacuagauccauacgaacuaagagccgcagcaguagcaggaccgcugcccgcgcaccaacugggaagggcacuauuccaucuuaaccaaaggcgcggcuucaagagcaacagaaaagccgcaggagacgagaaugaagcaggcaagguaaaaagcggaauauccgcacuaaaggcagagcuagccgccucgggagccgggacacuagggcaguggcuggccgccagacacgcaaauagacagcccgugagagcacgccucacuggaacaggagcgaaggccacauacucauucuacccagaacgcgcauuaguacacgaagaguuccaagcaauacgagcagcacaagcuccacaucacccaggaguaacggccgaacaaugggaccgcaucgaaagcgucaucuuccaccaaagaccccucaaaccgguaaaaccgggaaaaugcacacuguacccagaagaagaaagggccccgugggcgcugccgaucgcacaaagauucagaauccugcacgaacuccacaaccuacgcauaguaagaccggggcagggagaggaggggcucagcccagcugacuucgaccgauucuucgacagacuguguagaaaaggagaccuaaccuuuaaaaccuuagcaaaagaacucaaacucccacccgacgcaagaauaaacuuagaagacgacaaaagggacagacuaaagggagacgcaacagcagacgcccuaagcgcagaaaagggcaagcgacgaagaaucggagcagccuggcauagcuucccagccgaccgacaaagagaaauaguaggcagacuaauagacgcggaagacgaaggggaacuagcagcaugguuagucgaagaacucggacucccgugggagguagcuauacugacagccgaaagaccgggccuacccgacggauacugccggcucucggagaaagcgcuagagcaaguaguaccacuaaugcacgaggaacaccuccccuacgaugaagcaguacgcgcacucggauuacaccauagcgaccaucgcacaggcgaguuccuagacgaacuucccuacuacggauuaccgcuggaacgguucauagcauucggcaccggggaggcagacgacccucccgaacuaagaauugggagauuuccaaaccccacagugcauguagcacuuaacgaacucagaagagugguaaaccggauuauacgucgguggggaaaacccgaggaaauagucguagagcuggcaagagaccucaagcaaucgcgggccgacagggacaaaacgcaacgcgagcaagcagauaaucaaaagaaaaacuggacacgaacacaacaacucagagaauuagggauggaacccacaggagaggccuuacuccgacuccgccucugggaggagcuaccacgcaucggaagugcgcacgugugcguauacacuggacaacccauaagcaugacccagcuccuccaaggggacgucgacguagaccacauccuccccuucagccgcacacucgcaaacggcgcagacaacaaaauaguaugccaccgccgggcuaacaggauaaaacggaacaggacacccugggaagcauuuggagucguaagcgcggacggauacgacugggcagcaauagcggaacgagcagaaaguuuaccgaaaaacaaacgauggcgauuucuaccaaacgcaauggaacgauucgaaacagaacgcggcuucauagacagacagcuaguagaaacaagacauuuaagccgagucgcaagagaguaccuaggcugcaucgucccccuagaaaaagugcgggcagcccccggcagacuaaccgcaaugcuaagaggacgauggggccucaacagcauacugagcgaugcaaaccucaaaaaccgaagcgaucacagacaccaugcagucgacgcagcaguuuuagggguaaucgaccaacgcuuaguccagagagucgccgacgccgcaaaaagagcagaggaaaaagaacuagaaaaacucuucgacggguugccagacccauuugaaggacucccagggcccagcuuccgggaccaaguacaagaacgagcacaaggcauaauagugagccacaaaccagaacacggauggcagggacgaaugcacaaugacaccgcguacgggcccguagaacgccuaccagacggcacucacagaguggucacacgaaaaccccucggaagccuagcagaaaaggacuucggaaacauacgagacagagcacucgcagccgcacuagagagacacgucgccgaacaagcagcacaggggcgaagccuaggcgaggcacucucaugcuucacauggacagggggagaaguaaggcgaguccgcaugcuugacaagcuaggaaguccgguagccguucaagacgacgacggacacaccuucaaacuauacaaaggcgacagcaaugcgugguacgaaauacuacgcgacggcagagggagguggacaggucggauaguaucaacguacgaggcuuacagacugcacgcggaguggcucgcagaaagaggagacggcggcagaucggacgcugcauuuccggacugggcagccaggagacucugcgcaggaaucggcaaacccuuguucagacucuucaaaggagauaugcuagcguucggaaccgcaccgaacagggaaaucaugaaaguagucaaauucucagaggggcguauaguguucgccggccaccgagaagcagggaauuuaaaagaaagagacgcagacaaagacgaccccuucaaauacagaacaugcucaccagaagcacugagaaaagcgcaggcccgaccaguaggaguagaccccgccggcuucguacacgaccgcggaccacuagaauga

SEQ ID NO: 6139 - RNA, 3180 nt, Artificial Sequence
  Cas9 variant
auggggauaagguucgcguuugaccuaggcacaaacagcauaggcugggcaguauggaggacaggccccgggguauucggcgaagacaccgccgcaagucuagauggcagcggaguacuuauauucaaagacggccgaaauccgaaagauggccaaucacuggccacaaugcgccguguaccgagacaaucgcgcaagagacgcgacagauucguacuaagaagacgagacuugcucgcagcucuacgcaaggcuggauuauuccccguugacguggaagaagggcggcgacuagccgcgacggacccguaccaccucagggcaaaagcacucgacgaaucgcucacaccucacgaaaugggcagggugauauuccaccuaaaccaaagacgcggcuuuagaaguaaccgcaaggccgacaggcaagacagagaaaaaggcaaaauagcagaaggaagcaaacgacuugcggaaacccuagcggcaaccaacugcaggacccugggagaguuccucuggagcagacaccggggcaccccacguacgcgaucuccaacacgaauacgcauggaaggagaaggagccaaggcccuguacgccuuuuacccaacgagagaaaugguaagggcagaguucgaaagacucuggacugcgcaaagcagguucgccccggaccugcucaccccggaacgccacgaagaaaucgcaggcauacuauuuagacaacgagaccucgcgccgccaaagaucggcugcugcacauucgaaccaagcgaacgacgacucccacgcgcccugccaucgguagaagcacgagggauauacgaacgccuggcccauuuacgaaucacaacagggccggucuccgaccggggacugacacggccagaaagagacgugcuagcaagcgcacuacuggcagggaagucccuaacauucaaagcaguacgcaaaacacuaaagauacucccacaugcccuagugaacuucgaagaagcaggggaaaaaggccucgacggagcccuaacagcaaaacuuuuauccaaaccagaccacuacggagcagcguggcacggauuauccuucgcagaaaaagacaccuucgucggaaagcugcuggacgaagccgacgaagagagacucauaagaagacucgucaccgagaacagguuauccgaggaugcagcccguaggugcgccucaauaccacuagcggauggauacggccgacuuggccgaacagcaaacaccgagauccucgccgcccuagucgaagagacagaugaaacuggaaccguagugaccuacgcagaagccguccggagagcaggggaacgaacaggacgaaacuggcaccacucagacgaaagagauggcgugauacucgacaggcugcccuacuacggcgaaauacuacaacgacacguggugccaggaagcggagaacccgaagagaaaaacgaagccgcacgcuggggaaggcuagcaaacccgacaguccacauaggccuaaaccagcuaagaaagguggucaaccgacuaaucgccgcccacggaagacccgaccagauaguagucgaacuagcaagagaacucaaacucaaccgggaacagaaggaacgacuagaccgcgaaaauaggaaaaaccgcgaagaaaacgaacggcggacggcaauacuagcagaacacggacaaagggacacggcagaaaacaagauacgccucagacuauucgaagaacaagcgcgagccaacgccggcauagcccuaugcccguauacuggcagggccauagggauagcagaacucuucacauccgaggucgaaauagaucacauacuaccagucucccugacccuagacgauagccuggcaaaccgcguacugugcagacgagaagcaaaccgcgaaaaacguagacaaacacccuuccaagcauucggagcaacaccagccuggaaugacaucguugcgagggcugccaaacuuccacccaacaaaagauggagguucgaucccgccgcccuagaacgguucgaacgagaaggaggcuuucucgggagacaacuaaaugaaaccaaauacuugagccgacuugcgaaaauauaccuaggcaaaauaugcgaccccgacaggguauacgucacacccggaacccugacaggacuacuacgagcacgguggggcuuaaacagcauccugagcgauagcaacuucaaaaacaggucagaccaccgacaccacgcaguagaugcgguaguaauaggggugcugacgcgaggcaugauccaacgcaucgcccacgacgccgcacgagcggaggaucaggaccucgacagaguauucagagacguaccaguucccuuugaggauuuccgagaucacguccgcgaaagggugagcacaaucaccguagccguaaaacccgaacacggaaaaggaggcgcccuccaugaagacacaagcuacggacugguaccagacacugaccccaacgcugcauuaggcaaucuugucgugcgaaaaccaaucaggagcuugaccgcaggagaaguagaucgcguacgagaccgggcacuacgagcaaggcucggcgcauuagcggcaccguucagagaugagagcggacgagugagagacgccaaaggacuugcgcaagcacuagaagcguucggagcagaaaacggaauacgaaggguaagaauccugaagccagacgcuucaguagucacaauugcugaccgccgaacgggaguccccuaccgcgccgucgcacccggcgaaaaccaccacguagauauaguccaaaugagggacggcagcuggagaggauucgcagcaagcguuuucgaaguaaacagaccgggcuggaggcccgaaugggaaguaaagaaacuaggcggaaaacuggucaugcgccuacacaagggagacaugguagaacugagugauaaagacgggcaaagaagaguaaagguggugcaacaaaucgaaaucagcgccaacagagucagacugagcccacacaacgauggcggcaaacuacaagaccgacacgcagaugcagacgacccuuucagaugggaccuugcaacgauaccgcugcuaaaggaccgagguugcguggccguccgcgucgauccuauaggcguggugacacuaagacggagcaacguauga

SEQ ID NO: 6140 - RNA, 3183 nt, Artificial Sequence
  Cas9 variant
auggcggucaagucucuuaacuacauccuaggucuagaccucggcauagccagcugcgguugggcagucgucgagauggacgaacaagaaaacccccuccgucucauugacguaggcguaagaacauucgaagaagcugaaaacccgaaagacggcagcucccucgcggaaacaaggcgacucgcacgagcccaaagaagacuuaucagccgccgugcaaaccggaugaacaagcucagacggcuccucaaacaggaaaacguccuccaggccaacgacuacgacgaaaagggcuuaaucaucgggcuccccaaccaagcaugggagcucagagcccaagggcuagaccgcaagcucgaacccaaggaaugggcugcaguccucauccaccuaguaaaacacaggggcuaccucucacaacgcaagaacgagagccagaccgcagauaaggaacucggcgcccugcuauccggcaugaaccacaaccaccaacuccuccagucccaaucaaaccaauaccgcaccccagcagaacuagcaaucaagcaauucgcaacacaagacggccacaucaggaaccaaagaggcgccuacacccacaccuucaacagacucgaccuccaaaacgaacuuaaccaauuauucgaugcacaaacucgacugggcaacccccacguaucaggcucccugaaaacagccauaaacgaccuccugaugaaccaaaaagcagcccugagcggagacgccauccucgagaugcuagggcgaugcaccuucgaacccucagaguacaaagcagccaaaaacacauacagcgcagagagauuuguauggcucggcaaacugaccaaccugcggauacaagacaacggccuagaauccgcacugagccgagaacagcgagagcuccuacuaaacgagcccuacaacaaaacgaaacuaaccuaccagcaaguacgcaaacugcugcgccuccccgaaacagcauucuuuaaagggcuccgauacgguaaagacaaugcugaaagcgcgaccuuaauggaaaugaaaucauaucaugccauacgaaaaucccuagaaaacaaaucccucaaauccgaaugggaaaagcucaaaacccagccgaagcuauuagaccuaaucgggaccgccuucagcaucuacaaaacagacgacgaaaucgccggcugccuuaaaaaccaauuaccagagaacgucaucaucgcccugcaggaacaacuaaacuucagcaacuucauggaacucucccucaaagcucuagaaaaacuccuuccccucauggaacaaggacuacgcuacgaugaggcuugcacccaaauauacggcaaccgccacgagaaaaucgcagacaagaccgaaaaauuccuacccaacaucccugcugacaaacuucgcaacccagucguucugagaacacucacacaggcccgaaaagucaucaacgccaucauccgccgcuacggcagcccugcacgaguacauaucgaaacgggcagggaagucggaaaaucauucagcgacagggacaaacucaaaaagcaacaagaagaaaaccaagaacaaagacgcagagcaauagaugaauggaagcaauuuuucccaaacgccgcccacgaacccaaagccgucgacauacucaaacucagacucuaccagcuacaacaaggcaagugccucuacagcggacugccaaucgacgucagacgccucccagaaaagggcuacguagaaauagaccacgcacuaccuuuuucacggaccugggacgacucauucaacaacaagauccuuguauuagccucagaaaaccaaaauaaaggcaaccaaacgcccuacgaguaccugcggggagcggacaacucggaaucauggcgacucuucguagagaacguacaaaacugucaauucuccccaaacaagaaacagaaaaucauggcaaaacaacucgacgagaaaggcuuccuagaacgcaaccucaacgauacccgcuacgucagccguuuccucugccaauucaucagugaauaccuacaccuuaccggaaaaggcaagaaacgcguauucgcgagcaaugggcaaauaacugcccuccuucgcgggcgauggggccuaucuaaaaaccgggaagagaacgacagacaccacgcagucgacgccguggucgucgcgugcagcaccgucgccaugcaacagaaaauaacccaguucgugagauaccaaaaaggcaacgucuuuacaggugaacggaucgacaaagaaaccggcgaaguuauuuccauccacuucccgacccccugggaacacuuccgagaggaagucaugaucagagucuucgacgauaacccgcuacgcacacuccccgagaaacucccuaaccgucccgaagcccuccacgaauacgucaugccccucuuugucagucgcaugccaaccaggaaaaugacaggacaagggcacaaagaaaccaucaaaucggcgaaacgccuggaugagaaaaucucagucuugaggguaccccucacacaacucaaacuaaacgaucuagaaaacaugguuaacagagaacgggagccggcccuguacgaggcccuaaaggcaagacucgaacaguucaaaaacgacccggcaaaagcauucgcagaaccauucuucaaacaaggcggacaacaggucaaggcaguccgggucgaaaucgugcagaaaucaggcaugcuccuccgaaaaauuaacggcgucgccgacaacggcagcaugguccgaguagaugucuucgaaaaaucuggcaaauucuaucucgucccaauauacgccuggcaggucgccgagggcauucucccgaaccacgcagucguccacucgaaggacgaauccgauuggauccucauggacgaauccuaccacuucaaguucgcccucuacaaaaacgaccugcuagaaguccagacgaagaaagggugcauaauggguuacuucgccagccucgaucgagcaacgggugcgauaaccauccgcgaacacgaccgcgacaagaagaaaugcaaagacggagaacaccgcagcauaggugugaaaauggcuucaucauucaagaaacuccaagucgacgagcucggcaaaaacauccacgaaacaagaucccgaaaacgcccaaacauugguuga

SEQ ID NO: 6141 - RNA, 3186 nt, Artificial Sequence
  Cas9 variant
augcacacauuacccuacacccucggccucgauaucggaauagccucaguaggagccgcccuccuaagcgacgaaagcauacucggaaugcacguccgcacauucagcgccgccgagaccgacaaagaaggcgacccacucaacaaaauacguagagaagcacgguccgcgcgccgcagaauacggagacgagcccaccgccuacuacgucuacgacgacuccucaaacguacaggacucauauccgacaccagccuagaaguucugaagaccucaaaaaccccauggcaacuucguucggagggacucgacagacuccuaagccccucggaacuagccgcggcccuguaccacauugucaaacaccgagguuuccaaagcaaccgaaaagcugaacuaaaaacugaugccaaagccggccaaaugcuuucaggcgucuccgcaaaccaacagcucaugcgagauaaaucuuaccgcacuaucgccgaaaugguguguaaagacgacgccuuuaaagaccauaaacgaaauaagggcgguucauacaggaacaccuucgcccgaucagaccucgcagacgaacuaaagacucuacucaagaaacaacgcgaauacgacaacccccucgcaacuccagaacucgaagaagccguacacacgcuucucauggcucgacgacccgucuucaaagacgacgacaucgaaaagcuagucggcuucugcaccuucgaacacggggagaaacgggcacccaaagccgccuuuucgucagaacgcuucaucuggcuaggaaaacuaaacaaucucagacuaaucuauccaggcgaacaaaggucccucacaccagaagaaaggucccaaaucaucaaccucccauucacacaagccagcguaaaauucagccaaauccgaaagaaacuagaccugccggaauacguacgcuucaaucugguccgcuacaaaccaggcgaagaaacaagcaaaagcgaaaccgccaccuucuucgaagccaaagccuuccacgagcuccgaaaaacauaucgcgaaagcggaauaagcgagcuaugggagcgagaccagcacgacccgcagagguuagaccaaaucgcaaccgccauugcaguguaccgcgacgacgaacgcauacgaaacgaacucuccccucacacgaucgaaaacgaagucguagaagcuguccuaaacugcgacuucacccaauuuauaaaccucagucuaaaagcccucaacaaaauccuaccauacauggaacaaggacaacgauacgacgaggcauguaccucagccggcuaccaacaucacagcccccaacaaaaugaagagaaaagcggacgcauacccccacccgacaaaaauguuauccgcaaccccguaguauauaggucccuaaaccaggcccgcaaacuaauuaacgccaucaccaaacgauacggugccccugcagcuauccaccuggaaauggcccgugaccuaucuaagcccuuuucugaacgaaagucaauagaacgggaacaagaaaaauaucgcaagcaaaagguucaacucagaaacgaguacauagaacacuucggcaccgaaccaaacggacucaaucuacuaaaauuucgccucuacaaagagcaagacgcccaaugcgccuacacacagaaagcccucgaccucucccgccucaacgaagccggcuacguagaagucgaucauauccuuccauacucccgcuccuacgacgacucacuccucaacaagaccuugguccucacagaggccaacagagacaaaggaaaccgaaccccuuucgaguucaugggcggagacgaucaaucccagcacuggcaaaaauucguaagauggguccaaaugaacccuaaaauacgacaagccaaaagaaaccgcuaccuccgcaaagacuucuccgaaaaagccgcccgagaguuccgagaccgacaccuaaacgacacucgauacauuggaagagaauugaaagccaugaucgaaagccacguacaauggcaccccgacuccaaauccaaagauugcugcguuguacuuagcggacaacuuacagcacuucuacgcggacgcuggggauuuaacaaagaccgagccgcaggggaccuccaucacgccgucgacgccgcagucguagcagccgccacacggggaaugauacaaagaauggcccgacacuccaaauuucacgagcucaagaacgugagaaccagcuacgccgacccagauaccggagaagucgucaacuuggcggccgcccgagaccuugaaaaacacuucccacuccccugggacaacuuuagaaacgacacccucgcauaccuaaacccgagcgcaaucagcgcggacgagagcgcacaagaagggcaccguggaguccgcguaucucgcgcaccaacaaggcggaagcugggagccgcgcaccaagaaaccauaaggagcaaaggcaaagauaacauucuacucgagcaaggccucucagcaguaaagaccccgcucuccaaacucacccucaaaaauaucgaaaacauggucggguacgaggacccacggaaugccgcccuagucaaaguccuacgagagcgccuggaagccuucgggggcgacggcgcgaaagcguuugcaccaaaccaacccccgguguacaaacccuccaagcccggaaagcaggccccagaaauacgcagcguaaaaauggccuccaaaagcaaaggcgcacuacacgucagagagggacuggcagacuccggacgaaugauaaggauagacaucuacgaaacaaagaauggcuacguagggguaccaauuuacgucagugacaaagcccgcagcaagcuccccaaagcauacccaaagaaaggcgaagaccgcgccaacuggccagaagucgauacaaacgacaacuuucuuuuuagccuauacuccacugacuggaucgaggcgaaaacaaagaaagagacaauugcaggcuacgucaaaagcuacgacaucuucgacggcagacuccucgucuacgcucacgacaauaagaaaguagugcgaaaacuaacacuuucggcccucgcagaccuucaaaaacuccacgucucaauucuaggcgaccucuacaaaggaggcaccccaaaauguagcccacuccgaaaaggacaggagcucuga

SEQ ID NO: 6142 - RNA, 3186 nt, Artificial Sequence
  Cas9 variant
augcuccgacuaggacuagacauaggaucaaccagcauaggcugguucuuauaccgcaucacaaacggaaugaucgccgaaauaauagacugcggggucagacuauucagcgauggccgagaugcaaaaacaggcguaucaagcgcggucgaacgaagaaacgcacgcgcauuacgaagacgucgggaccgauaccuccgcagacgggcagcacucaugagacgacucgccgcagcaggccuuaugccagaagacccaucccaggcaaaaccacucgaacugcucgauccauaccgccuacgcgcggacgcucuggaccgccgacucgaacuaacagaacugggcagagcacuguuccaccucaaccagagacggggauucaaaagcaaccggcaaaccgacagagguaacaacgagggcggcaaaauuauagauggcuccgcgcgccucgaccaagcaaugauggcagugggcgcacguaccuacggagaauuucuccaccugaggcguagucaagccgaggaccugcgccgggugcccuccguaagaacccgccugacgcuacggucaguggacggcggaaaggcugaaaccggauacgacuucuacccagaccgccgacaucucgaagaagaguucaacaaaguuugggcggcacaagccgcacaccacccgguucugacggacucacuucgacacgaaguauucgaaaccauuuucuuccaacgcccacuaaaggccccagcgguaggucguugucuauucuuuccugagccccggcucccaagggcacacccccugacccaacgccgcguacuuuacgaaaccgugaacgcgcuaagaauacgaacggaauccggcgcagcagugccccucggcaaagaacagcgagacaagguaaucaugcucuuagacggaaaagcuccuguuaaagcaauagccucggcuaaguuaucacucaaagcgauagccaaacaccuaaaacuccgcgacggucaaacauuuacccucgaaaaaggaagagauuacauagccugcgaccccguucgcgcaagccuaucccauccagaccgguucgggcccagaugguccguucucgaggcagaggugcaagcagaaauaguaggccgaauccgggacgacgacgacaccauggcgcucguggaauggcucaagcaaguccacggccuagacgacgcacacgcccgugccaccgcugacgcgccacuccccgagggauacgggcgacuaggcgaaaccgcaacacgaaaacuacucgacugccucaaagcagaaguacugaccuacagcgaagcaguagguaaagcacuggaccaacaccacucagacagacggacaggagaaauauuggaaagccuaccguacuacggagagguacuacaagcccacguaauaccgggcacgggagaaccccaccacgacgacauaaccagauucggcagaaucaccaaccccacaguacacaucggccuaaaucaacuaagacgcuuaguaaacagaaucaucgcgcgcuauggcaaacccgcugaaaucguaguagaacuagcccgcgacuuaaaacaaagcaccggccaaaagaaagccgccaucgcacuaaaccucaaaaaccgcaaagcggcagaagcaaggagcgcccuccugaccgaauggggcgucccagauaccggggcgaaccguauguauguacgucuguggcaagagcugcacgaagaucccaugaugagacgcuguccauacaccggaacaauaaucucgccaagccuacuguucucgggagccaucgacaucgaccacauccucccguauucacgcacgcuagacgacagcacagcaaaccgcaccuugugcaugaaagaagccaaccgacaaaaacgcaacaaauccccauccgaagcacgccgcgacggcaugagaauaugggcacucgaagacgacaaucuccgacacaucccugaguucaaacguuggcgcuucgcggaagaugccauggcgagauucgaaggcgaacgagacuucgaagcgagagcacugguagacacccaauaccuaagccgcauaagcaaagcauaccuagaaacacucuacgacggcgccgacggcaaaagccacguaugggucgucccaggacgccugacggaaaugcuucgcagacacuggggacucaacggcauccuaaccgauccacuacgcgacgugacaaaagaaaagaaucgaauggaccaccgacaccacgccauagacgccgccgucgucgcagcgacagacagaggccucaucaaggcuauggccgaacaagcccgcacugacgucgaccaagggagagaagcacucgccuccucaauaaugccaccuuggccaggauuccgcgaagcagucgccgcacaagucgaccgcauaaucguaucccaccgaccugaccauggacgaauagaucucaccacccggaugaagggacgagaucagacaacagggccgcuucaccgcgacacagcauacgggcuaacaggacaguccgaaaaaggcgucccacucguagucacccgcgagccauucgacaaccucaccccaaccaugauaggaaaaauaagagacgagccgcucaaagcagcacucgcagcggugaccgcaggcaagaaagacgacgccuuugcggaagcccuagcacacuuccgcgaccgcccgggaccauaccauggcauccgacgaguacgacugauagaaccaauaagcgucguagaaauacgcgacgcaaguggccgcgccuauaaaggcuacaaaggaaacagcaaucacugcuucgagguauggcgccuacccgggggcgcaauaacagaacacaucgucagcacauucgacgcccaccaacccggcccugaaccacggccccaccccgccgcgaaacgacuccuucgacuguucaaaagugacauggugaaacuugacgacucgaaauucggacccguuaucgccacaguagugauguucgaccgaaacggaaaaaucucucucguuccacacacugcauccaacgcacgaaaaagaugcgaaaaauacaaagaggaccucuaccuacgguucaccgcacgcacacuaaucgaggccggagcccggaggauaauaguagacgaaaccgggcauuuccgggacccuggacggaaaggauga

SEQ ID NO: 6143 - RNA, 3189 nt, Artificial Sequence
  Cas9 variant
auggccgagaagcaacacagauggggacuagauauaggcacaaacucaauaggaugggcagucauagcccucaucgaaggacggccugccggccuaguagccacaggcagcagaauauucuccgacggacgaaaccccaaagacggcagcucacuagcagucgaaagacggggaccgcgacaaaugcggcgacgacgagaccgcuaccuccgacguagagaccgguuuaugcaagcccuaauaaacguaggccugaugcccggcgaugcagcagcgagaaaagcacucgugacagaaaaucccuacguccuccgccagcggggauuagaccaggcucucacccuaccggaguucggacgcgcccuauuccaccucaaucaaagacgcggcuuccaaagcaaccgaaaaacggaccgagcgaccgcgaaggaaagcgggaaagucaaaaacgccauagcagcguuucgcgcaggcaugggaaacgccaggacaguaggagaagcccucgcacgacgccuggaagacgguaggccaguacgagcaaggauggucggccagggcaaggacgagcacuacgaacucuauauagcgcgagaauggauagcacaagaguucgacgcucugugggccucacagcagagguuccacgcagaaguccuggcagacgccgcacgcgacagacugagggccauacuacuauuccaacggaaacuccuaccaguccccgucgggaaaugcuuccucgaaccaaaccaaccccgaguagccgcagcacuaccaagcgcacaacgcuucagacuaaugcaagaacucaaccaccucagaguaaugacccuagcggacaaaagagaacgaccccugagcuuccaagaacgaaacgaccucuuggcacaacucguggcacgaccaaagugcggcuucgauaugcugaggaaaaucguauucggugcaaacaaagaagcguaccgauucacaauugaauccgaaagacguaaagaacugaaaggcugcgacaccgcagcgaaauuggcaaaagucaacgcacuaggcacaagauggcaagcauuaagccuagacgaacaagaccggcuuguaugccuacuacuagacggagaaaacgacgcaguccuagcagacgcccucagagaacacuacggccucacugacgcacagaucgacaccuuacucgggcucucguucgaagacggccacaugcggcuaggccgcagugcccuccuaagggugcuagacgcacuagaauccggucgagacgagcaagggcuacccuuauccuacgacaaagcagugguagcagcgggauauccagcgcacacggccgaucuggaaaacggagagcgggacgcccugcccuacuacggagaauuacuguggcgauacacacaagaugcaccgacagcaaagaacgacgccgaacgaaaauucggaaaaauagcaaacccaacaguccacaucggacucaaccaacuacgcaagcuagugaacgcgcugauacaaagauacggaaaaccggcacagaucguaguagaacuagcaagaaaccugaaagcagggcuagaagaaaaagaacgaaucaagaaacaacaaacagcgaaccucgaaagaaacgagcgcauacggcaaaaacuccaagacgcaggaguccccgacaaccgagaaaaccgccuacgcaugagacucuucgaggaacucggacaaggaaacgggcucggaacaccaugcauuuacucggggagacaaaucucgcugcaaagauuauucucaaacgacguacaaguugaucacauauuacccuucucaaaaacacucgacgacuccuucgcgaacaaaguacucgcacaacacgacgcaaaccgguacaaaggaaaucgagggccguuugaagcguucggagccaaucgggacgguuacgcgugggacgacauaagagccagagcagcagugcuaccccggaacaaacgaaaccgauucgccgaaaccgcgaugcaagacuggcuacacaacgaaacggacuuccuggccaggcaacugaccgacacagcguacuuaucacggguggccaggcaauaccucacagcaaucugcagcaaagacgacguguacguaagcccaggccgguuaaccgccaugcugcgagcaaaauggggccuaaacagaguacuggauggagucauggaggagcaggggcggccagccgucaaaaacagagacgaccaccgacaucacgccaucgaugccguaguaauuggcgcaacagacagagcaaugcuccaacaaguagcaacacuagcggcacgagccagagaacaagacgcagaacgacuaauaggagacaugccaacuccauggccaaacuuccucgaggacguccgcgcagccguggcacgcugcgucguaagccacaaaccggaccacggaccggaaggaggccugcacaacgacacagccuacggaauugucgccggcccauucgaagacggaagauaucgaguccgacacagaguaagccuguucgaccuaaaaccuggcgaccuauccaacguccgaugugacgcaccacuacaggcggaauuagagccuauauucgaacaagaugaugccagagccagagaaguagcccuaaccgcacucgcagaacgauaccggcaacgaaaagucuggcuagaagaacuaaugagcguccuacccauacgaccaagaggcgaagacggcaaaacccugcccgauagugcccccuacaaggcuuacaaaggagacagcaacuacugcuacgaacuguucauaaaugagagaggucgaugggacggagagcugauaucgacguucagagcaaaccaggccgcauaccgccgauuccggaacgaccccgcgcgcuuccgcagauacacagccggagggcguccguuacuaaugcgccugugcauaaacgacuacauagccgugggaacagccgccgagagaacaauauuucgggucguaaaaaugucagaaaacaaaaucacccucgcugagcacuuugaagggggcacccuaaaacaacgggacgcagacaaggacgacccguucaaauaccucaccaaaagcccaggcgcguuacgagauuugggcgcccgcaggauauuugucgaccuaaucggacgagugcuggaccccggcauaaagggggacuga

SEQ ID NO: 6144 - RNA, 3189 nt, Artificial Sequence
  Cas9 variant
augaaccucaacuacauccuaggccucgaccucgggauugccucggucggaugggcgguggucgagaucgacgaacaggaaaauccgcagcgccuaaucgacgucggcguacgaaccuuugaccgagccgagguccucaagaccggagaaucccucgcacucgcaaggagacucgcacgauccagccgaagacuggucaaaagacgagccgaacguaucaaaaaggccaaacgacugcuaaaagccgaaaacuuacuacucucagcagaugagauacuccccaacgaggcauggcagcuucgcguaaaagggcucgaccaaaaacucgaacggcaagaaugggcagccguacuccugcaccuacucaaacaccgcggauaccucagccaacgaaagaacgaaagcaaaagcgagaacaaagaacuaggcgcccugcucagcggcguagcaauaaaccaccaaauccuacaaucugccgaauaccguacaccggccgaaaucgcgguaaacaaguuccaggcagaagaaggacacauccgcaaucaaagaggcgcauacacccacacauuuagccgacucgaccuccuugcggaaauggaacuacucuuccagagacaagcgacgcucggcaauccccauacgagcaccaaacuccuagaaaaccucacagccuuacuaauguggcaaaaacccgcccucgcaggagaagccauccuaaaaaugcucggaaaaugcaccuucgaacccaccgaauacaaagcagcgaaaaacuccuacagcgcagaacgguucguauggcucacaaaacuaaacaaccuccgcauacuugaacagggcgccgaacgggcucucacggacaacgaaagguucgcccuacuagaccaaccguacgaaaaagccaaacucacauacgcccaaguccgcacacuccuaggacuauccgacgaggcgauauucaaaggccuacguuaccagggagaggacaagaaagccguggaaaccaaaacaacgcucauggaggucaaagccuaccaccagaucagaaaggcccucgaaggccucgaccucaaggccgaauggaacgagcugaaaaacaaucccgcacuucuggacgagaucggcaccgcguucucucucuacaagacggacgaugacauacaccgauaccuagacgguaaacucucagagucaguccucaacgcacuacucgaaaaccuuaacuucgacaaauucauucagcucagccuaaaggcccuacagcaaauccucccccucaugcuccaaggacaaagauaugacgaagccgugagcgccauauacggagaccacuacgggaaaaaguccgaugagauagaccgacuuuuacccaacauaccuaccgacgagauaaggaauccuguaguccucagaacauuaacgcaggcgaggaaaguaauaaaugccguaguacgacuauacggaucccccgcccgaauccauaucgagacuggacgggaaguagggaaaagcuaccaagaccgcaagaaacucgaaaaacaacaagaagaaaaccgaaaacaaagagagaacgcugucaagaaauucaaagaguacuuccccaacuucgucggagaaccgaaaggaaaagacaucuugaaaaugcgacucuacgaacuacaacaagccaaaugccuguacagcggcaagucacuggagcucuaccgccuccuagaaaaaggcuaugucgaaguagaucaugcacugccauucucuaggaccugggacgacucauucaacaacaaaguauuggugcuagccaacgagaaucaaaacaaaggcaacgcaacgccguacgaguggcuggacggcaaaaacaauagcgaaggauggcaacacuucguagcacgcguccaaaccuccggauucucguacgcaaagaaacaaagaguccuaauccaagaacuagacgaaaagagcuucauagagcgcaaccugaacgacacccgcuaugucgcccgauuccugugcaaccacaucgccgacaacaugcuccucacuggcaaaggcaagagaaaagucuucgccaguaacggccagauaacggcacugcucagaggaugcuggggccuacagaaaguacgcgagaacaacgaccgucaccacgcacucgacgcggucguggucgcaugcagcaccaaaaguaugcaagacaaaauaacgaaauucgucaaauacaaagaaggacgccuauucaaagacaagaaagacggagucuacaaaggggaaagaauaaaccgagagacaggcgaaaucaucucgcuacacuuccccacccccuggaaauucuucaaagagaacgucgaaauccgcaucuucagcgaaaacccgaagcuggaacuggagaacaggcugcccgauuacccccaauacaaccaugaguucguacaaccguuauucgucagccguaugcccacucgcaaaaugaccggccaagggcacauggagacggugaaauccgcaaaacgccucgacaaaggcuuguccguacuaaaagugccccuaacccaacuuaagcucuccgaccuagaacgcauggugaacagagagcgcgaaauggcacuauacgaagcccuuaaagaaugccuggaacaguucggcaacgaccccgccaaagcauuugcggaacccuucuacaagaaaggaggcgcgcuagucaaagccguccgcguugagcaaacccagaaaagcgguguccuuguccgcaacggcaacggaguggcggacaacgccacaggcuccaucguacgggucgacgucuucacgaaaggcgggaaauacuuccucgugcccauauacacauggcaaguggccaaagggauccuccccaacaaagcgguaauccagggcaaagacgagagcgaaugggaagaaauggacgaaaacgccgucuuccaauucucgaugcacaaaaacgaccugauaaaaguaaaaacgaagaaaggcgaaauauucggcuauuucaacggacucgacagagcaaccggauccauagaaaucgaagaacacgaccucgagaaaagcaagggcaagaauggaucacaccgcggacuagggguaaaaaccgcauucuuccuagaaaaguaccaagucgacgaacuuggcaaaaacauacggccgugcagacccaccaagagacaacacguaagauga

SEQ ID NO: 6145 - RNA, 3192 nt, Artificial Sequence
  Cas9 variant
auggaaaaccacaucaacuaccgccucgggcucgacaucggaauagcaagcguaggcuggucaguaauaaaccucgacaagaaacgaaucgaagaccuagggguacgcauauucaacgcggcagagcaccccaaagacgggagcucgcucgcacucccaagacgaauugcccgagggcgacgccggcuacuacgacgcaaagccuacagagugaaaagaguccgcaaacugaucguggacuacaauauacuaacgaaggaccaacuaaacgaccuguucaagcaaaaaugccaaaacuccgugugggaaauacgcguuaaagcccuggacaacaaagucaccaacgaagaaugggcccgccugcuaaucaaccucugcaaacgccggggguucaaaagcaaccgcaaaaacgaggccgacgacaaagaaacaaagaaagucaucaacagcaucaaaagcaacaucaaagggaugaaagagagcggcagucgcacaauaggcgaguacaucuacacccaaacucucucaucgggcgauauaaguaaaaguuuccgcaacaaagacggccaauauaacaacugcguuucacggaaaaugauagaggaagaaaucaaaauccuauucaagaaacagcgugagcugggcugcgaguucgcaagcgaagaaauugaggaaaaauaucuggccauauucaacucccagaggccauucagcaaauucgaagaccuagaaaagauggugggcuuuugcacguuugagaaagcauccaaagagcgacgcgcgcccaaaugcaguaucagcgcagaggaguucguccucuacgacaacaugaacaaacucuccauccucaacaaaggagauacacgaaagcugacaaacgaagaacggaaaauaauagucgaaaaugccuucaaaaacaaagaaaucaaauacucaaaacuacggaaaauacuaaacuuaagcaaugacgaacgguucagcacgcucagcuauagcaacaaaaccgaacugagcaagaccgagaacucgaaauucgucgcgcuuaagggauaccacgagauuaaaucggcaaucgaaaaaucauuugggaaagacacauggaaucgcgugaaaaacaaccguaccaugcuaaacgacaucgcauacguccuuagcaucgcgaagaccgacgaagacaucauaaaacaacucucgcuccgaaacaucccccgcgagaucauugacgcaguccucggccuaucguuuucaaaguucucgaaccuauccauaaaagccaucgagaaaauacucccguaucugaaagacggucaacaauacaacgaagcaugcaagucagccggcuacgacuucaaagcaaccuacaacggcgagaagucguacaaacuaccgcuaauagacauagacgaaauagugaauccggucguaaaccgagcgcuaagccaaacgagaaaagugaucaacgcugugaucgaccgcuacgggagcccgauaggaauaaacauagagcuugcccgcgaccucgccaaaaacuucaaggaccgcucaaaaauaaagaaagaacaagaagagaacagggccaacaaagagaaaaucaagaacgaacuaaaaaugcucaugaacaaagaaccaacuuccucggaaauccucaaauaccggcucuggaaggaacaacgcgaagaaugcgccuacagccaggagagaauuuacauugaagaccuauucaaggugggccaguacgaaaucgaccacaucaucccauucagucgcagcuucgacgacucacugaacaacaaaguacugguaaaggccgcggagaaccaaagaaaggccaacagaaucccauacgaguacuucggaagcgacgaagaccgcugguaccgcuucgaaguaugggucgaacaaucaaguuugucauucaagaagaagaacaaccuccucaagaaacgguucucaagagaagacuccaucgaguucaaagaccguaaccuagucgacacccaguacaucuccagauacauaucgaacuuuauaaaaucccggcuaaucuucaaggaauccgacuccaaacaaaaaguaaucaccaucaacggccgcgcgaccucauaccuacgcgcgaaguggggcuugcucaaggucagagaaaacggagacaaacaccacgcgcucgacgccacaguaauagcagucgcaacucaaggaaugguacaagaaaucucaaaguauagcaaggcucacgaacugaaauacauccgacaaggggacgaauuuaucgacauagaaacaggcgaaauagucaaagucaaggaccacaaacaccuaagcaaagaccgccuccccgaaccauggcucggcuucucauccgaacugcgacugcgccucuccgaaaacccgauagaggaacucaagaaaagucccaucuccaccuacgacgaagaguucauacgcaaaacaguccgcccuauuuucguguccagaguacccuacaggaaagucaccggacgccucuucgaagaaaccguauacagcccgaaagcauucauagaugaaggcuucaucgcuaaaaagaaacuccaggaccucacacucaaagacuucgagaacauuuacaacuacaacagcgauaagaaacucuacgaugcgcuacgggagcgacucgaggaauacggaggaaacgcaaagaaagccuucgccgaagaguuccggaaaccaaccaaaaccggcaaacucggccccaucguaaaaucaauaaaagucaaaaccaagaucccuuucaaagacggaauugaccuaaacgguggcaaagucaaaaaggauggacucguacgaauagacauauaugaaaaagaaggcaaauacuacguaguacccguguaccggcucgacauacaacagggcaauauccccaaaaaggcggcgguagcuaacaaagaagagaaagacuggauccucauggacgaaucguacaacuucaaauucucgcuguacaaaaacgaccucaucuacauaaaauacgauagcaagggcgaguacuuuggauacuaugacggcuucgaucgccacaccggcgcaaucacgcucgaacggcaugacaacucggagagauaucgcgggauagggaucaaaacaggcgugaaagagauauucaaguacaaugucgacgugcucgguagguacuacaaagucgccaaauga

SEQ ID NO: 6146 - RNA, 3192 nt, Artificial Sequence
  Cas9 variant
auggagaaauuucacuauguccucggguuagaccugggaaucgccuccguaggcugggccgcaaucgaaaucgacaaagagacggaaaccucgaucgguuuauuggacugcggaguccgcaccuucgaacgcgccgaagucccaaaaacaggagacucucuagccaaggcacgacgagaagcccguucgacucgccgccugauuaggcgcagaagccaucggcugcugcgacuaaaacgccuccucaaacgagagaucuuuaggcaaccagagacuuucaaagaccucccuaucaacgcauggcaacuaagagugaaagggcucgacucccgccucaacgaauaugaaugggcagcgguccuacuccaccucgugaaacaccgcggcuaccucagccaacgcaaaucagaaaugucagaaaccgacuccaaauccgaaaugggccgccuccuugccggaguagccgaaaaucaccagcuccuacaacaagaacaauacagaacacccgcugagcuagcgcuuaagaaauucgucaagcacuuucgcaacaagggaggagauuacgcacacacauucaaccgucucgaccugcaagcagaacuacauuuacuauuccaaaagcaacgugaauugggcaaucccuucacaucacccgaguuagaaaggcaggucgaugaccugcuaaugacgcagcgcucugcccuccaaggcgacgcaauccucaaaaugcucggccacugcggcuucgaaccagaacaguucaaagcggccaaaaacacauucucggccgaacgauucauauggcucacaaagcucaauaaccugcgcauacaagaccaaggcaaagaacgcgcacuaacggccgacgaacgaaccaaacuccucgacgagcccuacaaaaagagcaaauuaacguaugcacaaguacguaaacuucuaagucucccacaaacagccaucuucaaaggccuaagguacgaccuagagcacgacaagaaagcagaaaacucaacccucauggagaugaaauccuaccacaacauccggcaaacgcucgaaaaaucuggguuaaaaacagaauggcagucgaucgccacccaacccgaaauccucgacgcaauuggaacagcauucucgauauacaaaacggacgaggacaucagccacgaacugaaaacaugcaggcuacccgaaaacguacucaacgagcuacucaaaaacauaaacuucgacggcuucauacagcuaucgcucacugcacugagaaaaauccugccccucauggaacaaggauacagauacgacgaagccugcacccaaaucuacgguaaccaccacucaggaucacugcaacaagaaaguaagcaauuucucccacacauuccaauagacgaugucagaaaccccgucguauuucgaacgcugacccaagcacgaaaggucgucaaugcgauaauccgacgcuauggaagcccagcccgaguacacauagagauggcaagggaauuaggcaaaaguaagagcgaccgcgaccgcauugaaaaacagcagcagaaaaacaagaaagaacgagaaaacgcagucgccaaauuuaaagaagacuuccccgauuucguaggcgaaccccgagggaaagacauccucaaaaugaggcuuuacgaacaacaacacgguaaaugccucuacucgggacacgacaucgauaucaacagacucaacgaaaaaggcuacguagagaucgaccacgcccuaccguuuucgagaacaugggacgacucgcaaaacaacaaaguccuggugcugggcucagaaaaccaaaauaaacgcaaccagacucccgacgaauaccuagacggcgccaauaauucacaacgguggcuugaguuccaagcccgcguccaaaccugccacuucucauacgggaagaaacaaagaauccagcuagccaaacuugacgacgaaaccgaaaaagguuuucuagagcgcaaccuaaacgacacacgcuacaucgcacgguucaugugccaauucgugcaagaaaaccucuaccucacagguaaaggaaaaagacugguauucgccucaaacggaggcaugacagccacccuacguaaccucuggggacuccgcaagguccgagaagacaacgaccgacaccacgcgcuggacgccauagucguagccugcagcacagccuccaugcaacaaaagaucaccaaggccuuucaacgacacgagaguaucgaauacguagacaccgaaaccggcgaggucaaauuccgcaucccgcaacccugggacuucuuccgacaagaagucaugauccgcgucuucucggaccagccuugcgaagaccucgucgaaaaacucuccgcgagaccggaggcacuacacgacaacgucaccccacuauucgucucccgugccccaaaucgaaagauguccggccagggccaccuugaaaccauaaaauccgccaagcggcucagcgaggagaacagcauggucaagaaaccccucaccacccuuaaacucaaagacauaccggaaaucguuggcuaccccucccgcgaaccucaacuguacgccgcccugaaaacacgacucgagacacacgaugacgaccccaucaaagcauucgcaaaaccauucuacaaacccaacaaaaacggggaacuaggcgcccucguccgaucaguucgagucaaaggugugcaaaacaccggaguaaugguacacgacggaaaaggaaucgcugacaaugccacgaugguccgcguugacguauauaccaaagcgggcaaaaacuaccuuguacccguguaugucuggcaagucgcccaaggcauccucccaaacagagcugucaccagcggcaaaucagaagcggacugggaccucaucgacgaaucauucgaguucaaauucucccuuucacgcggcgacuuggucgaaaugauaagcaacaagggacgaauauuuggauacuauaacggccucgaccgcgcuaacggcucaauaggaauacgcgaacacgaccucgaaaaauccaagggcaaagaugguguccaucgcgucggcguaaaaaccgccacagcauucaacaaauaccacgucgauccguuaggaaaagagauccaccgcugcuccuccgaaccacggccaacccuuaaaaucaaaucaaagaaauga

SEQ ID NO: 6147 - RNA, 3192 nt, Artificial Sequence
  Cas9 variant
auggagaaagacuauauacuuggguuggacaucgguaucggcuccgucggauacggccuaauagauuacgacacaaaaagcaucauugacgccggcgucagacuauuccccgaagccaacgccgacaacaaucucggcagacgagcgaaacgaggcgcccgacgccuaaagcgccgccguauacacagacucgaaagaguaaagagccuacuaagcgaguacaaaauaaucucgggccucgccccaaccaacaaccagcccuacaacauccgggucaagggacucacggaacagcuuacaaaagaugaacuggcaguggcccuauuacacaucgcaaagagaagaggcauacauaacguggaugucgccgccgacaaagaagaaacugccagcgacagccucucaacaaaagaccagaucaauaaaaacgccaaauuccuugagucgcgguacguaugcgagcuacaaaaagaacgucucgaaaacgaaggucacguaagaggcguagaaaaccgcuuccucaccaaagacauaguccgcgaggcgaagaaaauaauagacacccaaaugcaauacuaucccgaaaucgacgagaccuucaaagaaaaauacauuucgcucgucgagacucgcagagaauacuacgaaggccccgggaaagguucccccuacggcugggacgcagacgucaagaaaugguaccaacugaugaugggccacugcacauacuuccccgucgaguuccggagcgucaaauacgcuuauaccgccgacuuguacaaugcccuaaacgaucuuaacaaccugaccaucgcgagggacgacaaccccaaacuggaauaucacgagaaauaccacauaauugagaacguguucaaacagaagcgcaacccaacacucaaacaaaucgccaaagagaucggcgugaacgacaucaauaucucaggcuaccgugucaccaagagcgggaaaccccaauucaccuccuucaaacuguuucacgaucucaaaaaggucgugaaggaccacgccauccucgacgacaucgaucugcuuaaccaaaucgcagagauacucacuauauaccaagacaaagacucgauaguagcggaacucggacaacuagaguaucuaaugucggaagcugacaagcaguccaucagcgagcuaacgggauacaccggcacgcacagccuaagccuaaaaugcaugaacaugauaaucgacgaacuauggcacagcuccaugaaccaaauggaaguguucacauaccucaacaugcgccccaagaaauacgagcuaaaaggcuaccaacgaauacccaccgacaugaucgacgacgccauccuguccccaguagucaaacgcagcuucaagcaagcgaucgguguagugaacgcaaucauaaagaaguacggccuuccuaaagauaucauaauagaacucgcccgcgagagcaacuccgcagaaaagagccgauaccuucgcgcgauccagaaaaagaacgaaaagacccgagaacgcaucgaagcaaucaucaaagaauacggcaacgaaaacgcuaaagggcuaguccagaaaaucaaacuccacgacgcgcaagaaggaaaaugucuauacucuuuaaaagacaucccacuggaagaccuccuccgcaacccgaacaacuacgacauagaccacauaauaccucgaucagucagcuucgacgacagcaugcacaacaaaguccucguacgccgcgaacaaaacgcaaagaaaaauaaccaaacacccuaccaauaccucaccagcggcuacgccgacaucaaauacuccgucuuuaagcagcacguacuaaaccucgcagaaaacaaggaccggaugaccaaaaagaaaagggaauaccuccucgaagagaggaacaucaacaaauaugacguccaaaaagaguucaucaaccguaaccucguugacacgagauacacaacacgagaacugaccacacuccugaagaccuacuucaccaucaauaacuuagacguuaagguuaagaccauaaacggcaguuucaccgacuuccuacgaaaacgguggggcuuuaagaaaaacagagacgaaggguauaagcaccacgcggaggacgcccuaauuaucgcaaacgcggacuaccuuuucaaagaacacaaacuacuaaaagaaaucaaggacgucagcgaucucgcgggcgacgaacgcaacagcaacguaaaagacgaagaccaauacgaagagguauucggaggguacuucaaaaucgaagauauuaaaaaguacaaaauaaagaaauucucccaccgagucgacaagaaaccaaaccgacaacuuaucaacgauaccaucuacucaacacgagucaaagacgacaaaagauaccugaucaacacauuaaagaaccuauaugacaaaagcaacggcgaccucaaagagcgcaugcaaaaagauccagaaagucuccucauguaccaccacgacccucagacauucgaaaaacucaaaaucguaaugucccaauacgaaaacgagaaaaacccgcucgccaaguacuucgaggaaaccggucaauaccugacaaaguacgcuaaacacgacaacgggccagcaauccacaaaaucaaguacuacggcaacaagcuagucgaacaccuagacauaaccaaaaacuaccacaacccccaaaacaagguaguacagcucucgcagaaguccuuccgcuucgacgucuaccaaaccgacaaagguuacaaauucauaagcauugccuaccucacacuaaagaacgagaaaaacuacuacgcaaucucacaggaaaaguacgaccaacuaaaauccgagaaaaagaucagcaacaacgcgguguucauaggcucuuucuacacguccgacaucaucgaaauaaacaacgaaaaauuccgagucaucggagugaacagcgacaagaauaaccucaucgaagucgaucgcauagacauccgacaaaaagaguucaucgaacuagaagaagaaaagcaaguaaacuacaugaauagcgacagcuacuugaaaaacaaucgcaucaaaguaacaauaggccgaaaaacgaccaacauagagaaguuccacacggauauccucgggaacauguacaaaagcaagcggcccaaagcaccccaacuugucuuuaagaaaggguga

SEQ ID NO: 6148 - RNA, 3195 nt, Artificial Sequence
  Cas9 variant
augagcgaaugcgugacacgacggauccuaggaauagaccuggggauagccagcugcggauggggaguaauagaaguaggagaagcaaguggaucaauaaucgcaagcggcgugagaugcuuugacgcaccccugaucgacaaaaccggggagcccaagagugcaacaagacggacagccaggggacagaggcggauaauacgcagacgaagacaaaggaugaacgccguuagaaggcuacuagcagaguucggaguacugacgggcagaagccccgacgcacuacaccaagcauuacuaagacucucccaaagcguggccggaucacaagugacacccuggacccuacgcgcugcagcacacgaacgaaagcuaacgaacgaugaacuagcaguaguccuagggcacaucgccaggcaccggggguuccgaagcaacucgaaaaacgacggaggggccaacgccgccgacgaaaccagcaaaaugaaaaaggcgauggaaaccacgcgugaaggacuagcaagauaccacaguuucggggcuaugaucgcaagcgacccaaaauucgcagaccgaaaaagaaaccgagacaaagacuacucgcacacagcaaagagguccgacuuagaagacgaaguacggacgaucuuccgcagccaaacacgcuucggcagccuaguugcaucagagaaauuaucgcaagcauucgcggacgcggcguucuuccaacgaccgcugcaagacagcgaagacauggucgggucaugcccauucgagcccggacaaaagcgaaccgccaggagagcaccgagcuucgaacuguucagauucuuaagcagacucgcaaaccugaaacuaaccguaggcagagccccagaaagacgacucacgccagacgagaucgcacuagccgccaaagguuucggagaaacaaagaaaucgauaaccuucaaaagccuccgagaggcacuagaccuugaccccaacgcaagguucagugggguggcuaaagaaaaagagucaacccucgacguggcagcgcgcaccggaggugccgcauacggcacaaaaacacuaaaagacgcacuaggagacgcccccuggaggucgcucagcaggaugccagaaaaacucgacagaauugcagagauacuauccuucagagaggacaugaaagcuaucagaaacggccuggaagaagucggacucgacggccuagucguggacgcauuaaugcaagcaacagcaaacggagacuucaaggacuuuaccagagcagcccacauaucagcgcuagccgcaaggaacauaauaccaggacuacgggaggggcugguguacagcgacgcaugcacaaggguaggauacgaucacgcggcccgacccgcaguaccacugucacaaauagggucacccguaacaagaaaagcacuguccgaagcccugaaacaaguacgggccguagcccgagaguacggaccgauagacuacuuccacaucgaacuagcgaggagcauagggaaaucagcagaggagagaaagaaacucacagacgguaucgaagcgcgaaacguggaaaaagagaagcgcagaaaagaagcagcagaacaccucggcagagcaccaagcgacgacgaacuccucagguacgaacuagcuaaagagcagaacuucaaaugcaucuacagcggagacccaauugacccagccggcauaucagcaaacgacacgagauaccaaguggaccacauccucccauggucaagauucggggacgacaguuacguaaacaaaacacuaugcacagccagaagcaaccagaacaagaggggcagaacgccauucgaaugguucgacgcggacaaaaccgaagccgaauggauggaauacagcgcccgcguagaggacuuaaaagaaguaaaagggagaaagaaacgaaacuacucgaucaaagaugccgcaaguguagaagacaaguucaaggcacgcaacuuaacagacacgcaaugggcgaccagacuacuagcggacgagcuaaaaagaauguuuccaccaagagagugcgaaagaguagucaccguaagagcagacgguggcaaugacggccucagcauaguagaggaaaggaggguauuuacgagaccaggcgccauuacaucaaagcuaaggagagcguggggacuagagggucucaagaaacaagacggcaaaagagucgaggacgacaggcaccacgccguagacgcgcuaguccuagcggccacuacggaaucacuacuaaacaggcucaccguggagguacaacaacgcgaaagggaaggacgacaggacgacauauuccacugcucccaaccauggccaggcuucagagucgacguucagcgaacuguauacggcagcgaaacaaugcccggcauuuucgugucaagagcagaaagaaggcgcgcaaggggaaaagcccacgacgccacaguuaaacagauuagagauauagauggcgaaaggauaguguucgaaagaaaaccgauagagaaacucacagacaaagaccuggagagaauaccaguccccgaaccguacggaaaagcagcagaccccaagaaacuacgagacgaacuugucgaaaaccugcgggcguggauagcagccggaaaaccgaaagauaaacccccacggaguccaaaaggagacauaauaaggaaagugaggauagagaccaaagacaaagucgccguagagauaaacggcgggaccgucgauagaggggacauggcgagaguagacguuuucagaaagaaaaacaagaagggagugugggaguucuacgugaucccaaucuacccgcaucagauagucgcgagcgcacucccaccaaaucgagcaguaauagcauacaaagcagagagcgaauggacagcgauagacggaugcuucgaguucgcauggucccugaacccuaugagcuaucucgagcuaguaaaaucaaacggggaacugauagaaggguacuuccguagcauggaccgaacaacgggcgcaaucaaccugaguccgaugucaacaaacagcgaaaccauccggagcauaggcguaaaaacacucagcuccuuccggaaguuuacaguggaccgacuggggcggaaguucgaaaucccaagggaaguacgaacguggagaggugaagccuguacauga

SEQ ID NO: 6149 - RNA, 3195 nt, Artificial Sequence
  Cas9 variant
augaagagaacaucacuaagagcguaccgacucggagucgaccucggggccaacucacuaggcugguucgucgucuggcucgacgaccauggacagcccgaagggcuaggcccggguggagucaggaucuuucccgacggcagaaacccccaaaguaaacagagcaacgcugcaggacgccgccuagcccgaucagcacgccgccgaagagaccgauaccuccaacggcgaggaaaacugaugggacuccucgugaaacacggucucaugccugcagaugaaccugcacgcaaacgacuagaaugccuagacccguacggccucagagccaaagcgcucgacgaaguacucccccuccaucacguaggccgagcccuuuuccaucuaaaccagagacgcggauuguucgcgaaccgagccaucgagcaaggugacaaggacgcaucggcaaucaaggcggccgcaggacgccuccaaacaagcaugcaagcauguggagccagaacccucggcgaauuucugaacagacgccaccagcuucgcgccaccguccgggcacgaagcccugucggaggcgacguccaagcccgauaugaauuuuacccaacaagagccaugguggacgcggaguucgaagcaaucugggcggcucaggcuccccaccaccccacgaugacggccgaagcccacgacacaauccgagaagcgaucuucagccagcgugccaugaaacgccccucaauaggcaagugcagccucgaucccgccaccucacaagacgacguugacggauucaggugcgcuuggucacacccacucgcccagcgcuucagaauauggcaggacguacgaaaccuagccguagucgagaccggaccaacgagcucucgacugggcaaagaagaucaagacaaaguagcccgagcccuucuccaaaccgaucaacuauccuucgaugagauucgaggacuacuaggacuccccagcgacgcacgauucaaccuagaaagcgaccgcagggaccaucucaagggggacgccacuggugcaauccuaagcgcacgacgccauuucggcccagccuggcaugaccgaucgcucgacagacaaauagacauaguagcauugcucgaauccgcacuagacgaagcggcgauaaucgcuucucucgguaccacacacucacucgacgaagcugcggcucagcgugcccucucagcacuauuaccagacggauacuguagacuaggccuacgcgcaaucaaaaggguacuaccccugauggaagcgggacgcaccuaugcagaagcagcgucugcagccggguaugaccacgcacuacuacccggaggaaaacucucgccaaccggcuaucuucccuacuauggccaauggcuacaaaacgacgucguaggauccgacgacgagcgcgacaccaacgaacgacgauggggcaggcuaccgaaccccacgguccacaucggcaucggucaacucagacgugucguaaaugagcuaauacgcuggcacggcccuccagcagaaauaacagucgaacucacaagagaccugaaacucucaccacgcagacuagcagaauuagaaagagaacaagccgaaaaccaacgcaaaaacgacaaaagaacaagccuccuuagaaaacuuggacuccccgcaucaacccacaaccuccuaaaacuacgccuaugggacgaacaaggagacguagccucagagugcccguacacaggcgaagccaucggccuagaacggcuagucucagacgacgucgacauagaucaccucaucccauucuccauaucgugggacgacuccgccgcaaacaagguagucugcaugcgauacgccaaccgggaaaaaggaaaccgcacaccauucgaagccuucggacauagacagggccgaccauacgacugggccgacauagcagaaagggcggccagacuuccaagaggcaaacgguggcgauucggaccaggcgcaagagcacaauuugaagaacuuggcgacuuccaggccagacuacugaacgaaaccuccuggcucgcgcgcgucgccaaacaauaccuggccgccguaacacacccccacagaauccacguucuaccaggccgauuaacagcccuacuccgggcuacgugggaacuaaacgaccuucuacccgguucagacgacagagcagcaaaaucucggaaagaucacagacaccacgccauagacgcgcucgucgcagcacuaaccgaccaagcccugcuacgaagaauggcuaacgcacacgacgacacacgccgaaaaaucgaaguccuccugccauggccaaccuucaggaucgaccuagaaacucgacuuaaagcaaugcuagucucgcacaaaccagaccacggccuccaagcacgacuccacgaagauacagcauacggaaccgucgagcacccagagacagaagacggcgcaaaccucgucuaccggaagacauucguggacaucuccgagaaagaaauagaccggauacgcgacagaagacuaagggaccuggucagagcacacgucgcuggcgaacggcaacaaggcaaaacacugaaagcagccguacucagcuuugcacaacgccgagacaucgcugggcacccgaacgggaucagacacguacggcuaacaaaaagcauaaaaccagacuaccuggucccaauacgagacaaagccggccgcauuuacaaaucauacaacgccggggaaaacgcuuuuguagacauacuacaggcggagucaggacgcuggauagcaagagcgaccaccguauuccaagcaaaccaagcaaacgaaagccacgacgcccccgcagcacaacccaucaugaggguauucaaaggggacaugcuaagaaucgaccacgcaggagccgaaaaauucgucaaaauagucagacugucccccucaaauaaccuccuauaccucgucgaacaccaucaagccggagucuuccaaacacgccacgacgaucccgaagacuccuucagaugguuauucgcauccuucgacaaauuacgcgaguggaacgcagagcuagucagaaucgacacauugggacagccauggcgucgaaagagaggacuugaaacagggucagaagacgcaacaagaauaggcuggacaagacccaaaaaguggccguga

SEQ ID NO: 6150 - RNA, 3198 nt, Artificial Sequence
  Cas9 variant
augaacaaagacaucaacuacgcccucggacuagacaucggcaucaccucagugggaugggcaguaaucaaucuugaccucaaccgcauagaagacuuaggggucagaaucuucaacgcugcagaaaaccuaaaagauggcagcucauuagcacucccccgacgccuagccaggggucggcgcaggcuccuccgcagaaaagccuaccggguagaacgagugcggaagcuaauacucaaaaacaauauacucacgaaagaagaacuagagggacuguucaaaaacaaagaggugaucgacgugugggaagcgcgcgugaaagggcuagacuacaaacucagcagagaggagugggccaagauccucauaaacuucugcaaacgacgcgguuucaagagcaaucgcaagaacgaggcgaaagacaaggaagcagggcaaauacuguccucaaucagcuacaacaucgagaaaaugaaagaaaccaacucgaggacgaucggcgaauacauauacaaugaagugaagaacagcgaagacucauacgcaccccuacgcaacaaauucggagaguacaagaugugcguaagccgagaugucauccgagaggaaauccacacacuguucgaaaaacagcgggaacuaggaaacaacuuugcgucggacgaaaucgaggacaaguacuucgaaauauucaacagccaacgaccguucucaaacuucgaggaccuagaaaagcuagugggguucuguacuuucgagcgaaagaagcacaagagagcaccaaagcacugcaucagcagcgaagaguucacccucuacgaaggaaucaacaaacuaucgaucauaaaagacggagaaaaacgaaaacuuagcgaggaggaacgcacccuaguagucaacgaagccuucaacaagaaagaaaucaaguauacaacccuccgcaaacuacucggacuuucagaagaggaguuguucuccacacuaacguacuccauagacaaagacauaagcaagaccgagaauacaaaauucgugucgcugaagggauaccacgagaucaaacgagccaucgagaagggcgucuccaagaaagccuggcaagacauagagaacaacagaaaccuccugaacgacauagccuacguacucacgcucgguaaaacggacgacgagaucgaaaaacaauuacgccuccggaacguaccagaggaacuuuucgaaucgcuuuuggacaugucauucaacaaauucaauaaccucagcauauacgcgcuugagaaaauucucccguucaugaaagaaggguaccaguacaaugaagcgugcgagaaagccggauacaacuucaaggcaaucuacgaggggguacgcacaaagaagcucccagucaucgaaauagacgaaaucgugaacccagucguuaacagagcauuggcacagacgcgcaaagucauaaacuccguaaucgacaaauacgguagccccgugaggauaaacauagaacucgcaagagacuuagcaaagaacuucaaagaccgcaaacugauugagaaggaacagaaagagaacagagcaaaccucgacaaaauccgcgagaaccugcgcgaauuaauggacaaggaaccgaccguaguggagguccuuaaguaccggcucugggagcagcaacgaggcgagugcgcauacacccagagucaaauaccgcuagagcgacuauuuagccccggguacugcgaaauagaccauaucaucccauucaguaggagcuucgacgacagccugagcaacaaaauccucguacuuggaagcgagaaccagcgcaagggcaaucgcacgccguacgaauacuucggagaagacagcgaaagguggaacaguuucgaaaucugggucaaaggaucauaccucaauuauaaaaagaaagccaaccuacucaaaaagaaguucagcgaagaggaacaacgcgacuggaaagccaggaaccuccaggauaccaaauacaucugccgcuacauaagcaacuucgugaacaaccgacuagaguucaaggagagcgagaacaaacaaaaaguaaucacuguaaacggccgugcgacggccuaccuacgaagccgguggggguugaacaaaguccgagaagacggagauaaacaucacgcccucgacgcggccgucgucggcgucaccacgcagggaaugguccaaaagaucagcaaguauagcaaggcacacgaacucuacaccguaaggaaaaacgacgaguucguagacgucgaaacgggcgagugcguagacguggacgaguacaaagaaauccgaaaagacauacuaccgaggccauggcgaggcuucucggaagaacucaagcuacgccucagugacaauccccucgaggagcucaagaaaagccccauugagaccuauaacgaagaguucaucaaagaaaacgucaaacccauuuucgugagccgagucccguucaggaaaaucuccgggaagcuauuuaaagaaaccaucuacagcgaaagggcguucaaagacggauacuucgucaguaagaaaagucuagucgaccugaaacgaggggaucucgacaacuucuacaacuacgaaugugacaagaaacuguacgaugcuaucagcgaacggaugaaagaguucaacuacaacggaaagaaagccuuugaaagccccuuuaggaaaccgacaaaaagcggaaaagaaggcccagucgugcgaagcgugaaaaucaaaagcgcagugccauucaaagacggaaucccgaugaacgaagggcuaguggccaaagaaggaaugguccgcauagacauuuacgaaaaggaaggaaaguacuucgucgugcccguuuacagauaccagcuugcaaaaggaaucgugccgaagcgcgcagcaauagccaagaaggacgaacuaaaauggcccaucauggaccaaaccuacaacuucaaauuuucaauauacaaaaacgaccuaaucgaaguaaaguacgacaagaaaggaguguacuuuggauacuacgacggcuucgacaggaacagcgccucgcuuacgauagaaaagcacgacaauagcgagcgauaccgcucaaucggccucaagguaggcgucuuggaaauaaacaaguacgagguugacgucuuaggcaacuaccacaaagucaaacuaggaggaaacuga

SEQ ID NO: 6151 - RNA, 3198 nt, Artificial Sequence
  Cas9 variant
augaacaaggacaucaacuacgcccuagggcucgacauagggaucacaagcgugggcugggcagugaucaaccucgaccucaaccggaucgaagaccuaggcguacgcauauucaacgccgcagaaaacccgaaagauggauccagccuggcccugccccgacgccuagccaggggccgacgacgacugcuucgcaggaaagcguacagggucgaacgcguccgaaaacucauagugaaaaauaacauauuaaccaaggaagaacuugaaggccuguucaaaaauaaagaagugaucgacguaugggaagcgagggucaaaggccuggacuacaaacugagccgcgaggagugggcaaaaauccuaaucaacuucuguaaaaggcgaggguucaaauccaaccgcaaaaaugaaaccaaggacaaagaagcgggccaaauccugaguucgaucucauacaacaucgagaaaaugaaggagacaaacuccaggacaauaggcgaauacauauauaacgaaguaaagaacuccgacgacucauacgcuccucuacgaaacaaguucggcgaauacaaaaugugcguaagccgagauguacugcgcgaagagauacacacacucuucgaaaaacaacgagagcugggcaacaacuucgccucggaugaaauagaagacaaguacuuugaaauuuucaacagucaacgcccauucuccaacuucgaagaccucgaaaaacuggucggauucugcaccuucgaacggaaaaagcacaagcgagcgcccaaacacugcaucucgagcgaagaguucacccuauaugaaggcaucaacaaacuaucaaucaucaaggacggggaaaagagaaaacuaagcgaggaggaacgcacccuagugguuaaugaagcauucaacaagaaggaaauaaaauacacgacucucaggaaacuacucggacucagcgaagacgaacuguucagcacgcuuaccuacagcauugacaaggauauaucgaagacggagaacaccaaguucgucagccuaaagggcuaucacgagaucaagcgcgcuaucgaaaaaggagucagcaaaaaggcguggcaggacaucgagaacaaccgcaaccuccuaaacgacaucgcguacguacucacauuaggcaaaacagacgaugagauagaaaagcagcuacgccuacgaaacgucccagaggaacuguucgaaucacuacuagacauguccuucagcaaguucaacaaccugagcauauacgcacuagagaagauccugccauucaugaaagaaggauaccaauauaaugaagccugugagaaagcaggcuacaacuucaaggcgaucuacgagggaguucgaaccaagaaacuacccgucauagaaauugacgaaauagugaacccgguggucaaccgagcccucgcgcaaaccagaaaagugaucaacagcguaaucgacaaauacggcucccccguacgcaucaauaucgagcuagcgagagaccuggccaagaacuucaaagacaggaagcuaauagagaaagaacaaaaggaaaacagggccaaccucgacaaaaucagagaaaaccugagagagcuaauggacaaagaaccgacagcaguagaaguccuaaaguacagacucugggagcagcaacguggggagugugcuuacacacagagccaaaucgcacucgaacgccucuucagucccggauacugcgagaucgaccacaucauaccguucagccgcagcuucgaugacagccuaagcaacaaaauccuaguacucggaagcgaaaaccagcgaaaaggcaacaaaauacccuacgaauauuucggagaagacagugagcgauggaacaguuucgaaauauggguaaagggcaguuaucucaacuacaaaaagaaagcaaaccuguuaaagaagaaauucaccgaagaggaacaacgagacuggaaagcgaggaaucuccaagauaccaaauacauaugcagguacauauccaacuucguaaacaaccgacucgaguucaaagaaagcgaaaacaagcaaaaggucauuaccgucaacggacgagcaaccgccuaucuacgaagccgcuggggacuuaacaaagucagagaagacggggauaagcaccacgcccucgaugccgcgguaguaggcguuacgacacagggcauggugcaaaagaucucgaaauacucgaaagcacacgaacuguacaccguaagaaagaacgacgaguucguagacgucgaaacaggcgaaugcguggacguagacgaauauaaggaaauacggaaagacauauuaccgagaccuuggcggggcuucagcgaagaacugaagcuaagacuaagcgacaacccgcuagaggaacugaagaagcucccgaucgaaaccuacaacgaggaguucauaaaagaaaacgucaaacccauauucguaucucgcguaccauucaggaaaaucucggggaaacuuuucaaggaaaccaucuacagcgagcgagcauucaaagauggauacuucguauccaaaaagagucuagucgaucuaaaacgcggggaccucgacaacuucuacaacuacgagugcgacaagaaacuauacgacgcaaucucagagaggaugaaagaguucaacuacaauggaaagaaagccuucgaaucacccuuccgcaaaccgaccaaauccggcaaagagggacccguggugcgcagcgugaagaucaagagcgcagcaccguucaaggacggaauaccaaugaaugagggacuuguggcaaaagaaggaaugguaagaauagacauauacgaaaaagaaggcaaguacuucgucguacccguguaccgauaccagcuugcaaagggcauagucccuaagcgggcggcaaucgcaggaaaaagugagcugaaguggccaaucauggaccaaaccuacaauuucaaauucucgaucuuuaagaacgaccucauagagaucaaauacgccaagaaggacggcuacuuuggcuacuacgacggcuucgaccggcacacggcaucccucguaaucgaaaaccacgacaacuccgaccgguaucgaggcauaggggucaagacaggagucguugaguucaauaaguacgaagucgacgugcugggcaacuaccacaaaguaaaccugggcgggaauuga

SEQ ID NO: 6152 - RNA, 3201 nt, Artificial Sequence
  Cas9 variant
augucagaaagaguagugcggagaaucuuagggaucgaccucggaaucgcaagcugcggguggggagugguagauauaagcggggcagggggugggauaauagcgacggggguacggugcuuugacgcaccuuuaaucgauaagacaggagagcccaaaucugcgacaaggaggacagcccgagggcaacgacgaauaguaagaaggcgaagacagaggaugaacggaguucgucggcuuuuaugcgaguucggacuguuacccgacccaaggcccgacgcacuaaaucaggcgaugagacgcaucucgacggcgagcgcagcggcccaggucacaccauggacacuaagggcagcagcgcaucaaaggcuacuaagcaaugaagaacucgcggucgugcucggacauauagcaagacacagaggauuccgaagcaaugcgaaaaacgaagcaggagcaaaugcggccgacgaaacgaguaagaugaaaaaggcaauggaagccacaagagaaggauuggcaaaauaccaugcguucggagacaugauagcaaacgacccgaaguucgcgaaucgcaaaagaaaccgggacaaggauuacucgcacacagccaaaagaagugaccucgaagacgagguacgagccauauugcgagcgcagcuaagguucgggagcgcagcggcaacagaaacgcuggcccaaacguucgcggauguagcuuucuuccagagaccacugcaggacucagaggacagagugggcgacugcccauuugagcccgggcagaaaagagcggccagacgagcgcccagcuuugaacuauucagauuccucagcagacuagcaaaccucaaacucgcgguaggacguaguccggaacgaagacuaacugcggaagaaaucgcccuagcagcgaaaggauucggggaaaccaaaaagaccauaacauucaaaucacuacgggaagcgcuagaccuagaccccaacgcaagguucaguggaaucggaaaagacaaagaagcaagccuagacgucguagcacgaacaggaggggcagcauacgguaccaaaacguuaaaggaugcacuaggagacgccccauggaggagccuaaguaggacaccggaaacacucgaccgaauagcggagauauuaucauucagagaggacauaacaagcauuaggaacgggcuagaagauuuaggcuuagacagccugguaguagaagcacugaugcaagccgccgcgaacggagacuucaaggaguucacuagggcaggacacaucagcgcgagagcugcaaggaacaucauaccagggcucagagaaggauuaguauacagcgaagcgugcgcaagagugggauacgaccacgcagcacgacucaguguaccccucgaccagguagggucaccgguaacaagaaaagcacugagcgaggcgcuaaagcaaguaagggcggucgcgagagaguacggaccaauagacuacuuccacaucgaacuagcacgaagcgucggaaaaagcgcagaggaaagaaaacaacuaacagacggcauagaggcacgaaacguagagaaagcaaaaaggcgaaagcaagcagaggaacaccucggacgggcaccgucggacgacgagcuauuaagguacgaauuagcaaaagaacaaaauuucaaauguaucuacuccggggacgcgauagacccagcagggguggcagccaacgauacgagguaccaaguagaccacauccuaccguggagcagauucggcgacgacaguuaucuaaacaaaacacucuguaccgcacggagcaaucagaacaagagggggcguacaccauuugaaugguucgaggcagauaagacagacguggaauggauggaguacgucgccagagucgaaaaccuacaagaaguaaagggaaggaagaaacggaacuacucgaucaaagacgcagcggcaauagaggacaaauuuaaggcaagaaaccuaacggacacacaaugggcaaccaggcuccucgcggaugaacugagcagaauguucccaccgagggaaugcgaacgggcgauauguggcagagcggacgggggaaaugacgggcuaacaauaguagaagaaaggaggguauucacacgcccgggcgccauaaccagcaagcuaagacgagcauggggacuggagggacuaaagaaacaagacgggaaaagagucgaagacgaccgacaccacgcgguggacgcccuaguacucgcagcaaccacagagagccuacugcaacgccugacaguagaaguacaaagacgagagagagaaggacggccagacgacaucuuucacugcgcggaacccuggcggggauuccgcgccgacgugcgcaggaccguauacgguucagaaacaaugccgggaauauuugugagucgagcagagaggagacgagcgagggggaaggcgcacgacgcaaccauaaagcaaauuagggaaauagagggggagaggcugguuuucgagaggaaaccagucgagaagcuaacagauaaggaccucgagaaaauuccaauaccaaaaccuuacggacaaguaagugacccaaagcgccugagagacgaacucguggagagccugagagcguggaucgcagcaggaaaaccaaaggaucggcccccgcucagcccgaaaggagacgugauaagaaaaguaaggauucaaacuaaugacaagguaucgguagaaaucaacggcgggacaguagacagaggcgacauggcacgaguagacguguuccgaaagaaaaauaaaaaggccguaugggaguacuacgugguaccgaucuacccgcaucaaauaguagcgcuaaacgacccgcccgacagagcagucaucgcuuacgccgaagacaaagacuggaaggaaauagacaguagcuacgaguuccuauggagccuguucggacuaucauacgucgagauaagcaaagcaaacggggaaugcauagacggguauuucagaggguuacacagaggaacaggagcggcaucaguaugcaaacauaucagucuagggaaggacgccacagugagcggaaucggacuaaaaacucuagccaguuucaaaaaguucacaauagaccgacugggacgaaaauucgagauaccgcgagaaguccggacguggagaggagaagccuguacguga

SEQ ID NO: 6153 - RNA, 3201 nt, Artificial Sequence
  Cas9 variant
augagccaccucguucucggccucgaccucggacccaacucgauaggcugggcauuaguaaacgacgaccccgaacacccagucgaaagcaagcucguagaccuaggaguaagagucuuccccgaagguguagacaauuucgacaccucaaaggaacugucaagaaacgaggacaggaggguagcaagaggcaugcgaagacaaauucgcagacgagccagacggcgccaacaauuaaagcaagcacuaaucgacuccaaacuguggcccagcgacccaaacgacgaagucguauuauacaacacgaaccccuacgaacuuagagcacgcgcucucaaagagagguuagaaccacacgaagucggccgaguacuacuacaccucaaccaacgaaggggcuuccugagcaaccgcaagaaagaccggggcgacaaagaaguacaaggaaugcuugccgaaaucaacgaaaacgaacaacaaugcaaagauggaggcuuugacacaauaggcgcauggcucgcggacaaacaggcaaacauagaccaugcaaacagagaagaaaacgaucacguccggaacagacaccucgccaggucccaauacgucgaugaguuugaggcgaucuggagcguccaagccaaacaccacccaaaacugcugaccgaggagcuaaaagucggaaaacuaggaaaacagacguacccagucaagccgauaccaagauggcaugaacaccgacaaggacucagcccgcucgagagcuucggcaucuacggccucauauucuuccaacgacccauguacuggcccaagagcgucgucgggcuaugcgagcuagagccgaaagagcgaaggugucaacgcagcgacagaagacaacagagauuccgacuacugcaggaagugaacaaucugaaguacgucgaccccgacacgcaccuagaacaaaagcucgacgacaaacaacgccggcuacugcuggacaaacuaagccacaccaaagaaaugacguucgaccagauucgaaaagcccuggauuuccuagaauccgucaaauucaaucucgaacggggugaaagaagccgccucaagggcgugccaaucgacgcccuguuugccgcaaaggauguccuagggcaagaaugguacgacagaccagaacaacagaagacggagauaguggcagugcucuuggauaacgaacgggaugacgaccgcaucauagcacgagccguugcagaauggggaaugaccgcaaaagaggccgaagcaaugcucggaguagaccugccagcaggauacgcaaacuuaagcugcaaagccauugaaaagcuacuuccgcacauggaaagaggacuucuuuacauggaugacgacgaaagcaacucggcuaugcacgccgccggauaccuccgcagagaccaacuaagacgacgaauauucgacguucucccggauccggccaggaccccaaacugccccaucggggacauaccaaacccagucgucaagagaacccuaaccgagauaagaaaaguagucaaugccauagucagagaguacggaaaacccgacgcgauccaccuggaacucgcaagauccguacaaaugggaaaagagaaaaggucggaauacaguaaaaugauacgagacagagaagcggagagagacggcauagucgaaaaacugagggagagugggguccgagucacgcgagacaacauacucaaguaccaacuaugggaacaacaaaaccaggaaugcauauacucagguaaacccaucagcuucgagaaacucuucggggaagggggcggcgucgaaguagaccacauacuaccgcgcagcagaagccuagacgacucacaagcaaacaaaaucguaugccucagaaccgcgaacgccggaaagggcgaccaaacccccuaugaauggcucgcagacacccagcccaaacaauacgaacaaguaugccaaagggccggaaugcucaugcguuccgggagaaugcccuacgcuaaauaccggagauucauacaacgcgaacucgagcucgacaaauucaucgccaggcaacucgcggacacuggcuacauaaccaaagcaacaauggaauaccucagauaccuauucgacaaagaccacgacgugcuaggauugaaaggccagcuuaccgcggaacuaagauaccacuggggauuggaaacgauacuggaagaacucccagauucacccgccuggcacgaggcggacagcgggaaacuacgacccggagagaaaaaccgagcagaccaccgacaccacgcaauagacgccguagucauagcauugaccaaccgaagacgauuaguacaacuauccgacaucgugaaacgcggcggcgcgcgcgcgcacggagaaauacuagaagacccguggccgaacuuccgagaaaacgucguccaagcgauaaagaaaacgaauguaucacacagagucgaaagaaaaguagcaggaaaauuacaugaagaaacucuauacggaccgaccagaacucccggcgaguggguacuuagaaaaccagugauagcccuaucagcaaaugaaguggagaggauccgggacgcaaccauaagacaaaucguugucagcgcacucgcggaugccggcauagacgucggacgcggaaagaaaccagacgccaagaaaaugaaagaagcgcugucgaaacucaaaaugccaucgggcguucccauacgaaaaguccgccuaacaaaacccgagcaaacaauccagcccgugcgggcaggcagacccgaccaggccuucguaaagccugguucaacgcaccaccuaugcauauucgaguucaccgaaaacggaaaaacgaaacgagacgcaguuuucgugaccaugcuagaagcaaugaauagacuaaaacgaagagaacccgucauccaacgcacgcacccagagcgaccagacuccagauucgucaugagucugagcgcgcgcgaaaugcuccucgccaacuggaaggacggcgagagacuacucaccuuuaaaacagcuuccuccacacaagggcaaauaugguucgcggaacacacagacgcaagaaaguccgccgauuacaaacaguucgucgcgaacgcaaacacauuagacgccaaaaaggucaccguagacccacugggacgaauaagaugggcaaacgacuga

SEQ ID NO: 6154 - RNA, 3204 nt, Artificial Sequence
  Cas9 variant
augggaacaaggcugggacucgacauaggcaccaacucaauaggauggugccuguucaaccucgacggcagcggucgcccgaucggaauaagggacaucggaguccgaaucuucucggacggcagagacccgagaagcggugcaagccucgcaguagaacgaagagucgcgagagccaugagaagacgacgcgaccgauacauccgccgccgaagugcgcuccucgaagcauuaaucaacaccggacuaaugccagcggacguacaggaaagcaaggcccugaccgguugcgaccccuacguacuaagagcacaagcccucgacagggcccuagacgcccacuuacuaggccgaguacucuuccaucugaaccagcgcagaggauucaagagcaacaggaaagcagaaagaaaagcgggagaugacaaggaaggcggcaagauagccgacggagccaaagcacucgaccuagccaugcacgaagccggcgcacgcacguacggagaguuccucgccggccgugacucgcgacgcguacgacuaagagcggaaggagauggcuacgacuucuaccccgaaagacgccaccuagaagccgaguucgacgccaucugggacgcacaggcggcauacaaccccgcgcuccuaacggacgucguacgcgaucgccuccggagaauaaucuucuuccaacgcccacuaaaagcaccaaaaguaggcggaugcaccuucuuuaaugaagaaccgaggcuacccaaagcucacccacuuuuccaagaacgacgucuauaugaagaagugaaccaacuagaaauaacccgggcaggggccccuucacgcaaacugacucucgaccaacgagacaaaauaauccgcaaacucaaaagcgcaaaaacggccagcuucucgggacuagcccgccuccugaaacuugccgacggcgaaaguuucuccagagugaccgaaaaccgaaccggacucgccggagacgacauauucacaucauucagcgacaaacgaugcuuuggcgaccgcugggcucacuuugaccccggagugcaauggaguaucaucgaaaccgucaccgaagaagaagacccgguccgccugcgggacuggcucauggcaacgcacggcgucacaguagaacaagccgaagcuaucggccgaguccgccuacccgagggccacggaagacucggggaaaccgcaagucgacucauacuagcucaacuaaaaaguggaagcaaagacggccacccccucaccuacaacgaagccgucgaagcugcccucgguaagagccacuccgacuucaggaccggugaaauacuugaacaacuucccuacuacggagaaauccuuagccgagaaaucccacccggaagccuggaccccgacgacgaugacgaaaucagauggggaaagauaaccaacccuaccguccacauaggccucaaccaacugagacggcuacuaaacgcacuuaucaaagcacacggccggccagacgagauaguagucgagcuagcacgagaacugaaacucucagaaaaggacaaagccgagcacaaccgaaggauaggcgcaaacacccgagcagccgaagcacggucaaagaaacuccuagagucgggccaaccugacacaggagcuaauagaucccucuugaaacuuugggaggacuuaaacccaaacaacccacucgaccgauguugccccuucugcggccgacacauuggacagauggcucuauucuccggugagaccgaaaucgagcauauaaucccauacagucgaucacuagacgauuccgcggcgaauaaaguaaucgcccaccgcagcugcaacagagaaaaaggaaaccgaacaccaugggaagcguggggccacacagagagaugggcaauaaucgccgagcagguaucgcgacugcacaaaucaaaacaauggcgcuucgccccagacgccauagagcgauucaaccaagaaggcggauuuaucgcgcgacaauuauccgauacccaauaccugucacguauggcccgcacauacuuaucaucacucuacccugauaccgcaggggucuacguaauaccuggcagaaugaccgcaaugcuccggcgccucuggggccuuaacgaacucuuaccagaccacaacuacguagaaaacccucacucaggcgcccccaaaaacagacuggaccacaggcaccaugccaucgacgccgcgguagucgggguaacgacacggggacugcucaacgaaaucucacgagccgccggcagagccgaacgccaagaccuagaccgccucuucaucgaccuaccuaaaccaugggaaaccuuccgggaggaccuacacgagagccucgcccgaguuguagggucccacaaagcggaucacggccgaaaaggagucccagccaagggaaaggacgccaccgcggcacgacuacacaacgagacagcguacggccuaacaggccuaacaagcgaaagcggacuacccauagucguccaucgcgucccccuacuaucacuuaaacccgacgaccuguccaaccccauacgcaucccagacgcggcacuccaaagagcccucagggaggcgaccgacggcaaaagcggaaaggacuuccaagaagcacuggcccaauucucaaaaucagaccccgucuucaagggcauccgccacguccgcguccgugaaacccuaaaagucauccccauacgagacgccucaggucacgcuuucaaggccuacaaaggcgacgccaacgcccgcuacgacguauggagaaugccggacggcaaaugggugagcucauggagagacagagacggaaaagcccacagcggcauuaucacaauguucgcagcccaccaagccggucaaccaguccaacgaccccacccagccgccaaaagagugcucucccuucgacagaacgaccuaguggccguagaaccacaaggacaaccuagaaagaucaugcgagugguaaaauucucaucuggcggccaaauaaccuuugccgaacaccaagaagcgggcccccuaaaagcccgcgacgccaccucgccggacauugaccccuucaaauacuucuacaguuccgccggcggccuacagaaagcgcgagcgcgacaaauaagaauagacgaacuaggcaggauauucgacccaggaccacgcuga

SEQ ID NO: 6155 - RNA, 3207 nt, Artificial Sequence
  Cas9 variant
augaaauacgucuuaggacucgacaucggcaucgcauccugcggcugggccgucaucaaccaggaaaaacaccgcauagaggaccucggcgugcgcaucuucgauaaggcggaaaacccgaaagacggcaagucccucgccacccccagacgcgacgcccgguccacaagacgcacgcuaaggcgaaagaaacaccgcaugcaacguauaaaaauccugcuaguaaaacacggccuauugagcaaaacggaaaucgaccaccuuuacgaaucagcaacagagaucgacgucugguaccuaagacugaacgcccuugaacgaagacucaaccccaaggaguucgcaaggguccugauacaccugagcaaaagacgcggauucaagaguaaccgcaaggaaacgacccuauccgagaacgggcaaauccucgaaaacaucucagaaaaccuccaaauaauggaacaaaagaacuacagaacggucggagaaaugauccucaaagacaaaagguucgaaaaccacaagaggaacaaagacggcaccuacaucgggaccguaacccgacagcaacuacaagaagaaauccaaaugauauuuaacgcgcaaaggcucuacaaaaacaaccacgcuacggagaaguucgaaagcucauauuuagaaaucugggcuagccagcgcccguacgcaagcaaggaccaaaucgaaaagaugaucggauacugcacccuggaaccaaaagaaaaacgcguaccuaaagccuccuggucguuccaguacuucguagcccuacagacaauaaacaaccuccggcugauuuccaaagaccgaauagaagaacucuccuucgaagagaaaaagaggaucaugaaccucgcgcucgaaaaaucaaucgucaaauacaucgacauccgaaaacuccucuccgucccaaaagaauuucaauucaacucacucaguuacucggcagacaucgucgacaccaccguugaaaacaagaaauguauagaacucaaagaguaucauucaauaaacaaaguauauaaacaaauauacgggcagaaugcucuaaaccuacucccaaaagacuacgacaccaucgcguacggauuaacuaucuucaaggacgacaaagacauccaagaguaccuacagaauaaauacguaaacgcuaaaggcaagccgaucucgaaccuagcaaacaaaacauacgaugacacauucauccaagugcugcuaacccucaacuucuccaaaaugggacaccuguccuucaaagcccucaaaaacauaauacccuuccuagaagaaggccuguccuacgacaaggccugcgaaaaagcaggauacaacuucaaaggcacgucauacacgaagaaaacaaaguaccucccggucauaccacaaaacaccaacccggucguccaccgagcccuaucucaaacaagaaaggucaucaacgccaucauuaaaaaguacggcucgccgaacgcgauacacaucgaaacagcgagagaacuaucaaaaaccuuccaggaacggaaagaaauagacagcauguaccaggacaacuccaaaaagaacgaacacgcaaucugcaaacucaaagaacucggaaacaucaacccaucgggaauaaacaucguaaaauucaaacuguggaacgaacaagacggccgcugcauguacacgggaaaauacaucgagccccaucggcuguucgaagaaggguacacagaggucgaccacauccucccguacagccgaucccuagacgacucuuacaacaacaaaguacucacccuaggcaccgaaaaccagagaaaaggcaacaaaacccccuacgaauacaugcgcaacaacagcauaugggacgaguucgaaacccgcguccaguccaacaagaaaauaaauaaaaagaaacaacaaaaacuccuacugcaaaacuucucccacgcgcgcgaacaagaguucauagaacgcaaccucaacgacacccgauacgcuacaauuuaucugucgucgcuuauacagcaacaucuaaucuucucagaaagcagcagagagaagaaaguccacacagucucagggaucauaaccucccaccuccgaucccgguggggguucaacaaagacagaaaagagggccacauccaccacgcccucgacgccgucauaguggcgguuacauccgaccauaugauccaacgcgucaccaaauacuacaaacugaaagaacucaaccgcaaucgccaagcuaagcguaugcaguuccccgaaccaugggaaggauuccgucuugagcuugaagcaagaauaucccccaauacccaacaguaucucaaagggauacgcuucaaaaacuacgccgacgucaaccuaagcgaaaucaaacccauauucgucagccguaugcccaaacgaagcauuacgggagaacugcaccaagaaaccauccgaaaauuccuaggcuauaacgaaaagggaaaaguccuuacagccacaaaaaccaaacuggaagacaucccguucgacgccaacggagacuuccccauguucggcaaagaaacagaccuauacaccuacaacgcaauaaaggaaagauaccucucacacaaaaaggacaaauccaaauccuuucaagaaccccucuacaaacccaccaaguccggcggaaucggcccccuaauaaagucuauaaaaaucauggacacacgcaccaucgucaacccugucaaccagggcaaagggguggucuauaacuccaaaaucgcccgaaccgacguguucaagaaaggcgaaaaauauuacuuaauacccaucuacaccaucgaucucaugaaaaauacguuaccacaaaaagcuaucacggccggcaaaggcuacgaagacuggaccacaaucgacccguccuucacguuccuguucagccuauuccccaacgaccucauacaaauagugcccuccaaaaacaaaacaauaaaagccagaacgacugucuccaaaaaggaaguccuccuacccucacuaacaggcuacuucaaaggcguccacuccggcaccgccggcaucacagucgaaacccacgacggauccaucaucgccaacguaggcuccaaacaguuacuuagcuucgaaaaguaccaaguagacguacuagggcacuacaccaaaaucaaaaaggaaaaacgcauaggcauggccauauga

SEQ ID NO: 6156 - RNA, 3207 nt, Artificial Sequence
  Cas9 variant
augaacaaagccguagcauaccgccucgcccucgacuuaggaucuacaagccuagggugggcaauauucagacuaaacgaagcaagagaaccaacugcaauaauccgcgcgggcguacgaauauucagugaugggcgaaacgcaaacagcgaaccacucgcgguacaucgcagaguagcgcgggccaugagacgucgacgggacagacuacugaaacgaaagaagcgaaugcaugaccaacucguucaacacggcuuuuucccagccgaaguagccgaacguaaggagcucgaaagacugaaccccuaucaacuaagggcgaaaggacuucacgaagcacuaacgccuggagaguucgccagggcccucuuccacaucaaccaaagaagaggauucaagagcaacaggaaaaccgaccgaaaagacaacgacucaggcgcauuaaagcaagccauauccgaacucagaaagaggauacaagacagcgacugcgcgaccgcgggggaaugguucuggaaggaaagaaugcagcagaaaccugagggaguacgagggcaauggguaagagcaagauauagaaagaccccaagcaccacagacgagggcaagaaaagaaucggguaugaccuauacgucgaucgcgcaaugguggaacaggaguucgacgcucucugggccgcccaggcggcgcuacaaccgggguuauucacggaagcggcccgagcugaacucaaagacacgcuacuauaccaacgugaccucagacccgugaaacccggacggugcacgcuccuacccgcagaggaaagagccccgcuggcacugccaagcacacagcgcuucagaauacugcaagagguaaacaaucuaaggcucuuagacgaagcucugcgagaaguaccguugaaccuagcgcaaagggacgcggucguaagcgcgcuugagggcaagaaagaacucagcuucgcugcgauacgcaaacuauugacucuaagcggcaaauucaaccuggaagacgaaaagagagcagaacuaaaggggaaugcaacaucggucauacucgcacgcaaagaccuguucggagacgcgugggcaggauucgaugcggccgugcaagaugagauaguguggcggcucgucagccaagaaagugaaggcgcgcucauagccuggcuacagcaacauacaggagucgacggggugugcgcagaggcgaucguaaacacgcgacugcccgacggcuacgggcgccucucgcgaaaagcgcuggaaagaauaguaccggcguuacaacgagaagucugcacauacgacaaagcagugcaagcggccggauucgcacaccacagcgaccuaggauucgacuucgacuacgcagaagacgagguacaacaggugggggaacacacaaucgccucgacaggcgaaguacaggcacaauacgccuucaagcaacuaccauacuaugggaaagcccugcaaagacacguggcuuuuggcucaggcgacgcaaaggaccacgaggagaaaugcuacgggaaaaucgcuaacccaacgguucauauagggcucaaucaaguaaggacaguaguaaacgcacuuauacgacgcuacggacacccaacagaaguaguuguagagcuagcaagagaccucaaacagucgagagagcaaaaacaacagacccagcgagaacaagcggacaaucagaaaagaaacgaagacauccggaaacggauagcccccauauuagagaccucgccagagcgggugagagaucgcgacaucaaaaaguggauccuaugggaagaauuaaacaagaaagauaucgcugacagacacugcccauauagcggagaacgcauaagcgcaacgaugcuacuaucggaagcagucgagaucgaacacauacucccauucagccgaacccucgacgacucacucaacaacagaacaguagcgaugcgccgugccaaucgcauuaaaggggacaggacaccuugggaggcgagagccgacuucgaggcgcaaggcuggcgguacgaagcgauacuacaaagagcugagggcaugccaccacgcaagcgcuacagauucgccgaagacggcuaucaaagaugguuagggaaggaccgcaauuuucuagcgagagccuugaacgacacaaguuaccucaguagacucgcagcaaacuaccuaagauuagucuguccacaaggaguaagaguaauaccgggccaaaugacagauaagcuaaggggcaaauucggacucaacagugugcuagggcucgacggcaagaaaaacagaaacgaccaccgccaccacgcaguagaugccugcguaaucggagugacagaccaaggacuaaugcaacgauucgcaaaugcgagcaaacaagcgcgagaaaacgggcuaacacgguugguacaggacaugcuccugccgugguggccgaguuacuacgaccacgucgaacgggcaguccgccacauaagagucagucacaggcccgaccacggcuucgaaggcgccaugaugaaagggaccgcacacggcauaagagaggacggcauccgagaagacgggcgaauaaaacaacgaccgaaagcaaaaggaagcgcagaccacaaaacaaucacacucauaccgauagacgagccgagacaacuggcgagacauggggucgacgccgagggcaagccgcugccuuacaaaggauacgcgaguggaaguaauuacugcaucgaaauaacgaagaacggaaaaggcaaaugggagggacaagucaucagcacguuugacgccuaccggauaaaagcagcggcagacgcagcagcccgcgcaggacaagucauaagcacgguugaagccgacagcauaguaagaaagucaggaugggaaagacuccgcggagcacaaagccaaaacggccaaccccuagucaugaggcuagugauuggagauagcguacgcauggaagucgacggucgagaugaaguaaugagaguagugaaaauguccgggaaggagauggucuucgcgccaguacgagaggccaacguggacaagcgcaacaacaugccagacgagcaggacccauucaccuauaccuacaaaagggccgaucagcugaggaaggcgaaagcgcgacaaguaacgauuagcccaauaggcgaguuacgcgacccaggauucaaaggcuga

SEQ ID NO: 6157 - RNA, 3207 nt, Artificial Sequence
  Cas9 variant
augcaauauguccuaggucucgacauagggauagccagcugcggcugggccgugaucaaccaggagaaggaacgcauugaagaccucggcgugcgaaucuucgacaaagcggaaaaucccaaagacggaaaaagccuugcagccccacgccgcgaugcgagaagcacucgacggacucuccgccgcaaaaagcaccgcaugcuccguauaaaaauauuacucguaaaacaaggauuauuaagcaagaacgagcucaaccauuuguacgaaucaaccaccgaggucgacguauggaaccugcgacucgacgcacuugaacgaaagcugaaccccaaagaguucacucggguccuaauccaccuggcaaaacgcagaggguucaagaguaaccgcaaagaaacuacacugucggaaaacggccaaauccucgaguccauaagcgaaaaucaacaaauaauggagcagcaaaacuaccgcacaguaggcgaaaugauccuaaaagacaagaaauucgagaaucacaaacguaacaaagacggcaccuacaucgguaccgucacgcggcagcaacugcaggaagagauccaaaugaucuucaccgcccaacgccucuauaaaaacgacuacgccacagaagaguucgaaaucucauaccucgaaaucugggccucucaacgaccguacgcgagcaaagaccagauagaaaagaugauagguuauugcacccuagaaccaaaagaaaagcgagucccaaaagccucauggagcuuccaauacuucgucgcgcugcagacgauuaacaaucuccgccuaaucagcaaagaccgcauagaagaacucagcuucaaagagaagaaacaaaucaugaaccuagcccucgaaaaaucaauaguaaaguacaucgauauacgaaagcuacuaagcauaccaaacgaguuccaguuuaacucccuuuccuacucggcagacacaguugacaccacccuggaaaacaaacgcuguaucgagcucaaagaauacuacucaauaaacaaaguauacaaacaaauauaugagaagaacgcacucaaccugcuaccaaucgacuacgacacaaucgccuacggccuuaccaucuucaaagacgacaaagacauccucgaauauuuacaaaacaaauacguaaacgcaaaaggcaaaccaaucaauaaccuggccaaaaagacuuacgacuacacauucauacaagcauuguuaacccucaauuucaccaaaaugggccaccuauccuuuaaggcacugaaaaacauuauucccuuccuagaagaaggccuauccuacgacaaagccugcgagaaggccgguuacaacuucaagggaaccuccuacacggagaaaacuaaauaccuucccgucaucccgcaaaacacaaaucccgucguacaccgggcucuaucccaaacucgcaaaguaaucaaugccaucaucaaaaaguacggauccccuaacgccauccacauagaaaccgcccgagagcucucgaaaacauuccaggaacggaaagagaucgacucuauguaccaagacaacuccaaaaagaaugaacacgcaauccacaaacuaaaagaacucgggaacauuaacccgucaggcaucaacauagucaaauucaaacuauggaaugagcaagacggccgaugcauguacuccggaaaauacauagaaccacacagacucuucgaggaaggcuacacagaagucgaccacauccugccguacucccgcucacucgacgacuccuacaacaacaagacucucacacuuggcacagagaaccaacguaaaggaaacaagacgccauacgaguauaugggcaacacauccauauggaacgacuucgagacccgcguucacucaaacaagaaaaucaacaaaaagaaacaacaaaaacuacuccuacagcauuucagcuacgcgcgggaacaggaguucaucgaacguaaccucaaugacacacgcuacgccacgauauaccucucuucccucauacaacaacaccucaucuucuccgaauccagccgaaagaagaaagugcacacggucuccggcaucauaaccucccaccuccgcucccgauggggguucaacaaagaccguaaagaaggacacauccaccacgcccucgacgccguaaucguggccguaaccagcgaccacaugauccaacgggucacaaaauacuacaaacucaaagaacugaaccgaaaccuccaagccaaacgcaugcccuuucccgaaccaugggaaggauucagacuggaacucgaggcucgcaucucacccaacacccaacaauacuuaaaaggcuuccgauucaaaaacuacgcagacgugaaccucucagaaauaaaaccaauauucgugucucgaaugccaaagcgcagcauaaccggcgaacuccaccaagagaccaucagaaaauucauuggauacaaugaaaaaggcaaaguucucaccgccaucaaaaccaagcucgaagacauccccuucgacgcaaacggcgacuuccccauguacggcaaagagacagacuuauauacauacaacgccaucaaggaaagguuccuaucccacaagaaagacaaacgcaaauccuuccaagagccccucuacaaacccacgaaaucgggcggaauaggcccccucauaaagucaauaaaaauaaucgacacgcggaccaucguaaaccccguaaaucaaggaaagggcguaguauacaacucgaaaauagcccgcaccgacguauuuaagaaggacgaaaaauacuaccucaucccaaucuacacaaucgaccucaugaaaaacauccucccacaaaaagccauaacugcaggcaaagguuaugaggacuggacgaccaucgaucccucauucacguuccucuucagccucuuccccaacgaccugauccaaaucguccccagcaagaacaaaaccaucaaagcccgaacaaccgugagcaaaaaggaaguccuucuccccagccucaccggcuacuucaaaggcguacacagcgguaccgcaggcauaacgguagaaacccacgacggcagcgugaucgcuaacgucggcagcaaacaacuccuccuaaucgaaaaauaccaggucgacaucuuaggacauuacacaaaaauuaaagaggagaagcgcauugggauggccauauga

SEQ ID NO: 6158 - RNA, 3207 nt, Artificial Sequence
  Cas9 variant
augccaaaaucugcaaaaccccaacaagcauacacauuagggcucgacaucggaaucgcaagcgucggcgcagcccuccucggccaacagcacaucauaggccuccacguucgcaccuucgacagggccgaaacugccaaggaaggggaaccccuaaacaaaauucggcgagacgcccgccuaacacgacgccgucuccaacgccgcgcccauagacugcugcgacuacgcagacuauucaaacgacacaaccuaaucccggacaccgacaccucaaccuucauaagcggucagagccccugggaacugcgcgcucaggggcucgacagacagcuaacaucagcggaauggacaaccgugcucuaccacauagucaaacaucgcggcuuccacagcaaccgcaaaagcgaagucaaaaccgaugaaaaggcuggacaaaugcugaguggcgucaaccaaaaccaagcucuacuaaaacaaucaggccuacguaccaugggggaacucgcugccagacacgaagccuucagagaggccaagcgcaacaaaaagggcgcauacaaccacacuuucucaagacacgaccuagaggacgaacuacaccuccucuucaguaggcaacgcgaacucggcaaccccuacgccacaccagaacuagaagacgcgguccacacccuacuaaugcaacggcgaccagcacuauccggcacaaaccugcucaaaaugguuggacacugcacccuagagccagacgaguuccgcgcaccgaaagccuccuacaccgccgaacgguucauauggcucaccaaacucaauaaccuacgcguauccggaagcggcgaaaccagaccgcucaacgaaucagaacgacaagcccuccucagcaaacccuucagccaaagcaaacucaccuacaagcagguccggaaaauccuggaacucccggacaacauacgauucguuggacuacacuaccacccagcgcaagacaacggaaagucccccgaaaaccgcgucuucuucgaagccaaagcauuccacgcacuacgaaauguuuacaagaaagccggccucaaccucgaauggcagcgggacucacaaaaccccgaaaaauuagacaacaucacguacgcacuaaccguauucaaagaggacaaagaggcaaaacaguggcucaucgagaaaggagucgaagcaagcguaauagaagcaguccuaaacgaguccuucucggaguucguccgauuauccaucaaagcgcuucgaaaaaucaucccgcacauggaaauuggccaccgcuacgacgaagccguaaaacuagccggcuacucgcaccacucccaucucccacaacccagcaagaccccuuacaucccaagguuuucgaaacaaaguauagcgaaucccguagugucacgagcgcucaaccaagcgcgcaaacucgugaacgcaaucguacgugaauacggacccccugaugcagugcacauagagcuagcccgcgaccugaacaaaccguucgacgaacgacgaaaaauugagaaggaccaagaaaaguaccaaaaagacaaagcccgcgacauagaaacuuuccaagaaaacuucggguucaccccaaaaggacuccagcucaccaaauggcgguuguacagggaacaauccggaaaaugcgcauauucccuaaaaccccuggacauaaaccgauuauucgaagacggcuacgucgaaaucgaccacgcauugcccuacucccgaucauucaacgacgggaugaauaacaaaguacucacccuaacaacggaaaaccgcaacaaaggaaaucaaacaccauacgaauaccuugacggagccucaaacucagcccaauggcgcaacuucguggcauggguaaacucaaacaaaucguaccgagcaucuaaacagagaaaccuccugcgaaaggacuuugccgcccaagccgcaaccgaauuuagagaacgccaccucacggacacaagguacaucgcccgggaguucaaacggauggucgaaacucaccuaaaacucaacaagccaaaccaacgcugcguaguugucaguggccagcuaaccgcguaccugcgcgcucguuggggacuuaucaaggugcgcgaaaacggagaccuccaccacgcccucgacgccgccguagucgccgccugcagccacgccauggugaagcgccucgccgacuacucaagacgcggcgaacugcaauacgcccgcggacaccacuucgacccagaaaccggcgaaaucauagacauaaacgcucuacgcaaguuagacgaccauuucccccaaccguggaccgacuuccgacgugaacuccuagccuggcugucgccagaccccgcacaacaacuaaagaacuuagcauacuauacagacgaacgccugaaacaagucaaaccuauccgaguauccagggcaccaaccagacgcggacucggagccgcccaccaggaaacuaucagaagugccaaauaucucggagaaaaucgcuccaccgugaaaacuccccuagagaaacuaaagcucaaggacaucccaaacauagucggcuacgaagacccuaggaaccaucaacucauacaagcaauaucacaacgacuaacagagcacggcgacgauggaaagaaggccuucaaagaaccacucuacaaaccaggcaacaauaaguccacggcuccaguaguaagaucggucaaacucuucaccguccaaaagagcgguauuccaguccgaggaggcauagcgaacaacgguaacauggucagagucgacaucuucaccaagaaggaacgcuacuucgccguucccgucuacgucagugacgccgcacguaacgaacuacccaacaaagccgucgccagaggaaaagauggcuggauugacauugacgacuccuucagcuuccucuucucccucuacccaaacgacugggucucggucgucguuaaaccacacgaggcccccugcgaaggcuacuacgcagggcuagacaucucgaccggcgccauacacauaugggcacaugaucgcaaucgcucggucgggaaaaacggacuaaugagaagcaucggcauaaagaccgcacauucugucgagaaguaccacguagaccuccuuggaaacuuauaccgcguaguccacgagacccgcaaaccgcuccgagcagggaaauga

SEQ ID NO: 6159 - RNA, 3207 nt, Artificial Sequence
  Cas9 variant
augcaauacguccucggccucgacaucggcauagccucaugcggaugggcugucaucaaccaagaaaaagaacgaaucgaagaccucggcguacgaaucuucgacaaagcagaaaacccaaaagauggcaaguccauggcaacaccucgccgcgacgcacgaucuacccggcgaacucuucgaagaaagaaacaccgaaugcaacgcauaaaaauaauccuagucaagcaaggccuacuaucaaaaaccgaacuagaccaccuauacgaauccgcaacagaagucgacguauggaaccuucgccuugacgcccucgaacgaaaauuaaaccccaaagaguucacccggguacugauacaccucgcaaaacgccgcggauuuaaaaguaaccgcaaggaaacgacacugagcgaaaacggccaaauucuggagaguauaagugaaaaccaacagauaaugggccagaaaaacuaccgcacaguaggggagaugauccugcaagacaagaaauucgagucccacaaaagaaacaaagacggaacuuacauuggcaccgucacgagacaacaacugcaagacgagauccaaaugauauucaacgcacaacgccucuacaaaaauaacuacgccaccgcugaguucgaaaacucuuaccucgaaaucugggcgucccaaaggcccuacgccuccaaagaucaaaucgaaaagaugauagguuacugcacccuggaacaaaaagaaaagcgagccccuaaagccucguggagcuuucaauacuuugucgcccuccaaacaaucaacaaucuacgacugauauccaaggaucggaucgaggaacucuccuucgaagaaaagaaacagaucaugaaccucgcacuagagaaaagcauagucaaauacaucgacauccgcaaacuacuaucaguuccaaacgaguuccaauucaacagccuuucauacagcgcagacaccgucgacauaacgguagaaagccgaaaaugcauugaacucaaagaauaccacagcaucaacaaaguuuacaaacaaauauacgagaaaaacgcgcugaaccuacuccccaaagauuaugacacgaucgccuacggccucaccauauucaaagacgacaaggacauccuugaauaccuacagaacaaauacguuaacgcaaaagguaaaccuaucuccaacuucgccaacaagacauacgacgacaccuucauccaggcccuccuaaaccuuaacuucaccaaaaugggucauuugagcuucaaagcacucaaaaacaucauccccuuccuggaagagggccuuuccuacgacaaagcaugcgaaaaagcaggauacaauuucaagggaaccagcuacacagaaaagacuaaauaccuaccagucaucccccaaaacaccaaccccguuguccaccgagccuuaucacagacccggaagguuaucaacgcgaucaucaagaaauacggauccccaaacgccauccacaucgaaaccgcccgcgagcucagcaaaaccuuccaagaacgcaaagagauagacucaauguaccaggacaacucaaagaaaaacgagcacgccauaugcaaacuaaaggaacucggaaacaucaacccauccggcauaaacauagucaaguucaaacuguggaacgaacaagacggucgaugcauguacuccgguaaauacaucgagccccaucgucuauucgaggaaggauacaccgaaguggaccacauucucccguacucgcgcagccuagacgacucuuacaacaacaaaacacucacccuggggaccgaaaaccaacguaagggaaacaaaacgcccuacgaguacaugggaaacacaagcauauggaacgacuucgaaacccggguccaaucgaacaagaagaucacgaaaaagaaacaacaaaaacuauuacuucagcacuucucguacgcacgcgagcaggaauuuauugaacgaaaccuuaacgacacgcgcuacgccacgaucuaccuauccucacucauacaacaacaccuaauauucuccgaaucaucgcgcaaaaagaaagugcauacagugagcggcaucauaaccucacaccuucgcucaaggugggguuuuaacaaagaccggaaagaaggacacauccaccacgcacuugacgccgugaucgucgccgugaccuccgaccacaugauacaacgcgugaccaaauacuacaaacuaaaagaacucaaccgcaaccuccaagcgaaacgcaugccauuucccgaacccugggaaggguuccgccucgaguuagaggcccgcaucuccccaaacacccaacaauaccucaaaggcuuucgguucaaaaacuacgccgacgucaaucucucugaaaucaaaccaauauuuguauccagaaugccuaaacgaucuauuacgggcgaacuccaccaagagacaauccgaaaauucauaggauacaacgaaaaagguaaaguccugacugcgauaaaaacgaaacuggaagacaucccuuucgaugcaaacggcgacuuccccauguacggcaaagaaaccgaccucuacacguacaacgccaucaaagaaagguuccucucacacaagaaagacaaacgcaaaucauuccaagaaccacucuacaaaccgacaaagagcgggggcauugguccacucauaaaguccauuaaaaucaucgacacccgcacaaucgucaaccccguaaaccagggaaaaggcgucgucuacaacuccaagaucgcccgaaccgacgucuucaagaaagacgagaaguacuaccuaauccccauuuacaccaucgaccuaaugaaaaacauucucccacaaaaagcaauaaccgcagggaaaggcuacgaagacuggacgaccaucgacccguccuucacauuucucuucagccucuucccaaaugaccucauacagauaguccccuccaaaaacaaaacgauaaaagcacgcacaacggucucaaagaaagaaguccuccuaccuucccucacaggcuacuucaaagguguacacucagguacagccggcauaaccguagaaacccacgacgguuccgucaucgcuaacgucggaagcaaacaacuccuccucuucgaaaaauaccaaguggacgucuugggccacuacacuaaaaucaaagaggagaaaaggaucgggauggccaucuga

SEQ ID NO: 6160 - RNA, 3210 nt, Artificial Sequence
  Cas9 variant
augaagaagcagccacaacgcuacauacucggccuagaucuaggaauagcaagcgucggaugggcacucauucuaguagacggcgccgaaaaccccguaggcuuacuagacugcgggguacggacauucgaacgagcagaaguaccgaagacaggagacucacucgcccucgcccgaaggcaagcacggagcgucagacgccucauacgccgcagggcucaccgccuucucaggcuuagacgacuacuaaaacgugaaggaauacucagugccgcagacuucaacucagacggauuacccaaccucccaauagacgcauggcagcuacgcgucgcaggucuagaacgcaaacuaacaaaccaggaaugggccgccguccuccuccaccuaguaaagcacaggggauaccucucacagagaaagagcgaaacccagacggaaaacaaggaacuagggagguugcucgcggguguggccgaaaacagcaaacuccucucggaaucaagcgaacaguaccgaaccccagccgaacucgcaguaaagcuguuugccgaacaaucuggccgccugcgcaacaaaggaggcgacuacacacacacguuuaauagacuugaucugcagaaggaacugcaccuccuguucgaacggcaaugcgcacucggaaaccccuucgcuucggccgagcuccaauccaaaguagacgagcugcugaugacacaacgcagugcgcuccaaggcgaagcaguccuaaaaaugcucgguaagugcacauucgagccgagcgaguacaaagcggcaaagaacaccuacuccgccgagcgcuucauauggcuaacaaaacuuaacaaccucagaauccucuacaauggagaagaccgcgcgcucgacgagggggaaagaaagcaauuacuagacgaacccuacaagaaagcgaagcuaaccuacaaacaaguccgauccauacucaaccuccccgaaagcgcggucuucaagggacucagauacgggaaagacagugacggacuaaaagccgagaacggagcgcuuauggaaaugaaagcauaucacaaaauaagaaccguacucgaaaaagccgggcucaagggcgagugggaaaaccgaauccgcaacccggagauccuagaccaaauuggcaccgccuucuccguguacaaaacagacgaagacaucaaggcagaacuggccgcccucagacuccccgagaacguccuggaugcccuccucgccggauugaauuuugacaaauucauucaacuuagccuaaaggcacucucaaacauacugccccugauggaaagaggaauccgauacgacgaagccugcaaagaggucuauggagaccaccgcgcacuagccgagagcaaaaaccagauguugcucccacagauacccgcgaacgaaauacggaaccccgucguccucagaacccuaacucaagccagaaaagucauaaacgcaaucaucagacgcuacggcagcccccaacgcguacauaucgaaacggcccgcgaacucggaaaauccuucaaggacagaaaagaaauagaaaagcgacaagaagaaaaccguaaggaacgcgaacgugccgccgaacacuuuaaagaacucuucccccgcuucacuggcgaaccuaagagcggggacauacuaaaauuaagacucuaccaacaacaacaaggcaaaugccucuacagcggaaucccaaucgaccuagggcgccucaacgaaaagggauacgucgaaaucgaccacgcccuccccuucucacgcaccugggacgauagcuucaauaacaaaguccuaguacucggcuccgagaaccaaaagaaacgcaaccaaacccccuaugaauaccucgacggagccagggacagccaacgguggcgagaguuccaagcgcgaguacaaggcugccgauuccccuacgcaaagaaacagaggauccaaaccgcgaaauuggacucaaaaacagaacagggauuccucgaaaggaaccugaacgacacacgauacauagcccgauuucuaugcggcuucauagaaaaaucccuccaucuccaaggagccggcaaacgucgugucuucgccagcaacgggcaaaucacagcacuccuacguggccuuuggggccucaagaaagucagagaggacaacgaccgccaccacgcacucgacgcuaucgucguagccugcucgaccguaucaaugcaacagaaaauaacgaaagcaaugcaaagaagagaaacgcucgaaaccaucaacacagaaaccggagaagucaagacccgcaucccgcagccaugggacuucuuccgacaagaagucaugauaaggguauucuccgacgcgccgagagaggaacucgccgaaaaacucaacucgagaccagaagcucuccacgacuucguauccccguuauuuguaagucgcgcaccaaacagaaaaaugaccggacaaggacaccuagagaccguuaaaagcgccaaacgacugagcgagaacaucagcguaguaaagaaaccacucacggcucuaaaauuaaaggauaucgaaaacauaguaggauaccccgaccgcgagccagcccuauauagggcccuccaagaacgacuacaggccuacaaagacgacccagccaaggcuuucgcagaacccuucuacaaaccggcaaaagacggaggacaagguagccuaguaaaagcagugcggauaauagagaacaccaaacauggacuaaaaguacgcaacggaaucacugauaccaacggcgacaugguccgcgccgacgucuaccaaaaggcagacaagaaaggaaaacgucaauacuuuaucguacccgucuacgccuggcaaguugaaaagaacgaacuaccaaccguagacugcaaaggcuacgaaauugacgacaccuacgaguucugcuucagccucuacaaauacgacauuaucgaaauacaaaaccccgacaacaugucaaaagagcuacgcgucuacuacaucaacugcgauagcagcgacggcagauuuuggcuagcccaccacgacaagucagccaaggaacaacaauuccgcaucucaacgcagaaccagcccauuauuaagaaauaccagguagacccacucgggaaagaaauucgacucugcaaagcagaaaaacgaacagaacucaacggcaagaagaagaaauga

SEQ ID NO: 6161 - RNA, 3210 nt, Artificial Sequence
  Cas9 variant
augaacuacgacaucggucucaggaucggcaucacauccugcggauggucaaucauaaacaaagacuuagaaaggauagaagacuugggcguaagggucuucgagaaagccgaaaaccccgacgggacagccucagccgccccgcgccgcgaagccaggaagagucgccgaaaacacagaaggaagaaacaccgcaucgaacgcaucaaaagacuaaucguacaacacgaccucuuaagcaagaaagaacucgacagccucuaccuaagccccuucaacaucgacgucuggaaccuccggguugaagcccuagagagaaaacuagacaaccgagaguucgccagaguccugauccaccuuguccaaagacguggcuuccagaccauccgcaaaucaguggaaauacaggaagaaggcaaacuccucgaaaacguauccgaaaacgagcgcaucaugaaaguaaacggcuacaaaacuguuggugaaauguucagcaagcacgagaaauucacccaccacaaaagaaacaaagacggcaguuauacaagcguagucaccagaucucuucuauuaaaagagauaaaaacaauauucaacucccagcgaauccuuggaaacguauuuucaacacaaaagcucgaguccgacuauuuauauaucugggggagccaacgccccacgcugaccuacgaacaacuuaugagcaugguagggaacugcaucuaugagaagaaagagaaacgagcccccaaaaccuccugggcguuccaauacuucagccuccuccagaaaaucaacaagcucaaaguaucagacgacaacacacuacgaaaacucagcaaagaagaacgcgauaucguaaucgaacucgccuucaaaaagaaaaacguaucguucgucgacauccgcaaagcccucaaacucaacgacaauaccaaauucaaucaccugacuuauagccacgucguagaaaccaagaaagucgaaaaagccaccuucaucgagcuaaagggcuaccaccugauaaagaagcaacucaaggaccgcaaugucgagcucacucaagaacuccaaccaaaggacuacgacgcaaucgccgcagcgucaacauuuuucaaaaacgacauagaguuccgagacuaccuacgcaaucaauaccucgacucaaacggaaaacgcaaaucaaacaucgccaacaaaguauucgaagacaaagugaucgcagccgucuuugaacucaacuuuuccaaagucugccaccuuaguuuuaagucccuguauaagcuaauaccccaccucgaaaaaggccuggacuacaaggaggccauucucugcgcgggcuacaacuuccgugacgaaaacaaacgagacaagaaacuuuuccugcccguuauacaacaagaaaccaaccccgucguccaucgggcccugacccaagcacgaaaaguaaucaacgcaauuauucgcgaguacggaucgccaaacacaauccgauucguagucgcuaacgaucuagcaaaaaccuacaaacaacgaaaagagcuagaguccacgcucaaaaagaacagagccgaaaacgagaaaaucaagacaaaacuccuaucaaugggcauaaucaauccgacaggaauggacauuguaaaauacaaacucugguaugaacaaagcggaauaugccucuacaccggccgccaaauggagcugagcagccuauucaaaccgggauacagcaucguaaaccacaucauacccuacaaccgaucauucgacgacacuuaccacaaccgcgucuugacacuaaccgaaaccaaguacgaaaaaggcaacaagauccccuuugaauacuucggagcggaagaaaccugcuggaacgaguacgagaagcguguaucgaccagcaagaaaauucacgauaagaaacgcgaaaaacuacucauacguaacuuugacaucgaauacgaaaacgagaugaucagcaacaacgucuucgacacucacuacaucgguuccuacuucgaaaaauacaucgacgagcaucugcaguucaagaaaagcacgaagaaacagaaaguauucagcauccacggaaacaugguagcgcacuugcacucacgcuggggauucaacaaaaacucgcgcgaaauauaccugaaccacgcggucgaugccgccauuguagccguacugaccgaccaauugauccgcaauaucgccgacuacuaccgacgcgacaacauucucgaacaaaaaggcucgcucaaauucccggaaccguggaaauccuucagcauagaacuggaagcgagaaucagcccccaaguacgcgaccucaucaagaaacucaaccuggacuccuaccuugaugucgacauacuacacaucaaaccgguuuucaucuccaagaaacccagacgcaaagucaacggcgaggcccacaaauccacuauccgcucgcucaucggcaucaacgagaucgggaaaacaguaaccugcauaaaaacacgacuagaagacauccccuucgacgaaaacggcgacuucccgauguacggcaaagacacagacaaauacaccuacacggcaauuaaggaacgcuaccucgaguucaacaaggauaaggaaaaagcauucuccacaccccuguauaaauuaaaacgaaacggcgaaccuggcaaccaaaucaaauccguaaaaauaaucgauacccgaaacauaguaaacaagguuaaccaaggaaagggcaucgccuauaacagcaacaucauccgcguggacgucuucagccgagaccaaaaguacuacguagucccgaucuauuuacgagauuucaucaagggaucccugccaaacaaaauaaucaccgccgcuaagggguucaugcaauggccggagacugacaacagcuauacauuccuauuuucgaucuucccaaacgaccugaucaaaguaguuccaaaagaaggcaaauucaucaaagccaaaaacgaaaacaaggaaaacaucaaccuuaccgaaauacucggcuacuucaaaggccuagacagcaguacgggagcuuucacccuggaaucccacgacggcucgcuacuggcccgaggaaucggaaccaaaaaccuauuacucauagagaaauaccagguggacguccucggucgguacaacaaggucggcaacgaagaacggcaggacaucaagauacaacaaaacuga

SEQ ID NO: 6162 - RNA, 3210 nt, Artificial Sequence
  Cas9 variant
augaacuacgacaucggccuucguauagguaucacaucaugcggcuggucuauuaucaacaaagaccucgagcgaaucgaagaucucggaguccgcguauucgaaaaggccgaaaacccggacgggaccgccucagcggccccgcgccgcgaagcccgcaagagccgacgcaagcaccgacgcaagaaacaccgaaucgagagaaucaaacgacuuauuguccagcacgaccuacugucaaagaaagaauuagacucccuguaccuaucucccuucaacaucgacguguggaaccuccaagucgaagcacuagagcgcaaacuggacaaccgcgaguucgcacggguacuaauucaccucguccaacgcaggggcuuccaaaccauccggaaaucggucgaaauucaagaggagggaaagcuccuggaaaauguaucggagaacgaaaggauaaugaaaguaaacggcuacaagaccguaggcgaaauguucuccaaacacgagaaguucacgcaccacaagcgcaacaaagauggauccuacaccuccguugucacucgcucacuccucuuaaaggaaauaaaaacaauauucaacagccaacgaauccucggaaacgucuucucgacgcaaaaacuagaaagcgauuaccuauacauuuggggcagccagcgaccaacccugacguacgagcaacugaugaguaugguuggcaacugcaucuacgagaaaaaggaaaaacgcgcccccaaaaccagcugggccuuccaauacuucucgcuucuccaaaagaucaacaaacuaaaaguaagcgacgacaauacacuccggaaguuaucaaaagaagaacgugauaucguaauagagcuagccuuuaaaaagaaaaacgucuccuucgucgacauccggaaagccuuaaaacucaacgacaauacaaaauucaaccacuuaaccuacucacacgucgucgaaaccaagaaagucgaaaaagcaacauucauagaacugaaaggcuaccaccucaucaagaaacaacuaaaagaccgcaacguagaacuaacacaagaacuucaacccaaggacuacgacgcaaucgcagccgccucgacguucuucaaaaacgacaucgaguuccgcgacuacuugcgcaaccaauacuuggacucuaacgguaagagaaaaagcaauaucgccaacaaaguauucgaagauaaagugaucgcggccguuuucgaacuuaacuucucgaaagucugucaccuaucguucaagagucuguacaaacuaaucccccaccuugagaaaggccuagacuacaaggaagcaauacucugcgcaggcuacaacuuccgggacgaaaacaaacgcgauaagaaacuauuccuucccgucauacaacaagaaaccaacccaguagugcaccgcgcauuaacgcaagcacggaaagucaucaacgcgaucauucgcgaauacggaucacccaacaccauucgcuucguugucgcaaacgaucuagcgaaaacguacaagcaaagaaaggaacucgagagcacacucaagaaaaaccgcgccgaaaacgaaaagauaaaaacaaaacugcucuccauggguaucaucaaccccaccggaauggacaucgugaaguacaagcucugguacgaacaaucaggcaucugccucuacaccgggcgccaaauggagcuauccucccuuuucaaaccaggcuacuccaucgucaaucacaucauccccuauaaccguucauucgacgacaccuaccacaacaggguacucacucucaccgagacaaaauacgaaaaaggaaacaaaaucccguucgaauacuucggcgcggaagaaaccugcuggaacgaauacgagaaacgagucucaaccaguaaaaagauccacgauaagaagagggaaaaacuacucauccgcaauuucgacaucgaauacgagaacgagaugaucagcaacaaugucuucgauacccacuacaucggaucguacuucgaaaaauacaucgacgaacaccuccaguuuaagaaaagcacgaagaaacaaaaagucuuuagcauccacggaaacauggucgcucacuugcacucgcgguggggcuucaacaagaacucacgcgaaaucuacuuaaaccacgccgucgacgccgcgaucguagcaguacucaccgaccaacucauucgcaacaucgcagacuauuacagaagggacaacauacuagaacaaaaaggcucccugaaauucccagaacccuggaaguccuucagcaucgaacuggaagcccguaucagcccccagguccgcgaccucauaaagaaacucaacuuagacucauaccucgacguugacauacugcacaucaaaccggucuucaucucgaagaaaccccgcagaaaagucaacggggaagcccacaaauccaccauaagaucccucaucggaaucaaugaaauagggaaaacagucacaugcauuaaaacacgccucgaggauauccccuucgacgaaaacggggacuucccaauguacgggaaagacacagacaaauacacauacacugccaucaaggagcgcuaccucgaguucaauaaagauaaagaaaaggcuuucuccacuccccucuacaaacuaaaaaggaacggggaacccgguaaccagaucaaaaguguaaaaauuauagacacccgcaacaucguaaacaaaguaaaccaaggaaaaggaaucgccuacaacagcaacaucauacgcguugacguauucagccgcgaccaaaaguacuacgugguaccaaucuaccucagagacuucauuaaagguucacuccccaacaaaaucaucaccgcagcaaaggguuucaugcaauggccggaaacggacaacagcuacaccuuccuguucucaaucuuccccaacgaccugaucaaagucguccccaaagaggggaaauucaucaaagccaaaaacgaaaacaaggagaacauuaaccucaccgaaauacucggcuacuuuaagggccucgauucguccaccggggccuucacuuuagagucccacgacggcucccuccuagcccgaggaaucggaacgaaaaaccuccugcucauagaaaaguaccaggucgacgucuugggucgauacaacaaggucggcaacgaagaacgacaggacauaaaaauacagcagaacuga

SEQ ID NO: 6163 - RNA, 3213 nt, Artificial Sequence
  Cas9 variant
auggcaacgagacucggccucgacaucgggacgaacuccauaggcuggugccuauacgacggcgacucaauccgcgacaucggcguccgaaucuuccucgacggaagagagcccagcaagcugacgguguccggcuccggaacgccccucgccguaaaacgccgcgacgcccgcggcgcccgaagacgccgcgaccgauacaucggucgccggagcgcuaugcucagagaacuucgaaaacacggccugcuaccagcagauccaaaacaggcaaaaguauuagagacacaggauccauacgcacuaagaguuagagcccuagacgaaaaacuugaaccacaccaaaucggacgagcacuguuccaccuaaaccaacgacgaggauucaagagcaacagaaaagcggaaagggccagcaaagcaggagaagacggcaaaaucgccacagcaacaaaacugcuagacgaagaaaugcaacgccugggagcacgcacccuaggcgaguuccuagugaaacgagacagcgaguucgacggagaagcaggcaaacgaguacgcaugagagcagacucgaaggcauacgacuucuaccccgaccgccgccacgugcuagacgaguucagagccaucuggaacgcccaaaaaguauggcacccugaacuacucaccgaacaggccuggaacgacaucuuccgggucaucgaauaccagagagaacuaaaaccacaaguagucggccacugcaccuucgcagguauaaacgggguacccgccgacgaaaagcgacugcccaaagcccacccacuguuccaacagcgacgacuauacgaagaaguaaaccaacuaaaggucgucgccccgggagaagccggaagaccauuaacccgcgacgaaagggacgcacuaauccuaaaacuacaggacaagaaaucgguaucauucgagacccugggaaaaacccuaaaacucaaagacggugaacgauucaacaaggaaagugaaaaccggaaggcccuggacggagacgaaguccgggcagcccucagcggaaagaaacucuucgguacacgcugguuccauuucagcgccgaggaacaauggaugaucaucgaacgacuccucgaagaagaagacucugaaacacuacuaacauggcucaaaaucggauacagacuugacgacgaggcagcccuggcagucgcaaaugccaaacuacccgagggccacggccgcuucggacucagcgccacaaccgcccuucuaaaagaacucaaagccgaugucugcaccuacgccgaggccgcaaaaagagcaggguuccaccacucggacuuccgcaccggcgaagucuucgaccagcucccauacuacggagaaauacucgcccgggaaaucgcacccggcaaaccagaauauggcgacgaaaacgaacgaagauucggcaaaaucaccaacccaacgguccacaucggacucaaccaacuaacuaagcucgucaacgcuauaaucagacuacaugggaagcccgauuacauauucguagaacuagcaagggaacuaaaacucaacgaaaaagagaaaaucgcauacaaccgucaacuaaaagaaaacaccgacgcagcgagagauagaggcgcaaaacuaggaacaauggggguaagagacacuggccgcaacaggcuaauacuaagacuguggaccgaauugaauccaggagaugcucuaaaccgacgaugcccguucugcggagaacagauaucacaaagaaugauacagaauggggaagucgaaaucgaacacauaaucccauacagccaaugcuucgacgacggaaucgggaacaagguccucagccacguaagaugcaacaggcaaaaaggagaccaaacacccugggaacgauggggccacgacccagaucgauggucaauaauccaagaacaggucgcccacuuacacagauccaaacaauggcguuucgguccagacgcccgggacagguacgcagcugaagaagacagcuuucuccccagacagcuuauugauacgcaauaccucacaagaaucgccgccaaauaccucgcuugucuauacccagagcgcggcgagagacacguguucgccguccacggaggcaugacagccaugcuaaggcgccucugggaccucaacagcauccuacucgaccacaacugggucgaaaaccucaauagcaacgcaccgaaaaacagacuugaccaccgucaccacgcgaucgacgcggcgguggugggcaucaugaccccaggccuaauagccgaaaucgcaaaagcugccgcuagagcggaaaaacaaaaccuagauagacuguucgaagaauuaccuaugcccugggcccaacacccgaacgaccgccguuuccgcgacgaacuccgcgagaaaauacuggcugcgacggucucccacaaagccgaccacggacgacagggcaagccagaaagaggaagagacauuaccgccggcaaauugcacaacgacacagcauacggcuucacgggccuuaccagcgauaccggccuuccaguaguuguacaccgagucccauuaacaagccucacccccaaagauauugccgaccccgaucgaauccccgacacgaccuuaagagggagccucuggcaagccacacgugaccucagcggcaaggaguucgagaaagcacugcuggacuucucucgcacccacgcacaauuuaaagggaucagacgaguuagaguacgagaaggccucacacucauccccauccgaaaccacgccggaaaacccuauaaagguuaccuaggagacaguaacgcccgauacaacguuuggcaaaugccagauggccgcuggguccaccaaguaauaagcacauuugaccuccaccagccaggcuucaucgaacaaagaccacaccccgcagccaaaaaggugcucagccugcgacaaaacgaccuaaucgcaauugaacgcgacggagcacuccgacaaaucaugagaguacaaaaauacggccaaaauggucagaucuuccuuauagaacauaacgaagcagguaacauggcagagagaaacaaaaauacagacgaccccuucaaauucuacggaccgggagcaucggcacucaggaauaugaaagcccgacaaguacggaucgacgaacucgggcggauauucgacccaggcccacgguga

SEQ ID NO: 6164 - RNA, 3213 nt, Artificial Sequence
  Cas9 variant
auggccaaagacuucgaauacauccuaggacuggaccugggagaaaccucaauaggauggagcgugguccgacuaaacgaaggaguacccgagcaucucgaacgacucggagucagaauaugcucugauggacgcgaugcccagagccacgagccacucuccguagccaggaggaucgcacgcggccuccgacgacggcgugaccgcuacauccaccgucgaauccgccucaccgacguccuaguaaaguacggucucaugccagaggacaucaaagagcgcaagaaauuacaggcccucaacccauaccgacuccgcagcgaagcccucgacagaaaacucgaaccuuaugaacuaggccgaguccuauuccacauaaaccaacgccgcggcuucaaaucaaacaugaaaacagaccgcaaagacagcgaaaguggagcaaugaaacaagcaauacuuaaaacacgagcgaaaauggaagcaagcggcgcacggacccugggugaguuccuauacuuccucaacaaggacaaaacaucgacacaagaauauguacccguaagaaugcgaagccacagcgaaaagaacaagacggucuacgaaauguacccggauagagccauguacgaagacgaaguccacaagaucuucgaacaacaggaacucuccccggaggcccaaacggaaauauucaacacaauauucuuccaaaggccgcugaaacccguagaacucggauucugcgaguucgaagacggugagcgacgggcauacaccgccaguguaguuuuucagaaguuccgcgcucuccagcagauaaaccagauuuacguacaggacgacuacgagcgccgcccgcuaacuaaagaggaaaaggacauacuaaaacacuuccugcuagaagacuucagcgcccucgacaagaacggacuccuaaccugggccaaaguccgcacccucuugaaauugcaaaagaagaaauucaaccuggaaagcgaacgccgcaaaggacuaaaugcagacgucacauccuggaaacucaguaacgccgcaugcuucggccgagaaugguucucauucuccgacgccaagaaggaagaaauugucgcacuuaucacgggagcagaaaaagaagaagaauuaauagcagaacucaaaacaaaguacgggcuaucagacgagagagccaaaaacacagcaaacguaucccucccagacggcgucgcaagucugagcgccaaggccaugaagaagcucaucccguuccucgaagaaggaaugcuguaugacgacgcaguaaaacaggcgggcuauguauucagcucauccuucaagggagugcuccccgaaaaguacgaaaccuucaucgaacccgaaagcggagaauguuucgacgagcuaccauacuacggccaaguccuccgacgcuacgugcucggagggguaccaucagaggaaaacaaacuauuccccgagaaauauuacggcaagaucaacaacccuacagugcauauaguccugaaccaacuaagaaaacugauaaacagccuggucgccaaauacggacaucccagaaagaucguagucgaaauggcgcgggaccuaaaacucaguaagaaacaaaaagaugcaauagcuaaagaacaggcucucaacgaacgcgaaaacaagcgaaucggcgcagaacuagaacgccucgauauacgaaacaacuacgacaaccgaaugaaguacaaacucugggaagaccucucaacggacccaacaaagcguagcugcccauucugcggaaagcaaaucucacaacaggauaucuucuccccugaguuugaaaucgaacaccucauaccauucagucggagcuuuauggacggccggucgaacaaagugcucucaugccgacgcugcaaccgcgagaaaggcaacaagacccccuucgaagccuuuggaaacgacagcacacgcuggaacgcaaucaugggccgaguagaaucgcuaccugaaaacaagcgcuggaaguucgccuccgacgcaaugucaagguucgaacgugauggcgaucuccuagcacgcaugaugacggacacacaauacauggcacgaaucgcccggcgcuaucuaugcugcgcagcaaaccccaaccaaguuuaugguauacccggccaacucacugccaagcuccgcgaacauuggggccucaacuccauccuauccgaccagaaagagaaggaccgaagcgaccaccggcaccacgcgauagacgccuucguaguagccugcacagaccggggcacacuccaaaaguacuccacagagcgacgcgacuacgccaaaccggaaaugccuagcgagaaagcgccccacauccccuucgcggacuuccgccucagcgacauaaaaagagucuucgacgagauaaucguaucgcacaagccggacagaggcaacgcacgggcagccaucuuaaaaggcgggacgguugccaaacuacacgaggaaacauacuacggaaugggcggagaaggcucaaagaaaggaacauggaaacucauccaacgaaucccaguauccgaaaucaagaaagcguccgaccuagacugccugauagaccaaaaaggcaccgcgaacccccuccgagugcugcucguaggagcaagcgaaucggaacaggaacaaauaauagcaucauacuucgcccgaagaggaacgcacaaagugcgcaccuaccgggagcgaaacaaggacguaauccucccguucaaggacaaagacggaaaacucuaccgauacgcagucuauggcagcaacgcguacgcagaaaucuacugcccugacagaggaaagaacgcagguaaauggcagguugaaaucauucccaacuacugcgcccaccagaaaggauuuaucccgaaauggcgccacaccgacgcucacgcuaaacucaucaugcgccucuacaggaaugacaugguggcauacgagaaggaaggaaaaacagugaucgcccgcguaaagaaaaugggcggaaacggcgucaucguauuccgaaaccacuuaaucgccaaagaagaaggcgaccgccucagcuggcaagccgugguuucaggaaugcaaucagccaaccuccguaaaaucuaugucgacguacuaggccgggugauagacccuaaacgacccaugacccaaaacgaaacagauggacaagauaacuga

SEQ ID NO: 6165 - RNA, 3213 nt, Artificial Sequence
  Cas9 variant
augagccacuuccgacugaaacaacuaaacuacauauuaggccuggaucuaggcauagcaucaguagggugggcaguaguagaaaucgacacagaagagaaccccacacgccuaauagaugucggaguacgaaccuucgaacgagccgaaguacccaaaacaggagacucacucgcagcagcgcgacgccaagcgagauccgcccgaagacucauacggcgacgaacccaccgccuacuacgugcccgcagacuacucaaacgggaaggcauccuacacgcagacgaccucaacgcugaaggucuaguuaaagagcuccccaacacgccuuggcaacuaagagucgacggcuuagaucguaaauuaaugcccaaggagugggcagcaguccugcuccaccuuguaaaacaucgcggguaccuaucacaacgcaaaaacgaguccgaaggcgccgacaaagaacucggccgacugcucgcgggcguccacgaaaaccaccaggcccuccagaguucagaauauagaacaccagcagaacuagccgucaagaaguuccaagcacaaaguggccacauacggaaccaaagaggggacuacacacacaccuucgacagaaaggaccuccagcaagaacuccaccaacucuucgccgcccagcaaaaauaugguaacccauuugugucagacggccugaaacagggcaucgagacccuacuaaugcaacaacgaccggcauuguccggcgacgcaguucagaaaaugcuaggcagaugcacauucgagacggaagaguucaaagccgcaaagcacacauauucagcagaacgguucauauggcucacgaaacugaacaaccuaagaauacaagagaacggcaacgaacgaugcuuaacugcccaggagcgcggccaaauaaucgaucucccauacaagaaagcgaaacuaacauacgcccagguccgcaaagagcuaucccuccccgaaaacgcauucuucaaagguuugagauacggcaaagagaacgccgagacagccgcccucauggaaaugaaagccuaccacgccaucaggaaggcacuugaaaaagccggacugaaaaccgaauggcaagggcuagcaugcaaacccgagcuccuagacgcaauaggcaccgucuucucacucuauaaaaccgacgaagacauuagcacccgccuccaagggcaacuuagugaagacguaauaaacgcccuauuagccggccucaacuucgauaaauucauccaacuaucgcucaaagcccuaucaaagauccucccccugauggaacagggccagcgauacgacgaagcccacgccgcacuauacguccguagcacgccacaaccacagcggcugcugccccaaaucacagcagacgaaauauguaaccccguugugcugagaacacuaucccaggcccgaaaagucaucaacgccaucguaagacgcuacggaucacccgcucgaauccacaucgaaaccggacgcgaaguaggcaaaucauucaaggaccgccaggagauccaaaaacggcaggaagacaaucacaaagagcgaaaacaggcagcagaaaaauuucuagaauauuucccgaauuucguagggcaacccaaggccaaagacauccucaaacuccggcucuaucagcaccaacacggccaaugccuauacaguggcaaaacacuggacauuugccgacuuaacgaaaaaggguacgcagaaauagaccaugcacuucccuucucccgcacaugggacgacuccuucaauaacaaaguccuggugcucgccggagagaaccaaaauaaaggaaaccaaacuccauaugaauggcuaggcggcgcaucuaacucaccccgcuggcaggaguucguagcacgcguagguagcagucgcuuccaccacucaaagaaacagagaauacuccuccgucaacucgacgaagaaggguucaaagaacgaaaccucaacgacacacgcuacgucgcgcgauuccucugcaaauucaucgaagagaacaugcuccuccuaggacgcggcaaaagacgagucuucgcaucaaauggccaaauaacuucguuccuacgaagccgaugggggcuccguaaaguacgcgaagaaaacgaccgacaccacgcccucgacgccgucguaguggccugcuccaccguggccauacaacagcgcauaacauacuucguccggcaacgcgaaaugaacaucuucgacggagaacucaucgacaaagaaacaucagaagucaguagaccguacuucccacaaccaugggacuucuuccgacaagaaguaaugaugcgaguauucggcaaacccgauggggaccccagcuuccccgaagccgacacgaaagaaacacucugcacacuccuagagacuaggcucagcuccagaccccaagccgugcaugaguacgucacaccacucuuugucucccgcgccccaacccgaaaaaugucuggccagggacacaaagaaacgguaaaaucagcaaagcucuuacacgaaggaaaaagcguccugcgagucccacuaacccaacuaaaaccuaaccuccucgagaaaauggucaacagagaccgcgaaccacaacucuacgaagcacucaaagaacggcuagcggcauacgguaaugacccggccaaagccuucgccaccgaauuucggaagaaagggggacaacuggucaaagccguacgagucgaagacacccagaaaagcggcguccuacugcacaaaggcaccggcgucgcagauaacgcaacaaugguccgugucgacgucuucgagaaaagcgggaaguacuaucuaguuccuauauauucguggcaagucgcccaaggcauccucccaaacaaagcagucauccaaggcaaggacgagaagaacugggacgaaauggacgaaacguacacauucaaauucucaauguaccccaacgaccucgucgaaauaaacacaggcaaacagcgccucuucggcuacuauauaggccuagaucgcgcaacuggcgcaauaagcauaagagaacacgaccucgacaacuucaaaggcaaaaacggaauauacagaguaggaguaaaaaccgccauauccuucaagaaauaccaaaccgacgaacucggaaaagucguggugccaugcagacccaagaaaagacuccccguccgcuga

SEQ ID NO: 6166 - RNA, 3216 nt, Artificial Sequence
  Cas9 variant
augaggcuagggcucgauaucgggaccaacaguauaggcugguggcuguaccagaccgacgacgggacaaucaccgacguacucgacgggggagugagaauauucucggacggacgagacccccagagcaaagaaucauuggcgguagaccgcagagucgcccgggcgcaaaggcgcaggcgagaccgauaccucagacgcaaggcugcgcucaugaaaaggauggcgggagcaggccugaugccgacagaccaagcgcacgccaaaaagcucgagagccuggacccauacgcacuccgagcagaaggacucgauugcgaacuccccuuaacacaccuaggcagagcacucuuccacuuaaaucagagaagaggauucaaaucgaacaggaaaacagaccggggagacaacgagagcggaaaaaucaaagacgcaaccgcacgacuggacugggcaaugagggacgccaaagcaagaacauacggggaauuucuacacacgagacaacagaaagcagaugacccaaaaagaaugccaacaguccggacaagacugacaguggcgcgacgcgacaaugccgagaaggaggaagccggauacgacuucuaccccgaccgacggcaccuguccgaagaguucgacgcacucugggcggcacaagcagacuaccacgaagcacuuagcgacgacuugagggaccagaucaaaacgauaauauuucaccagagaccacugaaaacacccgaaguaggacuaugccuauucacagacgaaagaaggaucccaucagcacacccgcucaaccaacgaaggauacuauuagaaacgguaaacgcacuacgaaucguagcaagaggggaagcggcaagacgccucacacucgaagaaagagaucaaauaguccacgcccuagacaacaaaaaccacacuaaaacacucucagggauggcaaugaaguugaaagcacuaggaaaaguaauaaggcuccgcagugaccaaacguucacacucgagacagccaacagagacgccauagcaugcgaccuaguacgagcaagccuuagccaccccgaucgaaugggcggugucuggacgacacuagacgaaggagcacagugggagguaguccaaaggauaagggcugugcagucggacucagaguucgacgcgcuaguggucuggcuagaacagaaccacgggcucgacaacgcccacgcgcaagccaccgcgaacgcaccacugcccgaaggauacggaagaauggggcuaauggccacacgacggauacucgcagcgcuacaaucagacgugaugccguacucggacgcaguggcggccuguggauggucccacagcggagggcccaccggagaaguccuggaaaagcuaccguauuacgggaagaucuuggaccgccacguaaucccgggaaccuacgaugaaaacaacgaagacgugaaaagguauggaagaauaacgaaucccacgguacacauaggacucaaccaaauaagaagacucguuaaccggauuaucugcauacacggaaaaccggacgagaucguagucgaacuggcccgagaccugaaaaacucagaagaucaaaagcgugagauccagaaaaucauuaagaaaaacaccgacgcagcaaucaagcgcggcgaaaagcuaauaaacgaacuagggcaaaaggacacgggagccaauaggcuagugcugcggcugugggaggaccuaggacacgacgugaugacgagaaauugcccauauagcggaaaacgaaucuccgcagggaugcuauucgacggaagcugcgacguagaccacauacucccguacucgcgaacacuagacgauggaauagcgaacaaaacccuaugccuaaaagaagcaaacagacaaaaauccaacaauacucccugggaaguauggggcgaaaccgaacaaugggacacgauugccgcuaaucugaaaaaccuaccggacaacaaggcauggcgcuuugcaucagacgcgaugcaacgauucgaaggagaaaacgacuucuccgcuagagcgcuaaaagacacgcaguaccuaagccgaaucgcccgggcauacuuagacgcccuuuacgacggcggagacggcaacagccacguauggguagucccaggaagacugacagagaugcuccgacgacacuggggacucaacggguuagaagcgcuaacagacuccgacgaaaauacggucaaggccaagaacaggauggaccaccgacaccacgcgauagacgccgcaguuguagcggccacggacagaggacuaauucaaagaaucagcaaaauagcaaaacgggacgaacaggcaggagccgaagagguggcgagaucggucagcccgcccugggauggcuuccgcgacgacauugccgcucaacugagccgaaucaucguaagccaccgcgcagaccacggccgcaucgacucccaagcaaaacaacaaggcgaagacgccacagcggggcaacuacacauggauaccgccuacggaguaguggacgccgggcggguagucucgcgcaaaccccugcuaucacucuccgaaucagacauaaagaaaauacgcgaucccgaccuccaacgacaccuaacaagggucacaaaaggccuggacaagaaagaguucgaacacgccuuaagcgauuucgcaaaugcacgaaaacuccccgaccagagcgaaaacccguacuuuggaaugcgccgcguacggcuaaucgacgcauuacaagacucggcccgggucaguguacgagaccgcgacggccacaucuacaaagccuacaaagccggcucgaaccacugcuacgaaguauggaggcuaccagacggcaagauaaaacccugggccaucucgacauuugaggcccaccaaaccggaacagaaagcaaaccccaccccgcagcaaaacgcuugcuaagaguauucaagagggacauggucgcaauagagagagauggagagacccugaugugcuacguccagaagauggacaucgccaacggccucuuccuagucccucacacggaaggaaacgccgacgcacgaaacagagacaaagacgacucauucaaauucauccagaugucagcgguaagucuaauccgggcaaagaucagacgcauacacgucgacgaaauggggcgccuaagagaccaaggaccacccagauga

SEQ ID NO: 6167 - RNA, 3216 nt, Artificial Sequence
  Cas9 variant
augagauacaccauaggccuagauauaggcauagcauccguugggugggcagugaucaaugaggacaagagucggaucgaggacuuggggguaagagucuucaagaaagccgaggaacccgauggaaaaagccugaaccuggcccggagagaggcccgaggaagccgccggcggauacgacgccgagcaacaagaaugcagaaggucaaagaacuccucgucaaguacaaucucgucagcgagaaggagcucgaaacgcucuacaucaucaccgaaacgacaccggacguguacgagcucagggccaaagggcucgacagacugcucagcaggcaggaguucgccagaguacuaaccaacaucgcaaagcgaagaggauacaagagcaacaggaagaucgacgaagaagacaaagaagugggaaaacucagcaaaggcaccaucgaaaacaaacggauccuccaagaaaaaggauaccgcacaauaggggaaauguucuacaaagacgaaaaguucgaauauaacaaacgcaacaaagcaggggaauauaacucaacgguguuacggucaaugcucaucgacgaaguacauacccuuuucgaaaugcaacgcaaguucaaaagcgaguucgcaaacgaagaguucgaaaaggaauaugucgaagucaugaccuaucagaaaccauacauaacgccagaacuguuagagaaaaugcucggcaaaugcacauucgaaaaaggggaacccagagcgccuaaaaauuccuauaccuucgaacgauucaugcuucuccaaaaagucaacaaccucaacaucuacaucaacggggaaaagguugaaaucccccaagagaaaaagaaagaaauaaucgaacucgcauacaaacagagcgaaauaaaauacacacagcuacgaaagaaacuagaacuacccaucgaggcccgguucgcggaccucaacuaccaaauaaaaagaacagaggacgagagcgaggaagcacucgucaagaaaauagaggacaagaaauucgucaaacucgaaggguggcauaaaauacggcucgcacuaaaagagaacaaagauaaauucgagaaaauagagaaaaauccagaauuacaaaacaucauagcggacgcacucguuaggaacaagaccgaugaaacuaucaaaaacuaccuagaaaaauccgacauagacgaagaaauaaucaacgcgauccucaacaucaacuucacaaaauucggacaccucuccuauaaggccaugaacaagaucauccccgaacuagagaaaggacucaccuacgacaaagcgugcgaaaacguaggcuacgaguucaaagggcgcaaaaacgaacuccaauauaaacuaccgcccgucaccgaacuagaagacgaaauccucaacucagugguacugagagcgguaagucaaaccaggaaggucauuaacgccauuauagacaaauacgggucccccaccgccauauacaucgaaaccgcacgcgagcucagcaaaccguacgaugaacgcaugaaaaucgaaaagcgacaaaaagaaaacgcggcuaacaacgaccagauaaaagaauacaucaaggaaacuuucggauucgaccccaaaccuuucgacauaguaaaaaugaaacucuggcgagagcaaaacggaaagugcgcguacagcaguaaaccgauaccggcagaacgacuuuacgaggaaaacuucguacaagucgaccacaucauucccuucucacgcugcuucgacgacuccuaccaaaauaaggugcugguacuaacagacgaaaaccagaaaaagaaggagcggacgccauucgaguacuucggggaagacaaggaaagguggcaccaauuugaggaguucguuaaccuaaccuacaaguucaacacgcggaagaaagaaaaccugcucaucaaaaacuucaacgaagagaaaaguaaggaauggauccagagaaauaucaacgacaccaaauacaucagcaaauucauguacaacuacauagccaauaaccugaaguuugccgacagcgagucaaaacgaaaggucuacaacauaaacggccaagcgaccucaauccuccgccauuacugggggcuaaagaaggacagagaagagagcgacaagcaccacgcacaagacgcagugauaauagcaugugcaaccaauaagaacauaaagaaaguguccgacuacagccgaagaaaacuccuauacaaaaacaacgaaauaaucgacgaagaaacaggagagaucaucgacaaaaaguacaacauagacaucagcaucaaggaacccuggccaaaauuccgcgaagaaguugaagcccggauggaagaugcagacaacaacgggcagcuauacgcccugauaaacgggaacuuuacaaacuacgacgacguagacaucacccacauaaagcccauauucaccucccgcaugccggagcgaaaaaucaccggacgggcccacaaagacaccaugcgaucacagaaguucauucagcaaggccaaaauuucacaguggugaaaaagccgcucaaggcgauaagcaagcaggagauagagggaauaaucaacaacccagacuucaaaaaccuguaucucagcgacaagaaacucuacgacgacaucuaccagaaaaugaaagaagcagacuucaaagcagaaaaagccuucgccaacgaguaccgcaaauacagcaaaaaugggaacuccccaaucgucaggucaaucaaggucgccagcgcgggagcgacaggaguacagcugaaaaacggcgcgauagccgagaacgcaaacaugguucgcguggacguuuucgaaaaagacaacaagaacuaccuaguaccgauauacgucagcgacuucgcgaaaaacgaguugccgaacaaagcaaucugcgccaauaaagacgagaaggaauggaucgaaaugacugaaaaguacaaguucaaauucucacucuacccaaacgaccuagucaagaucaaacggaaaaacgaaaaggaguucuacgccuacuacugcucgacacaccgagggaccgggaacaucaaccuacuacugguaaacggcgaggcacgaaaggacggcguggggaucaaaaacaccgagaucuucgagaaguaccaggucgacguauuagggaacauuagcaaagucaacaaggagaaacgagagggagucaaguga

SEQ ID NO: 6168 - RNA, 3216 nt, Artificial Sequence
  Cas9 variant
auggacuaucgcaucgggcucgacaucggaaccaacagcaucggcuggagcauuaucgaacucaccacaguacaaagcaagcucgacgguaaauacagacucaaggcaguaggccuaauagacgccggcgucagaauguucgacagggccgagguaccaaagacaggagcaucccuagccuuaccccgccggcuggcccggagcagccgaagacgccuaacccgaagaagcgcaaggaaaaaggcaauccggaaccuccucgugaaagaagacauacugaaccaaaucgagcuugaccaccuauaucgaacauccgaacucgucgauauauggcaaauacgggucgaaggccuagaacggcgccucggccgacaagagugggcccgacuccugauacaccucgggcaaaaacgcggcuauagauccacacgcaaggccgaggaaggagccgacaccgaaggacgcgccgucuugagcucgaucaaagaaaaccaggaaacacugaaacaauacaggacggucggagaaaugugggcaaccgacgacaaguucaagggcagagugaggaacucgaccaacgaguucaucuucaacguguccagagacaaccucgaagaagaaauucgcuuccucuuccagcaacaacgggaacuaggcuccauguacgcaucuaagcuccucgaggaguccuacauggaagucuggggucaccaacuaccauucgcuagcggagaaagcauacucaaaaacgucggcacgugcucccucuacgagaaagaaaaacgggcggccaaagcgaccuacacauuccaauauuucauggcacuggacaaacuaaacaacguccgcauccucccaucaaugcggacccucuccgaagaggaaagaggacucgcacuaaaggcgauguucgagcgugacaagcuccccaagaacccaccaaaauucacauacagccaccuacggaaggccauaaaacuagaagaagaugaaacuuuccaaacaauaagcuacgacgucgagaaaacacuggcaaccaacgagagcgcaguauucgugaaccuggccgcuuauuaccagauaaagaagguaugcgacgagcacaaugaaaauuacgacuacguagacuacaacacgaucggacacgcccuuacagucuacaaaaccgacgaagacauaaacaaauaccuagcaagcaaaaacaacaucgcaaagagaguauacgccaacgacuucauagacucaguccuaaaacacaguuacacgaccuucggccaccuaagccuaaaggcccuuagccgaaucaucccacuaauggaagagggagaggucuucgcgaaagcgaaggaaaaagccggcuucaaagaagaauccuaccuagaaauuaaaaguaaacuccugaccaacauacccgacgcaaucaaaaacccagugguaaugcgaagccuuacccaagcgagaaaagucauaaaugcaauaauaaaacgcaugggagaacagcccgcaucaauacaaaucgagcuggcccgagagcuaucgaaagacgucagcgaacgaaagaaaauaacaaacggauucgcagaaaacagaagccgaaaccaguucgccauaaaaacacuggaggaaaaccacaucacgaacauccgcggccaggacaucguaaaguucaaacucuggcaagaacaaggcggccgcugcgccuauucacuaaaacccaucaagcuagaggaacugaucagcuuccucaagaaagagcgccgcuacgaacauaaccuagacguggaccacauaauacccuauucaaaaaccuucgacgacaguuacaccaacaaaguccuaguauuuagugacgaaaaccgcaagaaaggggaccaaaucccggcagaguaucucggcaucggcacaaaaaggugggaaaaauauaaagaguucgucaucaccucgaaguucccagccagcaaaaagaaacgccuccugaaggaacaacuugucgaacgagaggagcuguucaugaaagagagacaccuaaacgacacgcgcuaugcgagccgcuacuuuaugaacuuccugagagaaaaccuacugcgaaaagagacgguacuccacgaaacccagugggugacagccguggcggguagagucacaagccacauaagaaaaaggcuaggauucggaaaggaucgcgaggaaacgcacuugcaccaugcgcuggacgcaauaauaguagcgugcacagacaaauggaugaucgacugcgucacaaacuacuacaaaucccgcgaagggggcuccaucaaacgcaaggagaucagauuccccucgccguggaacggcuucuggcacgacgugcaaaccaaacucgcccaacugccacagccagagguaaucaacgaaagcauauccaaaggcaaccccgaugcgguagauuacaugcugguaagccgcaugccccgaaaguccaucacaggagcggcccacaaagaaaccaucagcaaauggggcggauacgacgacaaagggaaagcgcuccuuguuaaaaaggucgcacugagcgagcugaaauucaaaaaugacgauuuccccauguacaacaaggaaacugaccccuuacuuuacgaggccaucaaaaaccgguacgucgaaagcggacgagacgucaaaagggccuucgcgacaccacucuacaaaccgucaaaaagcggcaaacgaaacgaagugaaacgcguaaagguaauagcggagaagaaagcaauggucagagaagucaacggcggaauagcggagaacggagggcuagugagaagcgacauauuccucaaagagaagaaauacgugaugguacccgucuacaccuucgacaccauaaaacagcaacucccgaacaaauaugucguaagcggaagaggauacgaacaauggccggaacuaaccgccgagcacguauuccaguucagcgucuacccauacgagcuagugcacgucgggacuaacaaaggcgacaacagcuucuacuacuucgcuagccuaaacauaucaucaaacguccuaaaguucagcgaaugcaacagacccaccaaggacuacauagaaaucggccuaaauucuauaauacuccuagaaaaauacgaaaucgacguucuagggcgcauaaccggccaaagcaaaaaggggauccgacagagcuucaaaaacaauaagagccaaaugaaagaauga

SEQ ID NO: 6169 - RNA, 3219 nt, Artificial Sequence
  Cas9 variant
augcgacuaggacuugauauaggaaccaacucaguaggcuggugguuguacaaaaccgacggggaggcagcauccgcgcgaaucgucgaagucauagacgggggaguccgaauauucagcgacggaagggacccaaaaagcaagaccucacuagcgguagauaggcgcguugcccgagccgcucgacgaaggcgcgaccgguaccuaagacgacgagccagccucaugaaacucuuagcuagaacgggacucaugccggcagaucccguagaagcaaagaaacuagaacgacucgacccguacgagcuacgauccaccggacuagacgacgcucugccccucacccacuucggacgcgcgcuauuccaccucaaccaacgacggggcuucaaauccaaccgaaaaaccgaccgcggcgacaacgagaauggaaaaauacgagaagccaccgcacggcuggaucuugaaaugaugaccagcggggccagaaguuacggcgaguuccuucauaugcgaagacaacgagccagcgaccccagacauguacccuccguccgcacccgccuauccguagcagcaagaggcggacccgacgccaaagccgaagcaggauacgauuuuuaccccgaccgacaccaucuggaagaagaguuccacgcacuuugggccgcgcaagcaacacaccaccaagcacuaaccgacgacuugagagaccucguauuugaaaagauauucuaccaacgaccacucaaagagccaaagaucggacucugccucuucacagcagaggagcgaauagccaaagcacacccccugacccagcgccgaguacucuucgaaacaauaaaucaacuacgagugacagcagacggaaggagcacgcguccacuaacacucgaagaaagggauacacucguacacgcccuagacaacaagaaaccaaccaaaagcaugacuucaaugaacaugacacuaaaagcccucgcaaaacucuuaaaacuccgcgacggagaaagauucacacuagagaccgggguaagggaaaacauaagcugcgacccaguaagggccugcauggcacacccagccagauucggcccccaauggucaucccuagacugggaagcccaaugggacgucauaucaagaguacgacaaguacaaucagagggcgaguucaucgaacucacagacuggcuaauccagggccacgggcucgacgcggaccacgcaaaggccguaggcaacgcaccccuaccagaaggauacgcacgacuaggguucagcgcaaccgaaagaaucuuagaccaacucaaagcagaagucugcacauacagcgacgccgucgccaagugcggcuggcaccacagcgaucaaaggaccggggccugccuagaaguucugcccuacuacggggagguacuagaccgucacgugauacccggcaccuacgacgccaccgacgacgagauaacgcgcuacggacggaucacaaacccaaccguccacauaggccuuaaccaacucagaagacugguaaacaaaaucauagaaguacacgggaagccagaccaaauaguaguagagcuggcccgggaacuuaaacaaagcgaaccccagaagaaagacgcuaugaaacgccuucgaaacacaacagccgacgcaauacgcagaagcgaacaacuagaacaacuuggacaaccaaacacuggccacaacaggaugcuacugagacuaugggaagaccucggaccagccauagggccacgaugcugccccuacaccgggaaaaccaucucagucaccaugguauucgacggaaguugcgaugucgaccacauacuuccuuucagucgaacucuagacgacucguucgcuaauaggaccuuaugccuuaaagaagcaaaccgcgaaaaaucagaccguacccccugggaagccuggggcggaacagaccaaugggacgacauagcugcgaaccuuaaaaacuuacccgagaagaaacgcaaaagauucggaccggacgcgauggaaugguucgaaggagaaaacgauuuccucgaucgcgcccucgucgacacccaauaccucgccaaaauaucacggauguaccuggauacauuauucacaaaagguggacaugucuggguagugcccgggcguaugaccgaaauguuacgccgacauuggggccuaaaugcacuccugaacgacaaagaccgcggcgcgguaaaagccaaaaaccgcacagaccaucgccaccacgcaauagacgcagcaguaguggccgccacagauuaccgcuuaaugcagaaaauauccagggcagcaggccaaggggaaaacgccgggcaaucggccgagcucaucgcgagagauacagacgcgccgugggagcacuuccgagccgacauagcaucgcaacucgagaaaauuauaguuagucacagggcagaccacggaagaauagacgucgaaggccggaagacaggaagggacaguacagccggacgccuccacaacgacaccgcauacggaguaauagacgaccucacuguagccaguagaacaccccuaaugucccuaaagccuagcgacaucgcuauaaccgaaagaggaaagaacauaagagacccucaacuccaaaacgcucuauacguagccacaaaaggcaaggaagggaaaauguucgaacaggcucuagucgacuucgccucgaaagaaggccccuaccaaggaauacgacgcguacgacuuguagaaacacuacagaaagcagcuagaguggaaaucgguaaaacagaaaguggacaaccacuaaaagccuacaaaggagacagcaaccacuguuacgagcuauggaaacugccagacggcaaaauaguaccccaaguagugaccaccuacgaagcccacgcaggcuccgcaccgagaccccauccagccgcgaaaagaauacucagaguuuucaagaaagacaugguaaaacucacuaaagacggcgaggaaaucgucggcuacguacaaagcaugcauaucaaaaacggacucuucguugcucaacaccucgaagcaaacgccgacgcccguaaucgggacaaaaccgacccauucaaguuccuacaaaugggagcagggacacugguaaaaacaggacuuagacgcguccucguagacgaaaucggacggcuaagagaccccggacccccgaaacuuuga

SEQ ID NO: 6170 - RNA, 3225 nt, Artificial Sequence
  Cas9 variant
augcagaccaaaaaucucccauacacacuuggccuagacauaggcauggcgagcgugggcgcagcgcugcuccucccagaccaagaaagaauacucgcccuucauguaagaacauucgacaaagccgaaaccgcgaaagagggagagagcuuaaacaagaucagacgagacagcaggcucacucggaggcgaauccgccgccgagcacaccgucucguccgccuggcaagacuaaugaaacgcguaggacugauagccgaugcaaaccccgaagccuucgcccuacccggagucagccccuggcaccuccgagccgacggacuugaccgacuucuagaaccaaaagaaugggcuggcguacuauaucaccucguaaagcaucgaggcuuccaauccaaccgaaagucugaagccaaagcagacgaaaaagcaggacagaugcuuucaggcguaggacggaaccaagcacuccugaaagaagcaggauaccggaccgugggggaacucgccgcgcgccacgaagacuucaaagaagcgaaacgaaauaaagguggaucauacagccauaccuucgcacgggccgaccuaaacgccgaacugaaccuacuauucgaacgccaacgcgcgcugggcagcagauuagccucagccgacuuccaagaaaacgugcgagaccuccuuauggcgcgacgccccacccuaucaggggcaaaccuacucaaaauggugggcaaaugcaccuucgaaaaaucagaagaucgggccccaaaggcaggauaccgggccgaacgcuucgucuggcucgggaagcugaauaaccucaaaaucguaggauccggcgacgcaagaccccuuaccgacgcagaacaucgaaucgucaucgaccugccguucacacaagcaaaacucacauucaaacagguaagaaaagcauuagaacuagaaacccaccaaagauucaaucugcugagcuacaggccugacccaaaaggcaaagacaaagauccugaggaaucaacauucuuugaggccaagagcuuccacacccuaagaaaagcguacgagggagcaggccuaaagaaagaauggcaacgagacgcgcucgacccagaccgacuagacgcgcuagccuaugcauuaacaugcuacaaagacgacaccgaaucgcgacaauggcugguagcacaaggaauaggcacacccauaaucgaagcuguccuggcugagagcuucgacaaauucauccaccuaagccagaaagcacugaaagcgauacugccacacauggaagcaggccagcgcuacgacgacgcugcuaaauccgccggcuacgaccacucccaaccggacgcaggcaccggaaaacgagcgacccuaccuccaccugacaaagacacgauacgaaacccaguugucuaccgcgcguuaaaccaagcaagaaaacucguaaacgccauagucgccgaauacggaccaccggccgcagugcacauagaacuagcgcgcgaccugucgaaaccaauagaugaacgucgagauaucgaaaaaggccaaaaagaguuccaagcgcuuaaggaaaagcucgcugccgcauucgaagaaacauuccaccgcaaaccaagcggauuagaucuacucaaauacagacucuuccgagaacaacuagaccaaugcccguacugccaaaaggcccuaguaguagaccgccuauuugaacccggcuaugcccaaaucgaccacgcacuccccuacucccguucauucgacgacggaaugaauaacaaagucgugguccauguagcaugcaaccaagacaaaggcaaucgcacaccauaugaguuccuggacggagcaggcgacucagaacgguggcagcgcuucgucgcauggguacaaggaaacaaagccauacgacaagccaaacgaaaccgccuacugcggguaaacuucggcacugaugaagcgaaagaguucuccaaacguaauuuaagcgacacccgauauaucugucgagaguucaaaaggaccauagaaacccaauucgccuggcacuccgaugcggaagguaacgaacgcugcgucgugcucucaggccagcuaaccucucuauuacgagcaagguggggacucauaaaaguacgcgaagacggagaccuccaucacgcacuagacguugcuguuauugcagcggccagccggagcuugguaaagcgaauggccgacuacucccgaaggaaugaacucgaaaugguaaggaaccgcuacguagacccagcuaccggagaagucgucgacgucgccgcacuuagacagaucgaagaccacuucccgaaaccuuggccccucuuccgcgaagaacugcuagcgcgccuggccccugaaccgaaacuccaacugacgugcgucucaagcuacgaugagggacuacgugagaguauucguccaauccgugucucacgagccccgacacguagaggacuaggagcugcccaucaagaaaccauacgaucccucagggacggaucccagucagcaaucaaaacaccccuaagagaucucaaccucaaagaccuagaaaacauaguaggguucgaaagagacacugcgcuaaucgacgcaauccgaacccgacucgaggcauucggaggcgaaggaaagaaagcauuugacgacaaacaaccgccgcuacggaaacccagcaaagacccagacaaagcuccaaucaucagauccgucaaacuccuagucacacaaaagucagggaucccaauccgcggcggaauagcaaacaacggagcaaugcuacgaagcgacaucuucacgaaagccggaaaauucuaugcaguaccgauauauguagcagacgcagugagaggcgaacuaccccacagagccguagcacaagcgaagcccgaauuagaauggccaaugauggacgagucguaccaguuucuguucucacuacauccaaacgacuggaugacgaucagacuuaagaacgaggucagggaagguuacuacgccggacucgaccgcgccaccggaaacaucagccuguggcugcacgaccgaaaccaaaacgucggccaaaaaggccuccugaccggaaacgguaucaaaacagcccuagcaguagaaaaauaccacgucgaucuacucggcaaacugcaccgcguacauaaagaggaacgacagccgauacacaucaagccagggaagcgcuga

SEQ ID NO: 6171 - RNA, 3234 nt, Artificial Sequence
  Cas9 variant
augaaauacagcaucggacuagacaucgguaucgcgagcgugggcugggccguaauaaaugaagacaucgaacgaaucgaggaccucggagucagaauauucgacguagcggaacaaccgaaaacaggcgcuucccuaaguaccccgcggagacuagccagauccacacgaaaacgccuacgccggcgacgccaccgcgucgagcgaguccgcaaauucaugauccagaaaggacugcugacacagguacagauggaacaacuauacgacuggaaggacggagaccuagacauauggcuuguacgcgucaaugcccucgagcgcaaacuaagcgacagagaauuugcaaggauacuuguacacuuugccaagaacaggggguuccaaucuaaccgcaaguccgaacuccaagaagaagacaacggagccguccugagcgcuguccaggaaaacaagcggcuaauggaggaaaagggauaccaaacaaucucagaaaugcuauuguaugacgaaaaauucgagggcaccaaacgcaauaaaggcggcgaguacacucaugugguagccaggucugaccuaaagcgggaaauccaacucaucuucgaaaaacaacgcgccuauggccacgccuuugccacaauggagaaugaagacaaauuccuccaaaucuggucgucacaacgacccuucgcgaccaaagacgacauagccaagaaaauaggcaacugcaccuucgaacccaaagagaaacgcgccccaaagagcaccuacaccuucgaacgcuuccgcgcacuagacaaacucaaccggcugaggauucuauccggcaccagucccgcccgcucccucacacaagaagagagagaccucauauuaaacucacuguucagcaagaaagaaguaaaauacaaagaacuacgaaaacuccucaagcucaacgacgaacagcgauucaacgagaucuucuacgacccaaacgagaaaauugaaaagaacgaaaaccgaacguuccugagucuagagagccaguacaaaauccgcaaaauccuccagaaaauagagggcaagagccucaacgacacguacagaccggucgacuuagacacgaucgcauacgcccuaacaguauucaaggacgaccaagacauacgagauuaccuccaaaaccaauauguggcgucaaacgggaagaaagagcugaaccucgcaaaccggaaguacaacgacgaacucauagaggaacuccuccaucucucauucacgaaauuuggacaccucucgcuaaaagcgcuccgcaacauccuacccuucauggaacaaggcauccccuaccaccaagcgugcgaaaaggccggguaccaauucaacaagaaagucaaccgcgagaaacagaaacuacucccgcccguccccgccaaagacauugucaaucccguagugauacgaucacugagccaggucagaaagguaauaaacgggaucauaaagcgauacggcagccccagcagcaucuacaucgagcuggcgagggagaugggccguggguacaaggagagaaaagacuuagaaaaacaauacaacaaaaaccgccaaaugaacgagggcgcaaagaaacacauccuggagcuacgacccgaguucggcgacccaaggggccacgacauccucaaauacaaauuguggcaggaacaggacugcagaugcgccuacagcuucaaauccaucccaauuaagcaacuauucgagaucggauacgccgaaguagaccacaucauacccuacucuagguccuuugacgacagcaauaacaacaaaguccuuguacuagccgcagaaaaccaaaacaagcaaaaccgaacaccguacgaaugguucggacacgacgaaacaaaauggcaggaguucaccucgcuagucaccacaaugaaagucagcaaaaagaagaaaagccuccuacuaaagaaaaacuucgacgaagaacaggcagaagaguuccgcagcaggcaccugaacgacaccagauacauaacgagauacaucaaaacauuuaucgaagacaaccuacaauuccggaucgaagaaggcaagaaaaccuacguacacaccguaaacggcgccuacacaucccuaaugcggaaaagauggggauucaacaaaaaccgacaggagaacgcccuccaccacgcacuugaugccgugaucguggccguaucgcuaccauuuaaacacaaagugcgcgcauacuucaaacgaagagaagaauaugcccacaaccaacuuaaacgggagggcgaguucuuccccgaaccguggccaggcuucauccaugagcuagagauacggaugaugcaggauuccgagaauaucaaacuugcgauggaaucccucaaucuaaaaaccuacgacgaauccuucauaaaagagcucaaaccaauuuucgucucccggaugccgaaacgcgccaugaaaggacagauacacgaagaaacccugaaacgcgugcggggacgcacagacgacggauacauccgcacagucaaaaagguaaaacuagaucaaaucccauucgacaaaaacggcgacuucccgauguucggaaaagaaaccgauaugaaaacauacgaagccaucaaaucacgauaccucgaaucaggaaaagacaagaagaaagccuucaacaccccacuguauaaaccggccaaaaacccagagaacgcccccauuauccgauccauaaaaauagaagaaaaagcaaaccggguagucaugcucgacgagaaaacggcagcggacaacgcgucgaucguaagaacggaaguguucaggcacaaggaaaccggcaacuacuuccugacuccaguguacgucgccgacguccuagcgaagaaaguaccagaccgccuaaucaccacaaagaaaccguacagcgaauggcgcaaaauaacagacgaauacgaguuccuuuucucucuauaccccaacgaccuaaucaggguaaaaaugccaaaagaaaaagaaacgaaaacccacaccggcgaaaaacaugucuggcaggaaaacuucauguacuucaaaggugugcauagcgggagcgccggaguacgaaugauagaucacaugaacuccuucgaagacgaaaucggcguccgcaaacucgucguauucgaaaaguaccaaguggacccccuuggacgaaugaacaaagugcacggcgaaaagcgccacggcauauga

SEQ ID NO: 6172 - RNA, 3234 nt, Artificial Sequence
  Cas9 variant
augaaguacagcauuggacucgacaucggaaucgcgucgguaggaugggccguaaucaacgaagacauagaacgaauagaagaccucggagucagaaucuuugacgucgccgaacaaccgaaaacaggcgcuagccugagcacgcccaggcgacucgcccggagcaccagaaagagacuucgcaggcgacgacacagaguagaacgcguacgaaaguucaugauacagaaggggcuccuaacccaaguacaaauggaacagcuauaugauuggaaggacggagacuuggacauauggcucguacgcguuaacgcccucgaacgcaaacucagcgaccgagaguucgcgcgaauccuagugcacuucgccaaaaacagaggcuuccaaucaaaccgaaagagcgaacuccaagaagaagacaacggcgccguccucucggccguccaggaaaacaagcgccuaauggaagaaaaaggauaccaaacaauaucagaaaugcuacucuacgacgaaaaauucgaaggaacaaaacgaaacaaaggaggcgaauacacgcacgucguggcacgaucagaccucaaacgagagauacagcugauauucgaaaaacaaagagcguacggacacgccuucgcgaccauggagaacgaagacaaauuucugcagauauggagcagccaaagaccauucgcaacaaaagacgacaucgccaagaaaauaggaaacugcacauucgagccaaaggagaaacgggccccaaagagcaccuauacauucgaacgcuucagagcgcuugacaaacucaaccgacugagaaucuugaguggcaccucgccggcccguucacucacgcaagaggaaagggaccuuauccuaaauucacuauucuccaagaaagaggugaaguacaaagaacuccgaaaacuacugaaacucaacgaugaacagcgcuucaacgaaauuuucuacgaccccaaugaaaagaucgaaaagaacgagaaccgcacauuccuaagccuggaaucgcaauacaaaauccgcaaaauccuacagaaaaucgaaggcaaaucacuaaaugacaccuaccgaccggucgaucucgacaccauagcauacgcacuuaccguauucaaagacgaccaagacauccgagacuaccuccaaaaccaauauguagccagcaacggcaagaaagaacuuaaucuagccaaccgaaaauacaacgacgaacuaauagaggaacuccuccaccuauccuuuaccaaauucggacaccugucccugaaagcgcugcgcaacauacuuccguuuauggaacaaggaauccccuaccaccaagccugcgaaaaagccggcuaccaguucaauaagaaagucaaccgagagaaacaaaaacuguugcccccaguuccagccaaagacaucguaaaccccguagucauucgcucacucagucaaguaagaaaaguaauaaacggaauaauaaaacgcuacgggucgcccagcagcauuuauaucgaacucgcgcgcgaaaugggucgaggcuacaaggaacgcaaagaucuagaaaaacaguacaacaagaauagacagaugaacgaaggcgcgaagaaacacauccucgagcugaggccggaguucggcgauccgcgcgggcaugacauccucaaauacaaacuguggcaggaacaggacuguaggugcgccuacagcuucaagagcauaccaauaaaacaacucuucgaaauaggcuacgccgaaguggaccacaucauccccuacagccgauccuuugacgacagcaacaacaacaaggugcucguccuugcagcagagaaccaaaacaaacaaaaccgaacaccguacgaaugguucggacacgaugagacgaaauggcaggaguucaccagccuggucaccaccaugaaagucagcaaaaagaaaaagagccuccuccucaagaaaaacuucgacgaagaacaggcagaagaguuccgaucccggcaucucaaugacacacgauacauaacccgauacauaaaaacauucaucgaagauaaccugcaguuccgcauggaagaaggaaagaaacaauaugugcacaccgugaacggagcauacacgucacucaugcggaagagauggggauucaacaagaaccgacaggaaaaugaccugcaccacgcucucgacgcggucauagucgccgugagccucccguucaaacacaaagugagcgccuacuucaagcgccgagaagaauacgcgcacaaccaacucaaacgagaaggcgaguucuuucccgaaccauggcccgguuucauccacgaacuggaaauccgcaugaugcaagacagcgaaaauauaaaacuggccauggaaagucucaaccuaaaaacauacgacgagagcuucauaaaagaacuaaagccaaucuucgucagcagaaugccgaagagagcuaugcgcggccaaauccacgaagaaacacuaaaaaggguaagaggacgcaccgacgacggcuacauccgcaccgucaagaaggucaaacuggaccaaauacccuucgacaagaacggagacuuccccauguucggaaaggaaaccgacaugaagacauacgaagccaucaaaagcagguaucuggaaucagguaaagacaagaaaaaggccuucaacacaccgcuauacaaaccugccaaaaacccagaaaacgcaccaaucauccgguccauaaaaaucgaagagaaagcuaaccgugucguaauguuggacgaaaagacagcagcagacaacgcgucaaucguccgaacagaagucuuucgccauaaagaaaccggaaauuacuuccucacacccgucuacgucgcagacguguuagcuaagaaaguccccgacagauugaucacgacaaagaaacccuacuccgaauggcgaaaaauaacagacgaauacgaguuccuguuuucacucuacccaaacgaccucaucagagucaagaugcccaaagaaaaagggacaaagacucacacaggagaaaaacacguauggcaagaaaauuucauguacuucaagggcguccacucugggucagccggcgugagaaugauagaucacaugaacuccuucgaagacgaaauaggagugcgcaaacuugucgucuucgaaaaguaccaagucgacccacucgggcgaaugaacaaaguucacggcgagaaaagacacggaaucuga

SEQ ID NO: 6173 - RNA, 3234 nt, Artificial Sequence
  Cas9 variant
augcagcaaaaaccccaacgauacauccuggggcuggaccugggcauugccucggucggaugggcaugcguaugggccgaugaaaaugaacauccgacagggcugcuggacugcggcguccgcacguucgaacgagcggaaguacccaaaacaggcgacagccuagcacucgcacgaagacaagcgagaucaguaagacgccugauaagacgacgagcgcaccgccuccuacggcuaagaagauugcucaagagagaaggagugcuccuuagugcagacuucaacgaaaacggacucguucgaggacuaccaauagacgcaugggcacugaggguagcgggacuugacagaaaacucagcaacaaagaaugggccgcgguauuacuccaccuaguuaaacaccgcggguaccuaagucagagaaagaacgagacgcagagcaaggacaaagaacuaggccgucuccucgcagggguaaauggcaaccgagaagcacuucagaacagaucggacgaauacagaacagccgcagaacuagcgguaaagaaauucgccgcggaaaauaacgggagccugcgaaacaaagggggcgacuauucacacacguucgaccgaaaagaccuacaaagagagcuccaccuacucuuugaaagacaacgagcuuuagacaacccauucacauccucagaaauggaagccgccgucgacgagcuccucaugaagcagagaucagcacuacaaggggaagcgguccuaaagaugcucggucgcugcacauucgagcccagugaguacaaggccgccaaaaacacguacagcgcagaacgguucguauggcucacaaagcuaaauaaccugcgcauacaauacaacggagaggaacgagcccuaagcgaagcggagcggagacugcuacucgacgaaccauaccaaaaagcgaaacucacauacaaacaagugcgaaccauccuugaacuaccagagucggcgguuuucaaagggcucagauacgggcauggagaagacggauuaaaagcagaaagcggcacacucauggaaaugaaagcguaccacgccguccgcaaagcacucaaagacgcaggacuggaaggagagugggaaaaucggaucaggaacccagaacuacuagacgcgaucggcacagcguucagccuguacaaaacagacgaagacaucagagcgaaccuggccgcauuccgacuaagcgagaacguccucgaggcauuguuagcaggacuaaacuuugacaaguuuguccaucuaagccuaaaagcacuggccaagauacuaccccugauggaacaaggaaugagauaugacgaagcgugcaaggaagccuauggagaccacuacggcgcgaaagagcaagaggaccacaggcuccucccaccuuucguagcggacgauauaagaaacccaguaguauucagaacacuaacacaggcccgcaaaaucgucaacgaaauagugcgcagguacgggucaccgcuacgcguacacaucgaaacaggcagggaagugggaaaauccuuuagcgacagaaaagaaaucgaaaaacggcaagaagagaaucggaaagagcgagaaagagccgcagcccauuucaaagagcuauuucccaacuucgcgggggagccaaaggcacaggacauccucaagcucaggcuguacgaacaacaacacggaaaaugccuauacucaggaaaagagauagaccuacgacgacuaccggaaaaaggauacguagaaauagaccaugcccugccauucucaaggacaugggaugacagcuucaacaacaaaguacucguacucggaaaggaaaaccaagacaaaagaaacagaacaccauacgaauaccuggacggcaaaggaaacucaggcgcauggcgggcauucgccgaacgcgucucaggaugccgauucccauaugccaagaagcaacggcuacugacgcaaaaauuggacgagaaaacggaacaaggcuuccucgaacggaaccucaacgacacgagauacgucgcgagauuccuaugccaauucauagaggaaaagaugcaccucgaaggagcagggaagaagagaguuuucgcauccaauggacagauaaccgcacuacugagaggauucugggggcuaaagaaaguccgagaagaaaacgaucgccaccacgcgcuugacgcaguaguuguugccugcagcucagucagcaugcaacagaaaauuacgagacacuucagguacagggaagaacuggagcacaucgaccgagagaccggcgaagucauucacggauuuccacaaccgugggaauuuuuccgacaagaagucaugacacggguauucucggaugaccccgugagcgaacucgcggaaaagcuggacagccgacccgaagcgguucacgaauuugugacaccacucuucgucucccgcgcgccacacagaaaagucaccggacaaggccaccucgaaacaauccgaagugcaaaaagacuggacgagaaaauaagcgucgucaaacuccccuugacccaauuaaaaacaaaagacauagagcgaauagucggguaccccaaucgugaacccgccuuguacgacgcgcucgcggcacggcuagcagcguucaaagacgacccagccaaagcauucagcgagccauucuacaaaacaggaaaagacgggaaaugcggcguccuuguaaaagcuguccgaguagaaaacguccaaaaauccggccuccuggugagaaaagaugaaucgggaaaaaugcaaggcguggcagacaacgcaacgaugguaaggguagacguguucggaaagaacgggaaaaauuacuuagugccagucuacgcauggcaggucgagaaaggagaacugccuaacagagcaguggucgcauacgcggacgaggaagacugggaugagauggacgacuccuucgaguucaaauucagccucuacccgaacgaucuggucgaaguugugaccaaaaaggacaaguucuucggauauuacagcggcuucaaccgagccacaggggcaaucaacaucaaggaacacgaccuaagcaagagcaaagucaaaaacggaguauaugaagggaucggcgucaaaacagcacaguccuuccaaaaguaccaaguagacacccuggggaagacgauccgacucugcaaaccagaaaagcgaaugggguucaagaagaaauga

SEQ ID NO: 6174 - RNA, 3237 nt, Artificial Sequence
  Cas9 variant
augcgauacguccuaggccucgacaucggaaucgcaagcugcggaugggccguuauaaaccaagagaaagaacguaucgaagaccugggugucagaauauucgauaaagcagaaaaccccaaagacggcaaaucacucgccgcgccacgacgggacgcccgcucaacccggagaacgcuccgccgcaagaaacaccgaaugcaacgaaucaaaguacuacucgucaaacacggauuacuguccaaaacagaacucgaccaccuauacgaaagcgccaccgaaguggacguauggaaccuccgccucgacgcacucgaacggaaauuauaccccaaggaguucgcucgaauccuaauacaccucgcaaaacgcagaggcuucaagagcaaccgaaaagaaacaacgcuuagcgaaaauggccaaauccucgaauccaucucagaaaaccaacagaucauggaaaaacaaaauuaccgcaccgugggcgaaaugauccuaaaggacaagaaguuugagaaccauaagcgcaacaaaaacggaacauacgucggaaccgucacucgccaacaacugcaagaugaaauccaaaugauauuucacgcacaacgccuauauaaaaacgauuacgccacugaggaguucgaaagcagcuaccuggaaauaugggcaucucaacgccccuacgcaagcaaggaccagauagagaagaugaucggcuauugcacgcuagaaccaaaagaaaaacgcgcccccaaggcguccugguccuuccaauacuucgucgcacuccagacgaucaauaaccuccgccugauuagcaaggaccgcaucgaagaacugucauuugaggaaaagaaacaaaucaugaaccuagcccuugagaaaaguauagugaaauacauagacauacgaaaacugcuaucagucccuaacgaguuccaauucaacagccuaucuuacucagcagauacagucgacacagccgucgaaucccgaaagugcaucgaacucaaagaauaccauagcauaaacaaggucuacaagcaaauauacggcgaaaacgcgcucaaccuccucccaaaauacuacgacaccaucgcguacgggcuaaccaucuucaaggacgacaaggacauccucgaauaccuacaaaacaaguacgugaacgcuaaagggaaacccaucuccaacuucgcaaacaaaacuuacgacgacacguucauccaagcccuucuuaaccucaacuucacgaaaaugggacaccugagcuucaaagcccugaaaaacaucaucccauuccucgaagaaggccucucguacgacaaagccugugaaaaggcaggauacaacuucaaagggacguccuauacggaacaaacaaaauaccuacccguuaucccacaaaacaccaaccccguaguccaccgagcgcucagccaaacccgcaaagugaucaacgcaauaaucaagaaauacggaucccccaacgcgauccacaucgagacagcccgggaacuaucaaaaacauuccaagaaaggaaagagauagacagcauguaccaagacaacagcaagaagaacgaacacgcaauccacaaacucaaagagcuaggaaacauuaaccccagcggaaucaacaucgucaaauuuaagcucuggaacgagcaggacggccgcugcauguacucgggaaaauacaucgaaccacaccgacuuuucgaagagggauacaccgaggucgaccacauacuacccuacucacgaagccucgacgacuccuauaauaacaagacauuaacauugggaacagaaaaucaacgcaaaggaaacaagauaccuuacgaauauaugggaaacacgucaauauggaacgacuucgaaacgcgcguccagagcaauaagaaaaucaacaaaaagaaacaacaaaaacuacuacuccagcacuucagcuacgcccgagaacaagaguucauagaacgcaaccugaacgacacccgcuacgcgacaaucuaccuuucaucucuaauucaacaacaucucaucuucagcgagucgucucgcaaaaagaaagugcauacggucuccggaaucaucaccucacaccuacgaucacgauggggcuucaacaaagaccgcaaagaaggucacauccaucaugcccucgacgccgucaucguagccgugaccuccgaccacaugauccaacgcgugacaaaauacuacaaacucaaagaacuaaaccgcaaccuacaagcuaaacguaugcccuuuccagaacccugggagggcuuccgccucgaacucgaagcccgaaucucccccaacacccagcaauaccucaaaggccuucgcuucaaaaacuacgcagacgucaaccuguccgaaaucaaaaguaucuucgucucucggaugccaaagcacucaaucaccggggaacuacaucaggaaaccauucgcaaauuuauugguuacaacgaaaaaggcaaaguccugacagccauuaaaacaaaacuagaagacaucccauucgacgccaacggggacuuccccauguacggaaaagaauccgaccuauacaccuauaacgccaucaaagaaagauaccucucacacaagaaagacaaacgcaaguccuuccaggaaccacucuacaaacccaccaagaguggaggcauagggccccucauaaaaagcaucaagauaauggacacaaggaccaucguuaacccgguaaaccagggcaaaggcguagucuacaacaguaagauagcacgaaccgacguauucaagaaagaagaaaaauacuaccugaucccgauauacaccaucgaucucaugaaaaauauacugccccaaaaagccaucacagccggcaaaggcuacgaagacuggacaacaauagaucccucguucaccuuccucuucuccuuauuccccaacgaucuaauccagauugugccgaguaaaaacaagaccauaaaggcacgaaccacaguaucgaagaaagaaguacuccugcccagccucaccggcuauuucaaaggcguccacuccggaaccgcgggcauaaccgucgagacacacgacggcuccguaaucgccaacgucggcucaaaacaacuucuucucauagaaaaauaccaagucgacguccucgguaacuacaccaaaaucaaagaggagaaaagaaucggacuaacgacauauaacgauaacaagaaaauagccgcaugcuga

SEQ ID NO: 6175 - RNA, 3237 nt, Artificial Sequence
  Cas9 variant
augaaacaacagccgcaacgauacauacugggccuggaccuaggaaucgcaagcguaggaugggcccuaauccuaguagacgaagaaggcaauccgaucggacuccuugacugcggcguccgcacauucgaacgcgccgaagugcccaaaaccggcgacucacucgccuuagcacgcaggcaagcacgaagcgucaggcggcucauaagacgacgcgcccaccgacuccugagacugcgacgacuccugaaaagagagggaguccuuagcgccgccgauuuuaacucagauggguuacccaaccuccccaucgacaccuggcaacuaaggguggcaggccuggaacgaaaauuaaccaaccaagagugggcagcaguucuacuacaccucgucaaacacagaggauaccugucccaaaggaaaagcgagacacaaaccgaaaacaaagaacucggaugccuccuagcaucgguagcgaaaaacuccaaacucuuaagcgagaacgcaaaccaauacagaaccccggccgagcuugcaguccgccucuucgcugaacaaagcgggcacuuacgcaauaagggcggagacuacacacacacguucaaccgucucgaccuccaaaaggaacuccaccuccuauucgaacaacaacggacauucgggaaccccuucgcaagcgccgaacuccaauccaaagucgacggucuccugaugaugcagcgaagcgcccuccaaggcgaagccgugcucaagaugcugggaaagugcacauucgaaccaagcgaauacaaagccgcgaagcacaccuacucagccgaacgcuucaucuggcugaccaaacucaacaaucuccgcauccucgagaacggaacagaacgagcacuaaacgaggcagagcggaaacuccuccucgacgaaccauacaaaaaggcaaaguuaaccuacagccaagcccgaaaacugcuggauaugucgcacgacgcaacauuuaagggccuacgauacggaaaagacucggaagggcucaacgcggaaaauggagcacugauggagaugaaggcuuaccacaagaucagaacgguccuagacaaggccgggcuaaagggugaaugggaaaacaggauccgaaacccggaaauccucgauaagauaggcacagccuucucccucuacaagaccgacgaagacauccaagcugcgcucgcagaccuccggcuaccagaaaacguccuaaacgcccuacucgcaggccuaaacuucgacaaauuuauccaacucagccuaaaggcccugagcaacauuaugccacugauggaacgcgguauaagguacgacgaagccugcaaagaaguauacggagaccaccgcgcgcucgcagaaucaaagaaccaaaugcuacucccgcccauaccugccaacgaaauaaggaauccugucguccuacgaaccuuaacacaaacacgcaaagucauaaacgccaucauccgucgcuacggaagcccacaacgcguacacauugaaacagcccgcgaacugggaaaguccuucaaagaccgcaaagaaaucgaaaaacgccaggaggaaaaccgaaaagaacgagaaagagccgccgagcacuucaaagagcuauucccacauuucgcaggagagcccaaaggaggagauauacugaaacugcgacucuacgaacagcaacaaggcaaaugccuauacucaucaaucccgaucgaccuagggcgacuaaacgaaaaaggguacguagaaaucgaccacgcccuacccuucagccgcaccugggacgacucauucaacaacaaaguccuaguccucggaucagaaaaccaaaagaagcgcaaccaaaccccauacgaauaccuagacggcgccagcaauucccaacguuggcgagaguuccaagcccgccuacaaggcugcagauuuagcuacgccaagaaacaacgaauacaaacagcaaaacuagacucaaagaccgaacaaggcuuuuuagaacgaaaccucaacgacacacgguacaucgcaagguuccucugcggcuucauagaagaaaaucuacaccuucagggagaaggcaaacgaaggguauucgcauccaacggccaaaucacagcacuucuccgcggcuuguggggccucaagaaaguacgcgaggaaaacgaccgacaccacgcccuagacgcaauagucguagcuugcagcacagugucaaugcaacagaaaauaacaaaagcgaugcaacgacgcgaaacauuagaaacgguagacaccgagacaggcgaaguaaaaacccguauaccccaaccgugggacuucuucaggcaagaagucaugaugcgcguauucagcgacacgccacacgaagaacuagccgaaaaauuaucaggaagacccgaggcacuccacgacuucgucagcccccucuucgugucacgagcccccaaucgcaaaaugacgggacaaggacacuuagaaacagugaaaagcgcaaaacgccuguccgaaaacauaagcgugguccggaaaccacuaacugcccuaaaacuuaaggacauagaaaacauagucggcuacccagacagggagcccgcacucuaccaagcgcucagggaaagacuacaggccuacaaagaugacccgguaaaagccuucgcagaaccguucuacaaaccagcgaagaacggaggccaagggagccucguaaaagccguucguguaaaggacguccagaagacaggagucaugguccggaaggaccgcggaggcauagccaggggaauagcagacaacgccacgaugguacgaguagacguauucgguaagaaaggcaaaaacuaccuaguaccgguauacgcuuggcaaguagcaaaaggcauccuaccgaaccgagcaguaguggcauacgccgacgaagcagacugggacgagauggacgacucauacgaguuuaaauucacccucuauccgaacgaucucgucgagauaaucagcaagaaagggcgaaucuucggauacuacucgggccucaaucgggcaaccggagcaaucgacaucaaagaacacgaccuaagcaaagagaaagccaaaaauggcauucaccaaagcgucggcgucaagacaguacugagcuuccaaaaguaccaaguagauccccuaggaaaagaaauaugcuuaugcaaaguagagaaacacccagaacugaacagcaaaaagaagaaauga

SEQ ID NO: 6176 - RNA, 3237 nt, Artificial Sequence
  Cas9 variant
augggauaccucaucggccucgacauaggcauaacaagugucggcuacgccgugcuccaaaccgauuucaaaggaaacccauauaaaauucuucugaugaacaccgucaucuuccccguagccgaagcgccaaaaacaggcgagagccuugccgcacccguccgccaaaaacgcagcagccgacggacaaaccgacgaacuaaauuccguaaauuacgaguacagaaacuuuucguccgcuucggucuacucgaauccgcagacgucgccacuuuccuuaaucaaaaaguaccucaucaagacauauggcaacuccggaaggacgcacuaaaccguaagcugagcaaccgagaacucuucgaaauccuuuacuucuucgucggccacagaggcuucaaaagcaaccgacggucggaaguaaccggcaaacaaccgaaggacaaccaggugguccuuaccagcauccacgaccgaggaaacacccucaacgacuucgacucccuaggcgaaaugaugcaagaacuacccgaauuuaagaccaucaaacauaacaaggccuaccgacccgacaauacaaucuacccccuucgcgcauggaucgaacacgaacucagugccauauucuccguccaacagaaaaacaaccgccaaaucaccgacaacuucauuacacaauaccuagacaucuuccgcucacaacgagacuucgaccaaggcccugccgccccuucgagguucggcggcaacaugaucgagcgcaugguaggcccugacucccuagacgcucaugagaagcgcgccgccaaacucaccaacacguucuuccgcuucaacuuccuauccacacucaauaaccugaagauccaacuuacacucggugccgaguuccacccacucacuaccccacaacgcgaaaucguccuccaagcggcaacccuaaaaucccucaacuacaaacaaauucgacacaaacuccaacuccccgacucagcccgcuucaaucuaguacccuaccaaucaaacgaagaccccaucaaaaccgaaaguaaacacuaccuauucaaacgcaaagcccucacccaaaucgaagcggucaccgauaacccccagcucaucgacaagauaggcacaauccuggcauacuucaaaggagacaaaacccggcaagaaaaacuaucggcucucaaucuaagccgagcagaaaucaagcaacuucuccccaucaaucaacccggcuucggcaaucucucacuaaaaacuaugcacaaaauccuacccuaccuagaacaaggccaccucuaccacgaagcagcccaacuugccggauacgacuuucaaaacaaccuuguugaccgacaauaccuucgcgacaaccucaaaaacccagugguuaaucgcgccaucggcaaaaccaucaaagucgucaaugcaauuauuaagaaauacggagacccggacgcaauucacaucgaauuaacccgcgaaauaaagcacucucaugaggaacgccagaaaauugcccgccaaaugaacacuaacauggaccaaaacgacaaaguagcagaacaucuacgcgaaaacggcaucccagucaacggacaaaacaucauaaaauccaaacucuucuacgagcaaaaagggauagaucucuacuccggccagcaaauaaacgagcaggaucuauacacggaagaccacuaccaagucgaccacaucauacccuacucaaucagcuucaacgacucuuucaccaacaaaaccguuacccgaacuagcaacaaccagaacaaggcuaaucggcucccacucgaguaccucucagaagagaaacaggaugcuuuccgcgcccgagucaugucgaauauauccaacuaccgcaagcgacaaaauuuacugaaagaaggaaucaccgaagacaaccgccaacaguggaaaacgcgcaacaucaacgacaccggauacauuaaccggcuccucucacaauaccuacgcaacaacguccaauucaccaagaaaagccacaaccccgucuucaccguaaacggggcgacuacagccuacauacgcaaacguuacggcaucauuaaaaaccgccaagccaccgaccugcaccacgccguagacgcagucauaauaggcuguaucuccaacacauucgucucccgacuggccaaauacagcgaagcgcaagaggcacgguaccauaaacaacucuggcaaauaacacaauaccgccaggaacacaaagaccuauccacaaucgaauaccaagaacugauaaaacaauuuccccugccauggcccgacuucagacacgaacucauggcacgccuaaguaccgacccagccaaaaugauggcccaccacaccugggaacauuacaccgacgaagaaauaagccagcucaagccggcguucgucaucagauccgccaaccacaaagucaccggcucugcacacgacgacaccauuuacucuaagaaacuauacgaccagcguggcguaggacuccuccgcaccucccuccaaaacuugaaauaugauuccaagaaagacgggaucaaaaacuacgaacggcucaaagacggaucuaacucgcucgucuacgauucccuccuccgcgccuugaaagaacaugacggcaacgccaagaaagccuucccggacaaccaacuacuuauaagcacggguaaccaccaacaaauaaucacacacgucaaaacagucaaaaagaucacccaucccaucgaagucaaccgcgacaccgccauagcuauaggcggucguaugauccgcguugacaucuucaaacaagcuaaggcacaaaaacucaucgggauccccgucuacgugaaugacaccgucaagcccacucucccaaaucgcgcuugcacgagcggcaaaagauacuccgauugguaucagcuaacccgccaagaccaauuucuaugcucacucgucucaaacgaccucgugcuaguagaaaccgcaucgccucucaaagucacaaacaacaucacaaacgaagaaguccaaaccacacaacuccucugcuacuucucgucauucaauauugcaaacgcacaaauuaacuuccacuccauaaacaacgacucaucaaucaaccccauaguccuaaacaaagucacguaucucacaaaauaccaauuggacuaccucggaaacuacuucccagucaagcacgagucacgcaaaaccuuuaaucgaaaacgauga

SEQ ID NO: 6177 - RNA, 3237 nt, Artificial Sequence
  Cas9 variant
augcacacccgccucgcacucgacauaggcacaaccuccauaggcuggauccuauacgagcuaguaaacggacaacccgccucgauccucgacggagguacccgcaucuucuccgacggccgagaagcaaagacaggccacucccuggccgucggucgaagaacagcccgaggcaugcggagacgacgcgaccgcuaucuacggaggcgggcagcacucaugaaaagacuagcagccaucggacuaaugccugaaucacccgaagcagcggcgcaacuagcaacccuagacccauacgaacuccgcgcgcgaggacuagaccacccacucccucccgaacaucucggacgagcucuguuccaccucaaccagcgcaggggauucaaaagcaaucggaggaccgacaaagguaacaaugaaggcggcaugauagcagacgcauccgcaagauuagaacaggcaaugauggcggcaggcgcacgcagcuacggcgaguuccuccacaaaagacgagcugaagcaaccgcacccagagcaacccccgcuguccgcacaagaauaaacccgcaccuuaccggagaagacggcaaagaacaaccgggauacgacuucuacccggaucgcaaacaccuggaagacgaguuccacagacucugggaagcacaagccaggcacaauccagaccuaaccccagcaaugggagaccugcuauuccaaacaaucuuucaucaacgaccccuaaaggcucccgcggucggccgaugucucuuucuggacgaaccacgucuacccaaggcccacccauuaacccaacaaaggacacuauacgaaacaguaaacaugcuccgaaucgcgccaccaggccaacccaaaagacgccucucacgcgugcaacgcgaccagauagugcacgcacucaacaaucgaaaaauccuagccuccccagguaaaaauguacuaacauuagccgcgaucggaaaacuccugaagcuaagaccaggagaagccuuuagccucgauacagcuaaccgagacgccaucgcaugcgaccccguccgaaugucucuagccuacgaaggaagauucggaccucaauggagcgcauuguccguggaaagccagugggaacuaauacagcgacuaagagaugaccaggacggggccgcacuuguagacuggaucauggaccgguacggcuucgacagagaccgggcccgcgccauagcagacgcaccacugccagaaggauucggaaggcucggggaaacggcaaccagagcaguccucgcuguccugaucggcggcaccacagaacaagaaguccuaaccuacucagaagcagucgccgcuugcgggugggaccacucacgucucgggacgggcgaagugcuugacaggcugcccuacuacggccaaguccuagacagacacguccuccccgggaccgggagacccgaagacgacgaaauaaccagguucggcagaaucaccaauccaacaguacacauaggccuaggccaagucaaacgccuaguaaacaaagucauagacgcaugggguagaccacacgagauggugguagaacuagccagagaccuaaaaaugagcgaggaucagaaacgcaaccucgcaaagguaaacgcacaaaaccaacgcgccgcagaaaugagaagcgcaaaacuaauaggagaccugaaaauagaagacaauggacgaaacagaggcauccugagaguaugggaggaauccgcagccgacguacuccauagaugcugcccauacacaggggcacaaaucucugcaagcaugcuauucgacggaagcugcgacauugaccacauacuacccuacagcagaacccuagaugacggauuuaacaauagagucauaugccugaaaagcgccaaucgagagaaacgcaaccuaacaccaugggaagccuggggaaacacaccaaagugggcugcaauagaagcaaaccucaaaaaccugccgcccgcaaaagccuggcgcuucgccccggacgcaauguuacgauaugaaggggaacgggauuuuacagcccgagccuugguugauacccaauaccucagccgacucgcuagagaauaccucgagugucucuacgccgaagacauagacccuggaccgcacucgggaaagaaaccaagacggccaauaugggucguaaccggaaaacuaacagagcuacugcgcagacacuggggacuaaacagccuacuucccgacgcccaccgaggaaccgcuaaagccaaaaaucgcuuagaccacagacaccacaugauagacgcagcaguagugggcgccaccgaccacgcgaccgugcaacgcauagcuaacauggcgaaagggaacgucgaaaacggacucgaagacuuagccggcacaauacuaccaccguggcccggccuacgggacgaccuaaaagcgcgacucgaaaggacaaucguuucacacagaggaaaucacggcgcaauagacccggcagcccggaagcaaggacgcgacacaaccagcggucaguuacauaacgacaccgcauauggacucacgggggaaacccuaaaaggcguaccucucgucgugaaucgcaaaccaaucgacauguugaccccggcaaugauagacaagaucagggauccgcaucuaagccgauggcucacagcggucacgaaaggcaaagaagggaaggacuuuaaagcggccguagaagcauuccgugcccacccaggaccauauagaggaauaagacggguccgccuaauagagccgguagaagugauaagaauaaaagaccggaacggaagaccauacaagggcuacaaaggggacagcaaccaaugcuacgaaguauggugccuaccagaccgcacccugacacaccacgucguaaguacauucgcagcccaccagggccaaacagggaagccccacccagcugccaagcgccuugcacgacuauacaaaggcgacaugguaagacuagaccgcagcaaauucggcagcgucaucgcaacagucgaaaaauuugaucgaaacgggcagcuagagcuagucccccauaacgaaggaaaugcagaccaaagauacagaaaggacaaauccgacagcguauucauccgacuacgcgcggccaccuucauagccuccggagcacgccggguaaucguagacgaaaugggaagaauccgcgacccaggcccaggaaaacacuga

SEQ ID NO: 6178 - RNA, 3240 nt, Artificial Sequence
  Cas9 variant
augaaauauggaauuggacuagacugcggaauaaacucagugggcuacugcaucauggaacucaacucagacgacgaacccaaaaggaucguucgacuuaacagucgcauuuucaccgaagcagagaaccccaaagacggcuccucacuagccgccccucgccgcgaggccagaggacuccgacggcgaauacgccggcacaagcaccgccuagaacgcauccgagcccuacucguacgcgaaaacauagucacucaggccgaacuagacaacauguucuccggcacucuaagcgacaucuacgaacuccgcaccgcggcacuagacgcaccccucaacaacaucgaguucgcccgaguccuaauaaaccuagcccagcgaagaggauucaaauccaacagaaaaagugagaaaaguagcuccgacaaggaaacgggaaagcuacucucugcgauuaagaaaaacaaggaauccaucgaagccggcggcuaccgaaccgucggagaaaugcuguucaaagacgaaagauacgccaaacacaaacgaaacaaaggcgaagcguaccucaacacaguaucccgagauaugaucgaagccgaaauccacgcggucuucgcaucacagcguaacuucggaaugcccuucgccaacgaaaagauagaaaacgaauacaccgacaucgcacucucucaacggccauucgaccucggccccggugaaggcccagaaaacugcaaaucccccuacgccgggaaacaaaucaaaaacaugauuggacagugcacauucuucccagaagaaaagagagccgucaaagccuccuacucauuccaacucuucagccuguuacaagguaucaauaacauaacccuggucucaucugacggcaacacauucccccucucgcaggaacaacgaaaaacacucaaagacuacugcuucaaaacagccaacgucacauacgcaagcauccggaaaguccuccagaucccacaggaauacaccuucaaaaacauaaccuacaccgacgauggcaucgaaaaaucggagaaaaagacaaaguuccaacaccugaagccauaccacgaaaugaaaaaggugcuaggcagcgcgauccaaacccugacgccagaggaacucgacgagauaggcgaaauuuucacuuucuacaaagacgaaacgauaaucaucaaacaacucgaagagaccgagaucgacaaaagccuguacgacuuacugcugcagcuaccaacauucgagaaagcaggccacauaucaacaaaggccugcaaaaugauaauucccuuccucgaagaaggcaaaaccuacgacaaagccugugaaugcgcaggacugaacuucaaagcacacacgaacaugcagaaacagaugcuuuugccagccaaaucugacgagcugaacgacgucguaaacccaguagugcgacgcgcgaucucacaaaccaucaaagucgucaacgcaaucaucagggaaaugggaaccucgccaacguauauaaacaucgaacuggcccgagaacucagcaaaagcaagaaagaaagggaugagauaaacaaaaaguacaaacucaaccaggcggaaaacgagcggcucaagaaugaaaucaucgacaauuucaaaauuaaaccaaacgggcaggacaucaucaaacucaagcuauggcacgagcaagacgacggcauaugcccauacaccggcgugagaaucaaguaugagaaccucuucgacgauggcuacgcggaaaucgaucauauaauacccuacucacucucauucgacgacucauucaacaacaagauacucacaacagccacccaaaaccgccaaaaaggaaaucgaauaccacuagaguaccuuccggagagcgagaaagacggcuuucgagucugggucaacucaaauauuaggaaccacaggaaacgacaaaaccuacuuaaagaacacuucacagaagcagacaagaaagaguucaaauccagaaaccucaacgacacccgcuaccuaaauaaacuccuacuaaacuacaucaaugacaaccuccuauucaccgacuucuacaacggcaagaagaaacacguaacauccgucaacggcgcaguaacggccuacauacgcaaacguuggggcauaaacaaaaaccgggaagacggcgaccugcaccacgccgucgacgcggccguuauagccugcgugacacaaggcauaaucaacagaauuacagcauacucagcaaggaaugaagcaccauacgaccuaaacaccgaaacgggggaaaucaaagaacgauucccucuccccuaccccaacuucaaaaaggaacuagacgcccguacuaccaucgaagacgagaaacgacuaaaacgcguacuaaugucauucagcaauuacagcuaugacgacgucgaaaaagccaaaccaugcuucguguccaggaccccgcaccguaaagucaccggagccgcacacgaagagaccauaagaaguggcaagguagagggcuucaccgucaguaaaaccgaacucacgaaacucaaacuaacaaauggcgaaaucgaaggauacuaugaacccgaaucagacacgcuacucuacaacgcauuacuccaacgccuaaacgaguuuggcggagacgcgaaagccgccuucgccgacgaguuccauaaaccaaaagccgacggaacccccggaccagucgugaagaaagucaaaaccaucaaaagauccagcuccaacgucaaggcacgcaacaaaaacggacucggggucgcugacaauggcucaaugauacgaauagacgucuucuacguugaaaacgagggcuacuacuucguccccaucuacguggcagacacggucaaggagaugccgaacgaagcaugcccguucggcaaagacaagaagaagaucaugaccgacgacgacuuccucuucucacuuuacccgaacgaccucauuaaaaucaccgccaagaaagacaugaaauucuccuuagccaacaaagagagcgggcucccgaaaaacaaauacgcaaaugaaguacugguauacuacagcgcugccgacauaucgaacgcgagcauuucaguaaucaugcacgacaacgcuuacaaguucagagguugcggaaucaaaucccuagugaaacuggaaaaauacacggucgacccccucggcaacgucucgaaagucaaccgagaaaagcggauguacuucaaauga

SEQ ID NO: 6179 - RNA, 3240 nt, Artificial Sequence
  Cas9 variant
augcgccuaggacuagauauaggaaccucgaguaucggcugguggcuauacgagaccgauggcgccggaucggacgcacgcaucaccggcgucguggacggaggcgugcgcauauucagcgacggccgagaccccaaaucaggcgcaucccuagcgguagacagacgcgcagccagagcaaugcgaagaagacgagaccguuaccucaggcgcagagcaacccucaugaaaguacuagccgaaaccggccugaugcccgcagacccggcagaagccaaagcgcuagaagcccuagacccguuugcucuaagggccgccggucuagacgagccacuaccccuaccccacuuaggcagagcccucuuucaccucaaccaacgacgaggauucaaaucaaaccggaaaacugacagaggcgacaacgagaguggaaaaaucaaagacgccaccgcaagauuagauauggaaaugauggcuaacggcgcacgaacauacggagaguuccuacauaaacggcgccaaaaggccaccgacccgaggcacguuccaagcgugagaacucgacucucaaucgcaaacagaggcggccccgacggcaaagaagaagccggguacgauuucuacccagaucgacgucaccucgaagaagaauuucacaaacucugggccgcgcagggcgcccaccacccggaacucaccgaaacccucagagacuuauuauucgagaaaauauucuuccaaagaccccuaaaagaacccgaggugggccuaugccuauucuccggacaccacggaguaccaccgaaagacccgcggcuaccaaaagcacaccccuuaacgcaacggcgaguccuauacgagaccgucaaccagcuacgcgucaccgcggacgggcgagaagcucgcccccucacccgagaagaacgagaccaagucauacacgcccuggacaacaagaaacccacgaaaagucucucgucgaugguauuaaaacuccccgcucucgcaaaaguguuaaagcuaagagacggagaacguuucacgcucgaaacuggugucagggacgcaaucgcaugcgaccccuuaagagcuuccccagcacaccccgaucgcuucggaccccgauggucaauacuugacgcagacgcccagugggaggucauaagcagaauccgacgcguacaaucagacgccgaacaugcagcccucguagacuggcucacagaagcgcacggucuugacagggcucacgccgaagcaaccgcacacgcaccccucccagacggauauggcagauuaggccucacagccacaacgaggauucucuaccagcuuaccgcagacguuguaaccuacgcugacgcuguaaaagccugcggcuggcaucacucggacgggcgaacaggagaaugcuucgaccgcuugccguauuacggagaaguccuagaacgacacguuauaccaggcucauaccaucccgaugacgacgacaucacccgauucgggcgcaucaccaauccgaccguccauauuggacucaaccaacuccgacggcuagucaacaggauuauagaaacacacggcaaaccacaccaaaucguaguagagcuugcgagggaucuaaagaaaagcgaggaacagaaaagagccgacauaaaaagaaucagagacaccaccgaggcagcgaagaaacgcucugaaaaacucgaagaacucgaaauugaagacaacggacgcaaccgaaugcuacuacgccugugggaggaccucaacccggacgacgccaugagaagguucugucccuacaccggcaccagaaucucggcagccaugauauucgacggcucgugugaugucgaccacauucuaccuuacucacgcacccuugacgacucauucccgaaccgcacccucugccugagagaggccaacagacaaaaacgaaaccaaaccccguggcaagccuggggcgacaccccacacuggcacgcgaucgcagccaaccucaaaaaccuucccgaaaacaaacgguggagauucgcaccagacgcuaugacccgauucgaaggugaaaacggguuccuagaccgcgcacuaaaagacacccaauaucucgcccgaaucagccguucauacuuagacacacucuucaccaaagggggccaugucuggguggugcccgggcgauucaccgaaaugcuacgccgccacuggggccuaaacucgcuccuaagcgacgccggacgaggagcagugaaagccaaaaaccggacagaccaucgccaccacgcaaucgacgcggcaguuaucgccgccacagauccaggccuacuaaaccgaaucagccgcgcggcaggccaaggcgaagcugcgggccaaagugccgaacuuaucgccagagacacgccaccacccugggagggauuccgggacgaccucagaguaagacucgaucgcauaauagugucccaccgcgccgaccacggacgaaucgaccacgcagcccgaaaacaaggcagagacuccaccgcgggccaacuccaccaggagaccgccuacucaaucgucgacgacauccacguagccucccgaaccgaccucuuaagccugaaaccagcacaauuacuagacgaacccgggcgaucgggccagguaagagacccacaacuccgcaaagcacugcgcguagccaccggcggcaaaaccggcaaagauuucgaaaacgcucugcgauacuucgccucaaaaccaggaccauaccaagcuauacggcgaguaagaauaaucaagcccuuacaggcgcaggcacgcguucccgugccagcacaagaccccauaaaagcauaccaaggcgggagcaaucaccuuuucgaaauauggcgccuaccagacggagagauugaagcacaagucaucaccucguucgaggcacacacccuggagggcgaaaaacgaccacacccagccgccaaaaggcuccucagagugcacaaaggagacaugguagcacuggaaagagacggacgccgaguaguaggccauguacagaaaauggauauagcgaacggccuauucauaguaccacacaacgaagcgaacgcggacacccgaaacaacgauaaguccgacccauucaaguggauccaaauaggagcgcguccagcaauagcaagcggaauaagaagggugucagucgaugaaauagggagacucagagacggcggcaccaggccaauauga

SEQ ID NO: 6180 - RNA, 3240 nt, Artificial Sequence
  Cas9 variant
auggacgaagaagcuaaaauccagcucucaaaagaaagcuacgaagaggaacuagaaucacuacuggaaaagagcggggaagaguuccgugacgucuuccuacaggccaagaaaguauacgacgcaauccuacucagugacauacucaguacgaagaaacaaaacucaaaagcaaaacucagccugggcaugaucgagcgcuacgacucccacaagaaagaccucgaagaacucaaacaauucgucaaagccaaccuuccagagaaaaccgccaucuucuuuaaagacuccagcaaaaacggcuaugcaggauacauagacggcaagacaacacaagaagacuuuuacaaguuccuaaagaaagaacucaacggcaucgcggggucagaacgauuuauggaaaaagucgaccaagaaaacuuccuccuaaaacaacggaccacggcaaacggcgugaucccacaccaaguacacuuaacagagcucaaagcuauaaucgaacgccaaaagcccuacuacccauuccuggaagaggccagagacaagaugauccgacugcuaacauucaggauaccauacuauguagggccccucgcucagggagaagagaccuccucauucgcauggcuggaaagaaagaccccggagaagguaacaccauggaacgcaacagaagucauagacuacucagcaucggccaugaaauucauccaacgcaugauaaacuacgacacauaccuccccaccgaaaaaguacuccccaaacacuccauccucuaucaaaaauacaccauauucaaugaauuaacaaaggucgccuacaaggacgaacgcggcaucaaacaccaauucucaagcaaagaaaaacgggagaucuucaaagaguuguuucagaaacagcgaaaggucaccgucaaaaagcuacaacaguuccucuccgcuaacuacaacaucgaagaugccgaaauucuagggguagacaaagccuucaacucauccuacgccaccuaccaugacuuccuggaccuagcaaaaccgaauacugaaagggucgccgaacuccuagaacagcccgaaaugaacgcgauguucgaggacaucgucaaaauccucacgaucuucgaagaccgagagaugauccgcacacaacucaagaaauaccaguccgugcuuggagacggcuuuuucaaaaagcuagugaagaaacauuacaccggguggggacggcucucagagcgacugauaaacggaauccgcgacaagaaaacaaacaaaacgauacuagacuaccucaucgaugaugacgacuucccauacaaccgcaaccgcaauuucaugcaacugaucaacgacgacucacucagcuuuaaagaggagcuagccaacgaacucgcccucgcgggaaaccagagccugcucgaggucguagaagcccugcccggcagccccgcaaucaagaaaggaaucuggcaaacguuaaaaaucguagaggaacuaaucgagaucaucggcuacaauccuaaaaacaucgucguagagauggcccgggaaaaccaaagaacgaaccgauccaaaccaagacugaaagcccuagaagaagcgcuaaagagcuucgacagcccgcuccuaaaagaacagccggucgacaaccaagcccuacaaaaggaucggcuuuaccuuuacuaccuacagaacggcaaggacauguauacaggagaagcacucgacaucgaccgacuuuccgaauacgacauagaccacauaaucccccgcucguuuaucgucgacaacucgaucgacaacaaaguccuaguaucaagcaaagagaaccgccuaaagauggacgacgucccagaccaaaagguagugauucgaaugcgcagauacugggaaaaacuccuacgggccaacuuaauuucagagcggaaauucgccuaucuaacgaaacuagagcucacaccagaagacaaggcacgguuuauacaacggcaacucguggaaacccggcaaauaaccaagcacgucgcagcaauccuagaccaauacuucaaccaaccggaagaguccaaaaacaagggcauacguaucauaacacugaaaaguagccugguuucccaauucaggaaaacguucggcauacacaaaguacgggagauaaacaaucaccaccacgcacacgacgcauaccucaacgggguagucgccaucgcgcuccuaaagaaauacccaaagcucgagccggaguucgucuacggaaauuauaccaaauucaaccucgcaacagaaaacaaggcgaccgccaagaaagaauuuuacagcaacauccuacgauucuucgaaaaagaagaguauucauacgacgaaaacggcgaaaucuucugggacaaagcgcgacacauaccccaaaucaagaaagucaucagcagccaccaaguaaacauaguaaagaaaguagagguucaaaccgggggcuucuacaaagaaacgguuaaccccaaaggcaaacccgacaaacucauacaacgcaaagcuggcugggacgucagcaaguacggaggguucggcuccccggucgucgccuacgccguugccuucauauacgagaaaggcaaggcaagaaagaaagcuaaagccaucgaaggcaucaccaucaugaaacagucacucuuugaacaagaccccauaggguuccucagcaacaaaggguacucaaaugucacaaaguucaucaagcucuccaaauacacccucuacgaacuggagaacggaagacgccgcauggucgcgucccacaaagaggcacaaaaagccaacucguuuauccuaccggaaaaacuugucacccuccucuucuacgcccaacacuacgacgagaucgcgcacaaagaguccuucgacuacgucaacgaccaccucagcgaguuccgcgaaauacucgaccaaguaaucgacuucuccaaucgauacaccaucgcggccaagaacaccgaaaagaucgcagaacuauucgaacaaaaccaagaauccacaguccaaagccucucccagagcuucaucaaucuaaugcaacuaaacgcaaugggggccccagcagacuucaaguucuucgacgucaucauaccacgaaaacgcuaccccagccucaccgaaauaugggagagcaccauaaucuaccaaucaaucacgggccugcgcgagaccaggaccagaauggcgacuuugugggacggugaacaauga

SEQ ID NO: 6181 - RNA, 3240 nt, Artificial Sequence
  Cas9 variant
auggaugaggaagcaaaaauucaacuaagcaaagaauccuacgaggaagaacucgaaagccugcuagaaaaaucaggggaagaguuccgagacguauuccugcaagccaagaaagucuacgacgccauacuccucucagacauccucagcaccaagaaacaaaacuccaaagccaaacucucacuaggaaugauagaacgcuacgacucccacaagaaagaccuagaggaacucaaacaauucgucaaagcgaaccuacccgagaaaaccgccaucuucuucaaagauucaagcaaaaacggauacgcaggauacauagauggcaagacgacacaagaagacuucuacaaauuccuuaagaaagaacucaacggaauagcuggcuccgaacgauucauggaaaaaguggaccaagagaacuuccugcuaaaacaacgaacaaccgccaacggggucauuccucaccaaguucaccuaaccgagcuuaaagccaucaucgaacgccaaaaaccuuacuacccaucccuggaagaagccagagacaaaaugauccgccucuuaacauucagaaucccauauuacguaggaccacucgcccagggggaagagacauccuccuucgccuggcuggaacgaaaaacucccgagaaggucacccccuggaacgccaccgaggucaucgacuacuccgccucggccaugaaauucauacaacgcaugaucaacuacgauacguaccugccgaccgagaagguacuuccgaagcacuccauccuuuaccaaaaauauaccauauucaaugaacucacgaaagucgccuacaaagacgaacgaggcaucaagcaccaauucucgucgaaagagaaacgagaaaucuucaaggaacuuuuccagaagcaaaggaaggucacagucaagaaacuucagcaauuccuuuccgccaauuauaacaucgaagacgcggaaauacugggcgucgacaaagccuuuaauucgucauacgccacauaccacgacuuccucgaccuggcaaaaccuaacaccgaaagagucgcagaacuacucgaacaaccagagaugaacgcaauguuugaggacaucgucaaaauccugaccaucuucgaagaccgagaaaugauccgaacccaacuaaagaaauaccaauccgugcugggcgacggguuuuucaaaaagcucgucaaaaagcacuacacaggauggggccgucuaucagaacgacuaauaaacggcauaagagacaagaaaaccaacaaaaccauucuugacuaccuaaucgacgacgacgacuuuccauacaaccgcaacaggaacuucaugcaauuaaucaacgacgacagccucucauucaaggaggaacuagccaacgaacucgcacuagcaggaaaccaaucccuucucgaggucgucgaagcccuccucggcagcccggccaucaagaaaggcauuuggcaaacccucaaaaucgucgaagaacuaauagagaucaucggcuacaaccccaaaaacauagucguggaaauggcacgggagaaccaacgcaccaaccgcucgaaaccacgucuaaaagcccuugaggaggcccucaaaucauucgacuccccauuacugaaggagcaaccaguggacaaucaagcccuccaaaaagaccgccuauaccucuacuaccuacagaacggaaaggacauguacaccggcgaggcuuuggacauugaucgccucucagaauaugacaucgaucacauaaucccccgaucauuuauaguagacaacucaaucgacaacaaaguccuagucuccuccaaagagaacagacucaaaauggacgacgugcccgaccagaagguagucauccgcaugcgcagguacugggagaaacugcuacgggcgaaccucaucuccgaaagaaaauucgccuaccucacgaaacuagaacucacccccgaagacaaagcccguuucauucagcgacagcucguagagaccagacagaucacaaaacacgucgccgcaauccuugaucaauacuuuaaucaacccgaagaauccaagaacaaaggcauucgaaucaucacccucaaaucaucgcugguaagucaauuucggaaaaccuucggaaucaacaagguacgcgagaucaacaaucaucaccacgcgcacgacgcauaccugaacggcguagucgcuaucgccuuacugaagaaauaccccaaacuugaaccggaguucgucuacggcaacuacaccaaauucaaccuggccaccgagaacaaagcgacagcaaagaaagaguucuacagcaacauacuccgcuucuucgaaaaagaagaauacagcuacgacgaaaacggcgaaaucuucugggacaaagccagacacauaccacaaaucaagaaagucauauccucgcaccaagucaacauaguaaagaaaguagaagugcaaaccgggggcuucuacaaagagacagucaacccgaaagguaaaccggacaaacuaauccagagaaaagcgggaugggacguaucaaaguacggcggauucggcucgccaguaguagccuaugccguagccuucauauacgagaaaggcaaggcgcgcaagaaggccaaagcgauagagggcaucaccauaaugaagcaaucccuauucgagcaagacccaauuggauuccugagcaacaagggauauuccaaugucaccaaauucaucaagcuguccaaguacacucucuacgaacuagaaaacgggcgaagacgcauggucgcaagccacaaagaagcacaaaaagcaaacagcuucauacugcccgaaaaacucguaaccuugcuauaccaugcccagcacuacgacgaaaucgcccacaaagaguccuuugauuacguaaacgaccaucuaucagaguuccgagagaucuuagaccaagucaucgacuucagcaaccguuacaccauagccgccaaaaacaccgaaaagaucgcagaacucuucgagcagaaccaggagagcaccguccaaucgcugucccaauccuucauuaaccucaugcaacucaacgcaaugggcgcgcccgccgacuucaaauucuucgacguaaucauaccacgcaaacgguacccaucccuaacagaaauaugggaaucaacaaucaucuaucagagcaucacuggcuuacgggaaacaagaaccagaauggccacccucugggacggggagcaauga

SEQ ID NO: 6182 - RNA, 3243 nt, Artificial Sequence
  Cas9 variant
augaagaccucauucgccuucgacaucggaacaaacuccauaggguggugcguacucgcccucgacaacgccaaccugccauaccgaauccucgacgcaggaguucgcaucuucucggauggucgcgagcccaagucaggcaccagccucgcagaaggcaggagacuagcccggggcaugucgagaagacgcgacagauacaaacgcaggcgcaaagccgugauaagaacccuaauagaauacggcuuaaugcccgacgaccccgcagcgagacgagcccuaguagcagaaacgaacgacaaggcgccaggcaaaaucgcauccgacguauacgcccuaagagccagagcacuagacgacaaauuaccccuacaccacaucggccgugcacuguuccacaucaaccaacgaaggggcuucaaaucaaaccgaaaaaccgacaaacgagacaacgaccaaggaaaaaucgccuccggaauaagcaggcugagagacaaacuggcgagcgagggaaugcgaacccuaggcgaauaucuaaaccaccgacaccaagccggcaauuggguacgaguccgccccucgcgcguacccggaaaagacgacaaagaagaagacggauacggcuucuacccagagcgagcacuacuucaagacgaguucaacgcgaucuggaccgcccaagcggcccacuacccagacguccucacggaagaacggagaacccaccuagaaaccauaaucuucuuccaaagaccacucaaacccguucaaguaggcaaaugcuccuucaaccccggcgaggaacgcuugcccagggcacacccacuauuccaagaguuccggcuauacaaagaaguaaacgagcucgaacuuguagacagaaaccaagaucaccacaaacugagccucgaucaacgagacgcccucauagcccaacucaaaacgcaacgcgaagccgcauacagugcccuaaggaagaccgcccgagcaccccucggaacacgguucaacaaggaaacagaaucgagaaccaagaugaaaggcgacgaagucgcagccgaacucucagcgaagacaagauucggucaagccuggauaagcaugccacuugaagaaagauggaucauagucgacacccugcgacggguugaggaccccuuagagcuuacagcauggcuagaacaacacuacggacuagacggagaacacauagaugcaauccucgcugccaggcuccccgaaggguacggcagacugggagaaacagcccuaacggaaauccuagucgaacuaaaagccgccguuauaagcgaagcagaagccgcacgucgagccggcuacgaccacgcacuccuucagcgaggagcggguuuagaagcacuacccaaauaucaggaagucauagcccgacgaaucccacccggcaccggcaaucccgacgacccauacgacgucgaaaaaggacgcauuacaaaccccacaguacauaucggacugaaccagcugcaaaaaguccucaacgcacugauccgaagguacggaaaacccgaacaaauagccaucgaacuagcacgcgaacucaaacucaacgacgaacaaaaacgagagaaaaacaucgaaauugcccgaaacacuagggccgccgagcaacggagcgcaaaacucguggaauuaggcgucccagacaccggauacaaccgaguguuacuaaaacuaugggaagaacuaaaccuacgugcccccgaaaacaggguaugcaucuauugcggggaaccaauuaacauagaaacgcuauucucuagcgccguagauauagaccacauccuccccugguccaaaacccuagacgacucccaagcaaaccgucucgucugccaugucgcgugcaaccgacaaaaagcaaacuacgcacccgcagaggucccccaauggcaggggcgguacgaugacauacuagcccgagcuaacacccucccacuaaacaaacgauggcgauucggacgcgacgccaugaagaaauuugcagacgaggaaacauuccuagcgcgccagcucacagacacccaguaccucuccagacucgcccacgccuauauggccgcccuauacccagacgaagaaccggacgcacaagggguacuggcccgcaaaaaccacgugcgaguaaucaccgggcgcaugacagaaaugcuacggagacaauggggucuuaacagccuccucgcagaccacaaccagaaaaauaggaacgaccaccgccaccaugcaaucgacgcagccgugguaggcguuacuacacgcgcacuccuacaacgaauugcaaccgucgcagggggaagagaagcgcaagcgcuagaagaaacgaucggaaaaauagaaccgccauggccaggcuuucgugacgaguugcaagccgucaucaaacgaaucguagugucgcacaagccagaccacggcacgcuaccaaaaccaggacaaggaggacaaacagcagggcaacuacacaacgacaccgcauacggauuaacaggagaaaccgacucacgaggaacacccaucgucgugcggcgaaaaccuuucacaucauuaacggaaaaagaccugccaucgaucagagacagacaacucgcacaggcuuuaggaagcgccauugcuggccgaucugguaaggaacuccaagcugcacuagagcaauuccgcgacagagacgacuacaaaagcauaaggcacguacguguugucgaaccucucaauguaauacccauacgagacggaaccggacgcgcguacaaagcguauaagggcgacgcaaacuacagguacgacguaugggaacuacccaacggcaaauggaugcacgaggucgucagcauguucgaugcgcacgacaggagcuggacauccgcaguccacauacaccacccugcagcgcgacgcguacugagccuaaagcaaaacgacauggucgcauacgaccauccucaagacggaccuacaauaggacgaguuguuaaauucucacaaagcggacagaugacguucgcaccccacaaagaagccggcgcccuuaaggccagagacgcggauccggaagaucgauuccguuacuucuauaaaucaggcucagccaugaaagacaucggccugcgccagguccgcguggacgaaauaggccgcguauucgacccagguccgcgcgacaaagaagcaagaaacgcccgaaagaagaaaucgacagauuga

SEQ ID NO: 6183 - RNA, 3243 nt, Artificial Sequence
  Cas9 variant
auggccaagagcuuugcguuugacaugggcaccaacucaaucggcugggccguacuaggacuggacuccgccggagauccggacuccauagaaggagcgggaguacgcauauuuucagauggacgugaaccaaaaagcggagccucucuugcagaaggccgcaggaucgccagaggcaugucgcgcaggcgagaaagauauaaggcgagaagaaaagcgcucauccgaacccucggggacuacggacuaaugccccuagaacgcgcagcucgucgcgcucucguggccgagaccaacgaucguagcuucggauugguagcacaagacguauaugcccuaagagcacgcgcgcugguggaaaaacuacccccauaccaccugggccgagcacuauuccaccucaaucaaagacgcggcuucaaguccaaccgcaaaaccgacggcagagacaacgaacucggaaugaucgccacggguauagcggcccuagacgcgcaacugaacggacgcacacucggacaauaccuccacgaaaugagaggagcagacccucgacaaagaggccaaguacgaguaagaccgcaccucgaaauuaacgauaaaggcagggagauagccgcuuacggcuucuacccacaacgagcaaugcuagaacgcgaauuuaacgccaucugggcggcgcaagccccacaccaucccgaacuacugucggaagagagacgcgcccaucuauuccaagucauauucuaucagagaccccuaaaacaaccagacccaggccguugcagcuucaaucccgcagagccccgacucgccaaagcccacccauuauuccaacgauuucgacucgucaaggaaauaaacgaacuacgcauaguaacaggaagcaacucccaaggcgucccccuaacccuagaacagcgggacauccuacuaacacuacucagggacaagaaggcauccuccuucaaaacacuccuggcaaagauaauaaaaggccaacccgaggccagauucaauaaagcaagugauucacgcgacaagaugaaaggcgacgaacuagcagcaacaaugagcgacaaaaccagauucggucaagccugguucgccaugcccgaagccgaacaauggcgaauaaucgcaaaacuccgcgacaucgacgacccacuggaauuaaacgcauggcuagagagugaauacggacuagcgccggagcgccgugacgcagucgcaaacgcacuucuaccacagggauacggucgccucggagaaacagcuuugcgcacaaugcuagauuaccuggaagccgccgucaucagcgaggcagaggcugcggcccaggcaggcuacgaccacgcgcucgcacgcagaggcgcgggccuggaccaacuucccaaauaucaagaaguccuaggccgccgaauacccccaggcucaggagaaccaaacgacccauacgacaucaggauggggagaauuucaaaucccaccguccacaucgcccuaaaccaacugcgaagaguagucaacgcucuaauccgcaaguauggcaaacccgcugaaaucgccaucgaacucgcacgcgaccuaaaacuaucggaggaacagaagagggaggucaacgcaacuauagcgaaaaacacccgcgacgccgaacgacgagcagucagacucgcggacgaaggcauagauaacacaggacauaaccgcgcacuguuacgcuucugggaggaacuggccgcagacccccuagacagaguaugcguauacugcggcggaggaaucggggcugcgagccuauuuaacggaagcguggacaucgaccacauacuucccuggagcagaacgcuggacgacagcagagccaaccguauacugguacacaacagcugcaacagguuaaaaagaaacuucgcccccuucgaagugcccgaauggagagagauauaccaagauauccuggugcgugcggccaagcuaccggcaaacaaaagcuggcgauucgcccccgaugcaauggauagauuugaaggagaaaaagacuucuuagcaaggcaacucaccgauacccaauaccuggccaggauggcacacgaguaccuggccgcgcuauacccagacgaagaaccagacgaauggggcguguucgcacgcggcaaccacguucggguugucccaggacgguugaccgagauguuacgucgagcauggggauuaaacgcaauacuaagcgaugacaaccgcaaaaaccggaaugaccacagacaccacgcaauagaugcagucguagucggagugacaacacgagacaugcucaauaaaaucucccaagccgcaggccgaggagcggacaugggagcagcagacgcacuccguagauucgacccacccuggcccagcuuccaccaagccgucagagcagccguagaacgcauccucgucucgcacagagcagaccacggaacauuacccggcacagauggacaaggcucaacggcagggcagcuacacaacgacacagccuacgggcucacaggagaaacccgaaaaggacuggccgucguaguaaggcgaaaacccuaccucucacucgaaccccgagacauagagacaauacgagacccacagcugcgcgaccaccuagccacagaaacauacggccuggcgggugcugaguucacugcagcacuuaagcggcuccaacaaacggacaaguucuacgcaggaauccgacgagugcgagucaccgaagcccugagcgucaucccaauuagagacgcuacaggccacgcauauaaagccuacaaaggagacgcaaacuucagauaugacguaugggaacucccaaacggaaaauggguacccgaaguaauaucaauguuugacgcgcacgacagaggauggguaagccaaguccacgccgcaaauccagccgcccgaagaguacuuucccuacgccaaaacgacaugguagccuaucaacacccugaacaaggauuaguauacgggcgcgucguaaaguuuggacagucaggccaaaugacguucgcagcccaccacgaaggaggaucccuaaagagccgagaugccgaccgggacgacccauucaaguacuucuauaaaagcgccggcacaaugaaagacaucggccuacggcaaauaagaguagacgaaaucggaagaguccaggaccccgguccacaggaccgcgacagcaagagaguacgcaaauccgauagauga

SEQ ID NO: 6184 - RNA, 3246 nt, Artificial Sequence
  Cas9 variant
auggccgcauucaaaccgaaccccauaaauuacauacugggccucgacauuggcauagcaaguguaggcugggcgaugguugaaauugacgaagacgaaaacccgauaugccucaucgaccuaggaguaagggucuucgagagagcugaagucccuaaaacuggcgacagucuagccauggcacgccgccucgcccgaaguguaagacgccuaacaagaagaagggcgcacaggcugcuccgcgcaagacgccuacuaaaacgagaggguguacuucaagcagccgauuucgacgagaacggucuaaucaaaagccuccccaacacucccuggcaacuccgcgcggcagcacucgaccgaaaacucacgccccuggaauggagcgcaguccuucuccaccucauaaagcacaggggcuaccuaagccaacgcaaaaacgagggcgagaccgcagacaaagagcucggcgcacuccuaaaaggcguggccgacaaugcacaugcccuacaaaccggcgacuuccgcacccccgccaaguuggcacuaaacaaauucgaaaaagaauccggccacaucagaaaccaacggggcgacuacagccacacauucucccgaaaagaccuacaagcagagcugaaccugcuauucgagaagcaaaaagaguucggaaacccccauauauccgauggacugaaagaaggcauagaaacccuucuaaugacccaaaggcccgcacucuccggagacgcaguccagaaaaugcuaggccacugcaccuucgaacccacagaaccaaaggcagccaaaaacaccuacaccgcagaacgcuucguuuggcucaccaaacuuaauaacuugcgaauccuggagcaaggcagugaacaaccacugacagauacccagagagcuaaacucauggacgaacccuacaggaagucgaagcugacuuacgcccaagcaaggaaacuacuaggccuggaagacacagcguucuucaaagggcugagguauggcaaagacaacgccgaagccuccacccucauggaaaugaaagcauaccacgcuauaucaagagcccucgaaaaagaaggacuaaaagacaaaaagucgccccuaaaccucucacccgaacuucaagaugaaaucggcacagcauucagccuauuuaagaccgacgaagacaucacaggccgccucaaagaucgaguacaaccagaaauccucgaagcccuccuaaaacacauaucauucgacaaauucguccaaauaucccugaaagcacuccgcagaauaguaccccuaauggagcaagggaagcgauacaacgaagcaugcgcagaaauauacggcgaccauuaugggaagaaaaacaccgaggagaaaaucuaucucccacccauacccgcagacgaaauacgcaauccaguaguccuacgcgcacucucccaggcaagaaaggugauaaauggugucgucagacgauacggcucccccgcacgcauccacauagaaacagcccgagaagucggaaagagcuucaaagacagaaaggaaauagaaaagcgccaagaagaaaacaggaaagaccgggaaaaagcagccgccaaguuccaagaauacuucccaaacuucguaggugaaccaaaaaguaaagauauccucaaauuacgccuuuacgagcaacaacacgggaagugccucuacucaggaaaagaaaucaaccuaggcagacucaaugaaaagggauacguggaaaucgaccacgcccuccccuucagccgaacgugggacgacucguucaacaacaagguccucguacucgguagcgagaaccaaaacaagggaaaucaaaccccauacgaauauuucaacggaaaagacaacagccgugaguggcaagaguucaaggcucgaguagagacaagccgcuucccacguuccaagaaacagcgcauccuucuacaaaaauucgacgaggacggauucaaagagcgcaaucugaacgacaccagauacguaaaccgauuccugugccaguucgucgccgaucgcaugcgccuuaccgguaaaggaaagaaaagggucuuugcauccaacggccagaucacuaaccuccuccgcggauucuggggacugcgcaaaguccgagcugaaaacgauaggcaccacgcacuagacgcagucguugucgcaugcuccacggucgccaugcaacaaaagaucacaagauucguaagauacaaagaaaugaacgccuucgauggaaaaaccauugacaaagagacgggcgagguccuccaccagaaaacccacuucccgcaacccugggaguucuucgcacaagagguuaugauccgggucuucggaaaacccgacgggaaaccagaauuugaagaggcggacacaccagaaaaacuccgaacucuacuagcagaaaagcucagcucacgcccugaagcaguacacgaauacgucacaccgcuuuucguaagccgcgcaccaaaccgaaaaaugagcggacaaggccacauggaaacaguaaaaagcgcgaaaagacuggacgaaggggucagcguacuacgaguccccuugacgcaacuaaaacucaaagaccucgagaaaauggucaaccgagaacgggagccgaaacuauacgaagccuuaaaagcgcgccucgaggcacacaaggacgaccccgcaaaagccuucgcagagcccuucuacaaauacgacaaggccgggaaucguacucaacaaguaaaagcgguccggguggagcaaguccaaaagaccggcguauggguccgcaaccacaacggcaucgcggacaacgcaaccaugguacgcgucgacguauucgaaaaaggggacaaauacuaccuaguaccaaucuacagcuggcaaguagcaaaaggcauccuacccgaucgagcggucguggcauaugccgacgaggaagacuggacagucaucgacgaguccuucagguucaaauucguacucuacucuaacgaucucauaaaaguacagcucaaaaaggauagcuuuuuaggcuacuucaguggccucgacagagcaacaggcgcaauaucacugcgagaacacgaccuggagaaaucaaaaggaaaagacggaaugcaucgcaucggaguaaagaccgccuuaaguuuucagaaauaccaaaucgacgaaaugggcaaagaaauccggccaugccgucuaaagaaaagacccccaguucgcuga

SEQ ID NO: 6185 - RNA, 3246 nt, Artificial Sequence
  Cas9 variant
auggcggccuuuaaacccaacccaaucaacuacauacuuggacuagauaucggcauagccucggucggcugggcaaugguagaaauagacgaagacgaaaaccccauaugccucauagaccucggaguacgcgucuucgaacgagcggaaguccccaagacaggagacagccuagccgcagcccgccgccuggcccgaagcguaagacgacuaacccgaagacgugcgcaccgacuacugcgggccaggcgacucuugaaacgcgaaggcguccugcaagcugccgacuuugacgaaaauggacuuaucaagucccuacccaacaccccauggcagcucagaucggccgcccuggacagaaaacuaaccccgcucgaauggagugcgguucuccuacaccuaaucaagcacagaggcuaccucagccaacgcaaaaacgaaggagaaaccgcagacaaagaacuaggggcgcuacucaaaggaguggcggacaacgcccacgcucuccagaccggagacuuccgaacccccgcagaacucgcucuaaacaaguucgaaaaagaauccggccacauacggaaccgacgcggagacuacucgcacaccuucagccgcaaggaccuccaagccgaacuagaccuacuauucgaaaagcaaaaagaguucggcaacccucauaucuccgacgaccuaaaggaaggaaucgaaacacuccucaugacccaaagaccagcacucagcggggaugcagugcagaaaaugcuaggacacuguacuuucgaacccaccgaaccaaaagccgcgaaaaauaccuacacugcggaaagguucgucuggcugacaaaacucaacaauuuacgcauccucgaacaaggcagcgaacggccacuaaccgauaccgaacgggccacacuaauggacgagcccuaccgaaaauccaaacucacauacgcgcaagcaagaaagcuacuagaacuugacgacacagcauuuuucaaaggacuacguuauggaaaggacaacgcagaggcuuccacgcuaauggaaaugaaggcauaccacgcaauauccagagcgcucgaaaaagaaggccucaaagacaagaaauccccacugaaucuaucacccgagcuacaagacgaaaucggaacagcauucagccucuucaaaacggacgaggacaucacgggcagacuaaaagacagaguacaacccgaaauccuagaaguacuacugaaacauaucagcuucgacaaauucguacaaauaucgcucaaggcacuacgaagaauugucccacuaauggagcaaggcaaacgcuacgacgaagcgugugcagaaaucuacggggaccaugacggaaagaaaaacaccgaggagaaaauauaccuacccccaaucccagccgacgaaauucgaaaucccgugguccuacgcgcgcucucacaagcacggaaaguaauaaacgccgucguaagacgcuacggcagucccgccagaauccauaucgagacagcaagagaagucggaaagagcuucaaagaccgcaaagagauugagaaaagacaagaagagaaccgaaaagaccgagaaaaagcggccgcaaaauuccgagaauacuucccuaacuucgucggcgagccaaaaucaaaggacauccuaaaacugcgccuauacgaacaacaacauggcaaaugccuguacagcgggaaggaaaucaaccuaggcagacugaaugaaaagggcuacguagaaaucgaccacgcccuacccuucagcaggacgugggacgauuccuucaacaacaaaguccuaguacucggaagcgaaaaccaaaacaagggaaaccaaacaccguacgaauacuucaaugguaaagacaacagccgcgaauggcaagaguucaaagcuagaguagaaaccagccgauucccccgaagcaagaaacaaagaauccuccuccagaaauuugacgaagaaggcuucaaagaacgaaaccugaacgauacacgguacguaaaccgauuccugugccaauucgucgccgaucacauguuacuaacugggaaaggcaaacgacgaguguucgccagcaacggacaaaucaccaaccuccuucgaggauucuggggacuaagaaaaguaagggcugaaaauaaccgacaccacgcccuggacgcaguugucguggccugcagcacagucgcuaugcagcagaaaauaacccgauucgucagauacaaggaaaugaacgccuuugacggaaaaacgauugacaaggaaaccggagaagugcugcaccagaaaacccacuuuccacaacccugggaguucuucgcacaagaaguaaugaucagagucuucggcaaaccggacggaaaacccgaauuugaggaagccgacacgccagagaagcuccgcacccuccuggccgaaaaguuaagcucacggcccgaagcaguucacgaauacguaaccccacuauuuguaucgcgcgcaccaaacagaaaaaugagcgggcaagggcacauggaaaccguaaaaagcgccaaaagacuagacgaaggcgucucgguauuacgggucccccuaacacaacugaaacucaaagaccuggagaaaauggugaacagggaaagagaaccgaaacuauacgaagcccugaaagcccgccuagaagcacacaaagacgaccccgccaaagccuucgcagaaccauucuacaaauacgacaaggccgggaacaggacccaacaaguaaaagcaguaagaguagaacaaguccagaaaacaggaguguggguaaggaaccauaaugguauagcagacaacgcaacgaugguaagaguggacgucuucgaaaaagccggcaaauacuaccuuguacccauauacucauggcaagucgccaaaggaauacugcccgaccgugcggucguagccuacgccgaugaagagggauggaccguuaucgacgaaucguucagauuuaaguuuguucuauacagcaacgaccucauaaaagugcaauuaaagaaagacucuuuccugggcuauuucagcggacuagaccgagccaccggggcuaucagucuacgcgagcacgaccuagaaaaauccaaaggcaaagacgggaugcaucgcaucggaguaaaaacagcccuaucguuucaaaaguaccaaaucgacgaaaugggcaaggaaauacggcucugcagacucaaaaagagacccccgguacgcuga

SEQ ID NO: 6186 - RNA, 3246 nt, Artificial Sequence
  Cas9 variant
augacagccuucaaacccaaccccaucaacuacauccucggacucgacaucggcaucgccagcgucggcugggccaugguggaaauagacgaagaagaaaaccccauaagacucauagaccugggcguaaggguauucgaaagagccgaagucccaaaaaccggcgacagccuagcggccgcgcgccggcuggcccgcagcguacgcagacuaacacggagacgagcccaccgacuacuaagggccagaagacucuugaaacgcgaaggcguccuccaggcugcggacuucgacgaaaacggccucauuaaaucacuccccaacacucccuggcaacuccgagccgcggcacuagaccgcaaacucacgccccucgagugguccgcaguacuacuacaccucauaaaacaccgaggcuaccucagucaacggaaaaacgaaggagagacagcggacaaagaacucggagcacuccucaaagggguggcagacaacgcacacgcguuacagacaggagacuuccgcaccccggccgaacucgcaguaaacaaauucgaaaaggagucaggccacauccgcaaccagagaggagacuacagccacacauucuccagaaaggaccuacaagcggagcucguccuacucuucgaaaaacaaaaggaguucgggaacccccacaucagcgacggacugaaagaaggcauagagacacuccuaauggcccagcguccagcacuaagcggcgaugccguacaaaagaugcucggcuacugcaccuucgaaccaacggaaccuaaagccgcgaaaaacaccuauacagcagagagguucauauggcugacuaaguuaaauaaccuccgaauccuagaacaaggcuccgaacgaccccuaacagacaccgagcgugcaacacugauagacaugccuuacaaaaacaaacuaaccuacgccaaagcgcgcgaacuccuaggauuggacgacacggcauucuucaaagggcuccguuauggaaaagauaaugcagaaagcgcgacccuuauggaaaugaaggccuaccacgcaauacgacgggcccuggagaaagagggacucaaggacaagaaaucgccccucucccuaucacccgaauugcaagacgaaaucggcacagcguucucucuauucaaaacagacgaagacaucaccgggcgacuaaaaggcugccuacaaccugagauccuagacgcccuccuuaagcacauaaacuucgacaaauuuguacaaauaucccucaaagcacucaggagaauagucccccugauggaacaaggcaaacgguacgaugaagcgugcgcggaaaccuacggcgaccacuacggagagaaaaacucagaagaaaugcuguaccucccgcccaucccugccgacgaaauaaggaauccagucguccugcgagcucucucgcaggcccgaaaaguaaucaacggagucguccgcagauacggaucgccugcccguauccacauugaaaccgcacgagaagucggaaaaucauucaaagacagaaaagagauagaaaaacgccaagaagaaaacaggaaagaccgagaaaaagcagcagcgaaauuccgggaguacuucccaaacuucgucggcgagccgaaaucaaaagauauccuaaagcuacgacuauacgagcaacaacacggcaagugccuuuauuccggaaaagcaauugacauccgacgacuaaacggcaaaggauauguugaaaucgaccaugcacuccccuucaguaggacgugggacgacagcuucaacaacaaagucuuaguccuggggagcgaaaaccagaacaaaggaaaccgaacgccuuacgaguaucuuaacggaaaagacaauucccgagaguggcuugaauuuaaagcucgcgucgaaacaucccgauucccccacagcaagaaacaacgcguacuccuccaaaaauucgacgaaaaaggcuucaaagaaagaaaccucaacgacacacgauacgucaaccgcuuccucugucaguucguagccgaccacaugcaacucacaggaaagggcaaacgacgagucuucgccucaaacggacaaauuacaaaccuacuccggggauucuggggccuacacaaagucagagccgaaaacgaccgacaccacgcucuagacgcaguagucguagccugcucgacaguugccaugcaacagaaaauaaccugcuucguccguuacaaagaaaugaacgcuuuugacgggaaaaccguagacaaagaaaccggcgaaguuuuacaccagaaaacccacuucccacaacccugggaguucuuugcgcaagaaguaaugaucagggucuucggcaaaccagacgggaaacccgaguucgaagaagccgauacccccgaaaaacuacgcgcacuacuagccgaaaagcuguccucccgccccgaagcaguccacgaauacguaacaccacucuucgucuccagagccccaaauagaaaaaugucaggagcacacaaggacacccucagaagugcgaaaagauucgucaaacacaaugagaaaaucagcguaaaaagggucuggcucaccgaaauaaagcuagcagaccuagaaaauaugguuaacuacaaaaacggccgagaaaucgaacucuacgaagcacuaaaggcgcgccucggcgccuacgggggaaacgccaaacaagccuucgacccaaaggacaaccccuuuuacaagaaaggcggacaacucguaaaagcaguccguguugaaaagacucaagaauccggaguccuccuuaacaagaaaaacgcauacaccauagccgacaacggagacaugguaagagucgacgucuucugcaaagucgacaagaaaggcaaaaaccaauacuucauaguacccauauacgcguggcaaguggccgaaaacauucuacccgacaucgauugcaaaggauacagaaucgacgacagcuacaccuucugcuuuucgcuccacaaauacgaccucaucgcguuccaaaaagacgagaaaagcaaggucgaguucgccuacuacaucaacugcgacuccucuaacggccgcuuuuaccuggccuggcacgacaaggggagcaaggaacaacaauucagaauaagcacccagaaccuaguccuaaugcaaaaauaccaaaucgacgaauuaggcaaagaaauaaggccaugccggcucaagaaaaggccaccuguacguuga

SEQ ID NO: 6187 - RNA, 3246 nt, Artificial Sequence
  Cas9 variant
auggccgcauucaaaccuaaccccauaaacuacauccucgggcucgacaucggaauagcaagcgucggaugggcgauggucgaaauagacgaagacgaaaacccaaucugucuaaucgaccugggcgugcgcguauucgaacgcgccgaaguaccgaaaacgggggacagccucgcagcggcacgaagacuagcgagaucgguacgcagacuaacaagaaggagggcacaccgacuccuaagggcacggaggcuccugaaacgcgaaggcguacuacaagcggcagacuucgacgagaacgggcuaaucaagucgcugccaaacaccccguggcaacucagaagcgcagccuuggaccgaaaacugacaccccucgaauggucagcagucuugcugcacuuaauuaagcaccgcggcuaccuaagccagagaaagaacgaaggcgagaccgccgacaaagaacucggagcgcuacuaaagggagucgccaacaacgcacacgcgcuccagacgggagacuucaggacgccugccgaacucgcacugaacaaguucgagaaggaauccggccacauacggaaccaacgaggggacuacagccacacauucagcagaaaggaccuccaagcagaacuaauccuacucuucgaaaaacaaaaagaguucggcaacccccaugucucaggcggccucaaagaaggaauagaaaccuuauuaaugacccaacgccccgcacuaucaggagacgcaguccagaaaaugcuaggccacugcacguucgagccagcugagccgaaagccgccaaaaauaccuacaccgccgaacgauucauaugguuaacaaagcuaaacaaccuccgcauacucgaacaaggauccgaacgcccccucacagacacagaacgagccacgcucauggacgaaccauaccgaaaaagcaaauugaccuacgcacaagccagaaagcuacuaggacuagaggacacagcauucuucaaaggucuacgcuacgggaaagacaaugcagaagcgucaacgcuaauggagaugaaggcguaccacgcgauaagcagagcacuagaaaaagaaggccugaaagacaagaaauccccacucaaccuuuccccggaacugcaagaugaaaucggaacggcauucagccuauuuaaaacagacgaagacaucaccggucgacucaaagauagaauccaaccagaaauacuggaagccuuacucaaacacauauccuucgacaaauucguccaaauaagccugaaggcccucagacgaaucgucccacugauggagcaagggaagagguacgacgaagcgugcgcagaaauuuacggggaccacuacggaaagaaaaacaccgaggagaaaaucuaccuaccgccuauaccagcagacgaaauccgaaacccagucgugcucagagcgcuaucccaagcccgcaaaguaaucaacgggguggucagacgcuacgggagccccgcccgaauacacaucgaaacagcgagggaaguaggaaaaucauuuaaagacagaaaggaaauagagaaaagacaggaggagaacagaaaagacagagaaaaagcggcggcuaaauuccgcgaguacuuccccaacuuuguaggcgaacccaagucaaaagacauccuaaagcuccgccuauacgaacaacagcacggaaaaugucucuauuccggaaaagagauaaaccucggccgccucaacgaaaaaggcuacgucgaaaucgaccacgcguuaccguuuagccggacgugggacgacagcuuuaacaacaaagugcugguccucggaagcgaaaaccaaaacaaagggaaccaaacgccauacgaauacuuuaacgguaaagacaacaguagagaauggcaagaguucaaggccagggucgaaacaucccgcuuccccagguccaagaaacaaagaauacuacuccaaaaauucgacgaggacggcuucaaagagcguaaccucaacgacacuagauacgucaacagauuccugugccaauucguagcggaccggaugcgccugacaggaaaaggcaagaaacgagucuucgcauccaacggacaaauuacaaaccuacucagaggcuucuggggacuaaggaaaguacgcgcggagaaugaccgucaccacgcucuugaugcaguggucgucgccugcagcaccgucgccaugcaacagaaaaucaccagauucgucagguacaaagaaaugaacgccuucgauggaaagaccaucgauaaagaaacgggugaaguccuacaucagaaaacccacuucccgcaaccaugggaguucuuugcacaagaaguaaugauaaggguauuuggaaagccagacggaaagcccgaguucgaagaagcugacaccccagaaaaacuacggacacuacuagcagaaaaacucagcuccagaccagaagccguccacgaauacguaacaccccuauucgucuccagagcuccuaaccgaaaaaugucaggccaaggccacauggaaacggucaaaagcgcgaaacgacuggacgaaggagucuccgugcuccgagucccacugacacaacucaaacucaaagaccuagagaaaauggucaacagggaacgagaaccgaagcuguacgaagcccucaaagcacgccucgaagcacacaaggacgaccccgccaaggcguucgcagaacccuucuacaaauacgacaaagcaggcaaccgaacucaacaagucaaagccgugcguguagaacaaguccagaaaacaggggucugggucagaaaccacaauggcaucgccgacaacgcaaccaugguacgcgucgacgucuucgaaaaagcuggcaaauacuaccuaguccccaucuacagcuggcaagucgcaaagggcauacuaccugacagagcggucgucgcauacgccgacgaagaaggcuggacaguaaucgacgagagcuucagauucaaauucguccuguacucgaacgaccucauuaaaguccaacucaaaaaggacagcuuccuaggcuacuucagcgggcucgaccgggccacaggagccauuagcuuaagagaacacgaucucgaaaagaguaagggaaaagacgguaugcacaggauaggagugaaaacugcucugagcuuccaaaaauaucaaauagacgaaaugggcaaagaaauacgccucugucgccucaagaaacgaccacccguccguuga

SEQ ID NO: 6188 - RNA, 3246 nt, Artificial Sequence
  Cas9 variant
augcuaaaacggguccucggaauagacguggggauaagcagcauaggaugggcacuccuagaguuccaaggugacauagacaacaaagaccucccgaguggcaagauccuagcgucaggaguccggguuuucacacaagccgaaaacccaaagaacggggaaagccuggccaagcccagacgcgacgcccgccuagcccgccgccgcacaagacgcagggcacaaagacucaccgacauuaaggaccuauucuucaaauacaagcuagucaccggcauaagucgcaacaaaauaaacagcauauauaaaaccgaagaaaacaagaaagauccguggacccugcguaaagaagcccuguacagaaagcuagacggagaagaguucgcccgcguauuaacccacauagccaagcaccgcggcuucaaaaguaugagaaagagcgaggaggaaggauccgacacaaaggcaaaagaaacccagaggguuuugacggagaucggcaaaaacaaagauacccugaagacgggcauauggcaaacggccggagaaaugauagcgucacgaccgaaaggggacgcccgccgaaacaagacagauagcuauaaaaacuccauaucgcgagaacuccuacaggaugaaaccaaaauaaucuuugaaaaacagcgagggaugaacucgcaauucacguccgcggaccucgaaaaggaauacuccgauaucgcauuccaccaagcgcccauacaaucgauguuaaaaauggucggcggaugcacuuucgaaaaagacgaagaaggcaaacgacuaaagcgggcacccaaaaacuccuacuccgcugaaguuuucacagcccucaccaagaucaacaaucugguccuuaaaaccaaaacggccaacauaaaugaccgauuccuaacaaccgaagaacgaaagaaagcacuagaacuuugccacagcaacgcaaaggucacauucaaacaacuacgaggagaacucggcuuaccagaagacuggauauucaacaccguggauuacgccaagaagcccaagaagacagcggucaaggaaaccgaacccgaauccgccugcuuuuuccagaugcgaggguauaacgagauccgaaaaaguguagggaaagaccuauggacagagauauccaugaagaaggaaauccuaaacucaauaguaaccacacucgccacagagaaaagugacgaagccauaaaagcucagcuaaagaaaagcgaaguaccggacgaaauagccgaaaaaguccugggccuaaacuuucgcggauuccuacaccuaaguaucaaagcccuagacaaaaucaucccguucaugauggccggcgacaaauacacggacgccugcgacaaagcgggauacaaagaacagaucuccggcauaaagaaaauauuccuccgcaaacuaaacgacgaagaaaacgagcagaucacuaaccccgucgccaaaagagcgauaacgcaauuccgcaaagucauaaacgcgauaauccgcgaguacggaaaauucgaccaaaugaauauagagcucgcccgcgaccuggcaaaaucauacgacgacagaaagaaaaucaaagaaggccaagaagacuucagggcggaaaaagaccgcgccgcacaaagaugcaaagacaacggacuagaccccaacagcaaagacaaccucagcaaauaccggcuaugggagcaacaggacaacggauuuuguaucuacugcggaaaacccauagaacuacaacgacuggcggagcagggguacugcgaaguagaccacauacugccguacucgcguagccucgacgacucccagcacaacaaaguccuagcacacauacacgacaaccaacaaaagaaaaaccaaauccccuucgaacacuucgggggcgacggcccaaaaugggaagaguucgucggccgccucaacagccaauucaaaaaccugccaaaaagcaagcugaaucgucucgucaaacguaaauucgacgaaaaagacauggaaggauucaaagaacgcaacaucaacgacacaagguacaucucgcgauucaucaaaaacuucguggaaaaccaccucgaguucgcagaauccgcucaaaagcaaaaaguuuucgugagaagcggcagccugaccgcguuccugcgccaccaaugggggcuuaucaaaaagagggacgaaagcgaccgacaccacgcacuagacgcgcucguuaccgcgugcgccacccaagcgaugguaaagagcaccgcaaucaccgcccagaagauggaaucguacaacuggauaaacaaggaaaaaccacggaugccccuuccauggcucaacuuuagagacgacguccagaaaagccuagacgccgucuucgucagcagagcucccagacauaaagugggcggcgccgcccacaaggagacaauccggucaauaagaaaaugcggcgaggagaaccuaauaaucgaaaagacaccccuaguugacauagcgaccaaauccggcauaaagcuaaaggacauugaaaaacuauacaagaaagagcaaaacagaaaacucuacgaaacucucaaagagcgucucgaacaaaacgggaacgaccccgugaaagcguucggaaacccagacgacccugugcgcaugccgaccaacgaucuaacaaaaacgggacccaucauaaaaucaauaaaacuaaucaccaacaagaaauccggucucaacguaagagcaggcaucgccgacaacggcgagauagccagacuagacguuuacgaacggaaaggcaaguucuaccucauacccaacuacguggccgacuucgccaauaaagaauugcccaagaaggcaaucaaagccaauacaccagaaaccgaauggccaauaaucgaccgcaauuacaacuucaaguucucgcuguuuaaagaugaucuaauaagcaucaaacaaaaacucgacagccccgaggaguucuauuacuacaaagggccagacgucuccaccgccuccaucaccgucgaaagcguggaccgcaaacggcucugggaggaaaagaagaaaggcaagauagaaaacguguuccacaccagaauaggaaccaagaccuuaaaaucuuuuagaaaauucaaccuagacauccuaggaaccaaagcgcccguggagaucaaaaaggaaaccugggucggcguaauccgcaaaaacggaguagccaacaacacagggaacaaagccauguga

SEQ ID NO: 6189 - RNA, 3249 nt, Artificial Sequence
  Cas9 variant
auggcagcguucaaacccaaccccaugaacuacauccucggacuggacauagggauagcaagcgucggcugggccaugguagaaaucgacaaagaagaaaacccgauacgacucauagaucuaggagucagagucuucgaacgcgcagaaguacccaaaacaggugacucccuggccauggcacgccggcuugcccgaucagugcgacgacucacacgacgacgagcacaccgacuccuccgggcccgacgccuccucaaacgcgaaggcguccuccaagacgcugacuucgacgaaaauggccucgucaaaagccucccaaacacacccuggcaacuacgcgcagcagcccuagaucgcaagcuaaccugccucgaauggagcgcuguacugcuccaucugaucaaacacagaggauaucuaagccaacgcaaaaacgaaggcgaaacggcugacaaagaacucggcgcauuacuuaaaggggucgccgacaacgcccacgcacuccaaacaggagacuuccgaacuccagcggaacuagcacucaacaaauucgaaaaggagucgggacacauccgcaaccaacgcggcgauuacucgcacaccuucagucggaaagaccuccaagcggagcugaacuuacucuucgaaaaacaaaaagaguucucgaacccacauguaagcgacucccucaaggaaggaauagaaacacuauuaauggcccaacgcccagcguugagcggcgacgccguccagaaaaugcucggacacugcaccuucgaaccagccgaaccaaaagcagcaaagaacacauacaccgcagaacgauucauauggcugacaaaacuaaacaaccugcgcauacucgaacaaggguccgaaaggccacugacugacaccgaacgcgccacgcucauggacgaacccuaccgcaaaagcaagcuaacauacgcacaggcacgcaagcuccugggccuagaagauaccgcauucuucaaagggcuaagguacgguaaggacaacgccgaagcccccacgcugauggaaaugaaagcguaccacgcaaucagccgagcacucgaaaaggaggggcucaaagauaagaaaagcccgcuaaacuuaagcaccgaacugcaagacgaaaucggcacggccuucagccuauucaaaacugacaaagacauaacagggcgccugaaagacaggguucagccugagauacuggaagcccuccugaaacacaucuccuuugauaaauucguccaaauaagccucaaagcauugcggagaauuguaccacucauggaacaaggaaaacgcuacgacgaggccugcgccgaaauuuauggcgaccacuauuguaagaaaaacgcugaagaaaagaucuaccuacccccuauuccagccgaugaaauacgaaacccagucgucuuaagagcgcuaucacaggcacgcaaagucauaaacugcguaguccgccgguauggcucgcccgcaaggauacacaucgagaccgcccgagaaguaggcaaaucauucaaagaccgaaaagaaaucgagaaacggcaagaggaaaaccggaaggaccgagagaaggcagcggccaaguuccgcgaauacuuccccaauuucgucggagaaccaaagagcaaagacauacugaaacuucgccuauacgagcaacaacacggcaagugccuauacagcggcaaagagauaaaccugguccgacucaacgagaaaggauacgucgaaaucgaccacgcccuaccauucucccgaaccugggacgacuccuucaacaacaaggugcuaguacugggcucagagaaccaaaacaaaggaaaccaaacccccuacgaauacuuuaacggaaaagauaacagccgcgaauggcaagaguucaaagcaagaguagagacauccagauucccgagauccaagaaacagcgaauauuacuacaaaaauucgacgaagagggcuucaaagaaagaaaccucaacgacacacgauacgucaauagauuccuaugccaguucguagcggaccacauacuucuaaccggaaaaggaaaacgacgcguguucgccagcaacgggcaaauaacaaacuugcuacgaggauucuggggacuacguaaagugcgcgccgaaaaugaccgccaccaugccuuggacgcuguagucguggcauguucgacgguagcgaugcaacagaaaaucacacgguuuguccgguacaaagaaaugaacgccuuugacgggaaaaccauagacaaagagaccggagagguccuccaccaaaaagcccacuucccccagccaugggaauuuuucgcacaggaagucaugaucaggguauucggcaaacccgauggaaagcccgaguucgaagaagcggacacccccgaaaaacugcggacacuccuagcagaaaaauuaucaagccgcccggaagcaguacacgaauacgucaccccgcuauucgucagccgcgcacccaaccgcaaaaugagcggacaaggccacauggaaaccgucaaguccgcaaagagacuagacgaaggaaucagcguccuccgcguaccgcucacccaacucaagcucaaaggucucgagaaaaugguaaaccgggaacgcgaaccaaaacucuacgacgcccucaaagcccaacuugaaacccacaaagacaaccccgcgaaagcguucgcagaaccauucuacaaauacgacaaagccggcaaccgaacacagcagguuaaggcaguccgaaucgaacaaguacaaaagaccgguguaugggucagaaaucacaauggcauagccgacaacgccacaauggugcgcgucgacguguucgagaagggcggcaaguacuaucuaguacccaucuacagcuggcaagucgccaagggcauacuaccagaccgagccgucguugcauuuaaagacgaagaggacuggacagugauggacgacuccuucgaguuccgauucguccuuuacgcaaacgaccuaauaaagcuaaccgcaaagaaaaacgaguuccucgguuacuucgugucccugaauagagcgaccggcgcgaucgacaucagaacccaugacaccgauagcacgaaaggcaaaaacggcauauuccagagcguaggcgucaaaaccgcccucagcuuccagaaaaaccaaaucgacgaacuaggcaaggaaauacgccccugccggcuaaagaagcgacccccagugcgauga

SEQ ID NO: 6190 - RNA, 3249 nt, Artificial Sequence
  Cas9 variant
auggcagcguuuaagcccaacccaauaaacuacauacucggccucgacaucgggaucgcauccgucggcugggcaaugguggagauugacgaggaagaaaaccccauuagacugauagaccugggaguaagggucuucgagcgggcagagguccccaaaaccggggauagccuagcaauggcacgcagacucgcccgcagcguacgaagauugaccagacgcagagcgcauagacuccuccgcgcgcgacgucuauuaaaaagagaaggcguucuccaggccgcagacuucgacgaaaacgggcugaucaaaucacucccaaacaccccauggcaauugagagccgccgcacucgaccgcaaacugacaccacucgaguggucugcgguacuacuucaccuaaucaaacaccgcggcuaccucucgcaacgcaaaaacgagggggaaacagcagacaaagaacuaggcgcgcuucugaagggggucgccaacaacgcacacgcccuucaaacaggcgauuucagaacccccgcugaacuggcccucaacaaguucgaaaaagaaagcggccacauccgcaaccaacggggcgacuacucacacaccuuuucacgcaaagaccugcaagccgaacucauccuacuauucgaaaaacaaaaggaguucgguaacccccacguaucaggcggccugaaagagggcauugaaacgcucuugaugacgcaacgacccgcccuauccggcgacgccguccagaaaaugcuuggacacuguacguucgagcccgcggagcccaaagcagccaagaacacauacaccgcagaaagauucauaugguuaacgaagcucaauaaccugcgcauacucgaacaaggaagcgaacgcccacuaaccgacaccgaacgugcaaccuuaauggacgaacccuaccgcaagagcaaacuuacguacgcacaagcccgcaaacuccucgggcuugaagacacugcauucuucaaaggccuacguuacggcaaagacaacgcagaagcaucaacucuaauggaaaugaaagcauaccacgccaucucacgagcccucgaaaaagaagggcucaaagacaagaaaucgccacucaaccucagcucggaacuacaagacgagauagggacugccuucucccucuucaaaaccgacgaagacauaacaggccgccuaaaagaucgcguccaaccggaaauccuggaagcccuccucaagcacauauccuucgacaaguuuguacagauaucgcuaaaagcgcuccgccggaucgugccacuaauggagcaaggaaaaagauacgacgaagcaugcgcugaaaucuacggagaccacuauggcaaaaagaacacagaagagaaaauauaccuucccccaauccccgcagaugaaauacgaaacccaguuguacuccgggcacucagccaagcacgcaaaguaaucaacggagucgucagacgcuacggaagcccagcacggauccacauagaaacagcacgcgaagucggaaagucauucaaggaccggaaagagauagaaaaacgccaagaagaaaaccgcaaagaccgcgaaaaagcggccgcaaaauucagggaauacuuccccaacuucgucggcgaaccgaaauccaaagacauacugaagcuaagacucuacgagcagcaacacggcaagugcuuguacucaggcaaggaaauaaaccuaguccgccugaacgaaaaaggcuacguagagaucgaccacgccuugcccuucucacgcacaugggacgacucguucaacaauaaaguccucguccugggauccgaaaaccaaaacaaaggaaaucaaacccccuaugaauacuucaacgggaaagacaacuccagggaauggcaagaguucaaagcgcgcguagagacaagccgcuucccacgaagcaagaaacaacgcauauuacuucagaaauucgacgaagacggauucaaagaaugcaaccuaaacgacacaagguacguaaacagguuucuaugccaauucgucgcagaucacauccuccugaccgggaagggcaaacgacgaguauucgcaucaaacgggcagaucacaaaccuucuaagaggcuucugggggcuacgaaaagugagggccgaaaacgaccgacaccacgcccucgacgccguagucguggccugcagcaccguagccaugcaacagaaaauaacuagauucguacgguacaaagaaaugaacgccuucgacggaaaaacuaucgacaaagaaaccggcaagguccugcaucagaaaacacacuucccacaacccugggaauuuuucgcgcaagaagucaugauacgagucuucggaaaaccggacggcaagccugaauuugaagaagcugacacgcccgaaaagcuacggacgcuauuagcggagaagcucucaagcagacccgaagcgguucacgaguacguaacaccgcuauucgugagccgcgcacccaacagaaaaaugucaggucaaggccacauggaaaccgucaagucagcaaaacgacuagacgagggcgucucaguacuacgagucccgcugacucaacucaaacucaaagaccucgaaaagauggugaacagagaacgagaaccuaagcucuacgaagcucugaaggcgcgccucgaagcccacaaagacgaccccgccaaagcauucgcugaacccuuuuacaaauacgacaaggcagggaaucgaacacagcaaguaaaagcuguccgagucgaacagguucaaaagacagggguauggguccgaaaccauaacggaaucgccgacaacgcaacaaugguccgcguagacguauuugaaaaaggugacaaguacuaccucgugcccauauacagcuggcaaguagcaaaagggauacuccccgaccgcgccguaguccaaggaaaagacgaggaagacuggcaacuaaucgacgacagcuucaacuucaaguucagccuacacccuaacgaccuaguagaagugauaacgaaaaaggcccgaauguucggcuacuucgccagcugccaccgugggacggggaacauaaacauccgcauacaugaccuggaccacaaaaucgguaaaaauggaauacucgaaggaauaggagugaaaacagcccucucauuccaaaaguaccaaaucgacgaacuuggaaaagagauacguccgugcagacugaagaagcgacccccagugagauga

SEQ ID NO: 6191 - RNA, 3249 nt, Artificial Sequence
  Cas9 variant
auggcggcauucaaacccaaucccauaaacuacauccucggccuagacauaggcaucgccuccguaggcugggcaauggucgagauugacgaagacgaaaacccaaucugccugauagaccuagguguacgggucuucgaacgcgcagaagucccgaaaacuggagacagccucgccauggcccgaagacuagcgagaucagugaggcgacucacaagacgccgcgcacaccggcuacuacgcgccagacgacuacuaaaacgagagggaguccugcaagcagccgacuucgacgaaaacggccucaucaaaucccucccgaacacacccuggcaacuacgagcggccgcacuagaccgaaaacucacaccacucgaguggucagcaguacuccuccaccucaucaaacaccggggauaccuaucacaacgcaaaaacgagggcgagaccgccgauaaagaacuaggugcacuccucaagggggucgcagacaacgcacacgcccuucagaccggcgacuuccgcaccccagccgaauuagcccuaaacaaauucgagaaggaaucuggccacauccgaaaccagcgcggagacuacucccacacauucagccguaaagaccuacaggccgaacucauccuucucuuugaaaaacaaaaggaguucggaaacccgcacgucagcggcggccuaaaagaagguauagaaacgcuacucaugacccaacgacccgccuugagcggcgacgcgguacaaaagaugcuaggacacugcaccuucgaaccagccgagcccaaagcggccaagaauaccuacaccgcagaacgauucaucuggcucaccaaguuaaacaaccucagaauacucgaacaaggaucagagcgaccccuaacggacaccgaacgugcaacauuaauggacgagcccuacagaaaaucaaagcuaacauacgcacaagcacgcaaacuacugggcuuagaagacaccgcguucuuuaaaggacuacgcuacggcaaggacaacgccgaggcaucaacucuaauggaaaugaaagcauaccacgcuauaagcagagcgcuagagaaagagggauuaaaagacaagaaauccccacugaaccuaucgccggaacuacaggacgaaaucgggaccgccuucucgcuguucaaaacggacgaggacauaaccgggagacugaaggaccgcauccaaccagaaauacuagaagcccuccuaaaacacaucucguucgacaaauuuguccaaauaucauugaaagccuuacgccgcaucgugccacuaauggagcaaggcaagcgauacgacgaggcaugcgcagaaaucuacggagaccacuacgguaagaaaaacacggaagaaaagaucuaccuaccacccauacccgcugacgaaauacggaacccaguaguacuccgagcccuaucccaagcuagaaaaguaauaaacggaguagucaggagauacggcucuccugcucggauacacaucgagaccgcccgcgaagucggaaaauccuucaaagacaggaaagaaaucgaaaagcgacaagaagagaauaggaaagaccgcgaaaaagcagcagccaaauuccgggaguauuuccccaacuucgugggcgagccuaaaaguaaggacauccugaaacucagacuuuacgaacaacaacauggaaaaugccuauauuccggcaaagaaauuaaccucgggagacucaacgaaaaaggcuacguggagaucgaccacgcacuccccuucagccgaacaugggacgacuccuucaauaauaaaguccucguccuaggaucagaaaaccagaacaaaggcaaccaaacccccuacgaauauuucaacgguaaggacaacucccgagaauggcaagaguucaaagcaaggguagaaaccagccgauucccccgcagcaagaaacaacgcauacuccuucaaaaauucgacgaagacggcuucaaagaacgcaaccucaacgacacacgauacgucaaucgauuccucugccaauucguggccgaccgaaugcgacugacaggcaaagguaagaagaggguauucgccuccaauggccaaaucacuaaccuacuccgcggauucuggggccuccgaaaaguacgagcagaaaacgaccgccaccacgcacuagacgccguagucguagccugcagcacaguugccaugcaacagaaaaucacgcguuucguacguuacaaggaaaugaacgcauucgacgguaagacaaucgacaaagaaacaggagaaguccuccaccagaaaacccauuucccacaacccugggaguucuucgcacaagaaguaaugaucaggguguucggaaaaccagacggaaaaccggaguucgaagaagccgacacaccugaaaaacuucgaacgcuccucgcggaaaagcucucaucucggcccgaagccguccacgaauacguuacaccccucuucguguccagagcgcccaacagaaaaaugucagggcaaggacauauggaaaccgucaaaagcgcaaagcggcuagacgaaggcgucuccguccuacgcguaccgcuaacccaacucaaauuaaaagacuuagagaaaauggugaacagagaacgagaaccaaaacuguacgaagcccuuaaagcacgccucgaagcgcacaaagacgacccagcaaaagcauucgcagaacccuuuuacaaguaugacaaagcgggcaaccggacucagcaagucaaggcagugcgaguggaacaaguucagaaaacaggagucuggguccggaaccacaacggcauugccgacaaugcaacaauggucagggucgacguauucgaaaaaggggacaaauacuaccucguccccauauacuccuggcaagucgcaaaagggauccucccagauagggcaguuguccaaggcaaagacgaagaagauuggcagcucauagacgacagcuucaauuucaaguucucacuccaccccaacgaccucgucgaagucaucacaaagaaagcacgaauguucggguacuucgcauccugccacagagggacugggaacaucaacaucagaauccacgaccucgaccacaaaaucgggaaaaacggaauccuagaaggaauaggagucaaaacagcccugaguuuccaaaaauaccagaucgacgaacucggugaagaaauaaggccaugucgacuaaagaaacggccacccgugcgauga

SEQ ID NO: 6192 - RNA, 3249 nt, Artificial Sequence
  Cas9 variant
auggcggcguucaaaccaaacccaaucaacuacaucuuaggguuagacaucggaauagcaagcgucggaugggcaaugguggaaaucgacgaagacgaaaaccccaucugccuaauagaccugggaguucggguuuucgagcgagcggaaguccccaagaccggagacagccucgcaauggcccgccgacucgcgcgcagcguacgacgacuaaccaggcgcagagcccaccgacuacuccgcgcacgucggcuccucaagcgagagggaguccuccaagcggcagacuucgacgagaacggccugauaaaaagccuuccgaacacaccguggcagcuacgcgcagcagcccucgaccgcaagcuaaccccgcuagagugguccgccguccuccugcaccuaaucaaacaccgaggguaucuaagccaaagaaagaaugaaggcgaaaccgcggacaaggaacuaggcgccuuacucaagggcguagcagacaacgcccacgcccuacaaacgggcgauuucagaacccccgccgagcuagcgcucaacaaauucgaaaaagagagcggacacaucaggaaccagaggggcgauuacucacacaccuucucaagaaaagaccuccaagccgaacucauacuacuauucgaaaaacaaaaggaguucggaaacccccacgucucaggaggcuuaaaggaagggauagaaacccuacuaaugacacagagacccgcgcuaaguggcgacgcaguccagaagaugcucggccauugcaccuuugaacccgcagaacccaaagccgccaagaacaccuacacggcagaacgcuucaucuggcuaacaaaacucaauaaccuacgcaucuuggaacaaggaagcgagcgcccacugaccgacacagaaagagcaacccugauggaugaacccuaccgcaagagcaaacugaccuacgcgcaagcccgaaagcugcucggacuugaagacacagcguucuucaaaggucuccgguacggaaaggacaacgcugaagcgagcacacucauggaaaugaaggcauaccacgccaucucgcgcgcucucgagaaagaaggauuaaaagacaaaaagagcccccuaaaucuaucaccagaacuacaagacgagaucgguaccgccuucucacucuucaaaacggacgaggauauaacggggaggcugaaagaccggauacaaccagaaauacucgaagcacugcucaagcacaucuccuucgacaaauuuguccaaauaucccucaaggcccuccgucgaaucguaccacucauggaacagggcaaaagauacgacgaggccugcgcagaaauauacggagaccauuacggaaagaaaaacaccgaagagaaaaucuaccuaccaccgaucccugcagacgaaauccgcaaccccgucguacucagggcccucucacaggcacguaaagugauaaacggcguuguaagaagauacggaagcccagcacgcauacacauagaaaccgccagagaagugggcaagagcuucaaagaccgaaaagaaauagaaaaacgacaagaagaaaaucgcaaagaccgagaaaaagccgccgcgaaauuucgcgaguacuucccuaacuucguaggcgaaccaaaaagcaaagacaucuuaaaacucaggcuauacgaacaacaacacgguaaaugccuuuacucaggaaaagaaaucaaccuaggcaggcucaacgaaaaaggcuacguggagauagaccacgcgcuaccauucucccgcacaugggacgauucauucaacaacaagguccuuguauuaggaagcgagaaccagaauaaagggaaccaaacaccuuacgaauacuucaacggaaaagacaauucacgcgaauggcaagaguuuaaagcccgcgucgaaacgagucgauucccccggaguaagaaacaacgaauccuacuccaaaaauucgacgaagacggauucaaagaaagaaacuugaacgacaccagauacguaaaccgcuuccucugccaauucgucgcugaccgaaugcgacugacgggcaaaggaaagaaacgggucuucgccagcaacggucagauaacaaaccuccugcgcgguuucuggggccuacgaaaagucagagcggaaaacgacagacaccacgcgcuagacgcaguaguugucgccugcagcaccgucgccaugcagcagaaaauaacgagauuuguccgauauaaggaaaugaacgcauucgaugggaaaaccaucgacaaagaaacaggagaaguccuucaccaaaagacccacuucccccagccaugggaguucuucgcccaagagguaaugauccgcguguucggcaaaccagacggcaaaccagaguucgaggaagcagacaccccggagaaacuacgcacccuccuggcagaaaagcucuccucacggccagaagccguccacgaauacguaacgcccuuauuugucagccgcgcgccgaaccgcaaaaugagcgggcaaggacacauggagacggucaaaagcgcuaaaaggcucgacgaaggggucucaguacuccgcguaccgcugacgcagcuuaaacugaaagaccuagaaaagaugguaaaccgagaacgugagcccaaacuuuacgaggcacugaaagcgcgacuggaagcacacaaagacgauccggccaaggcauucgccgagccauucuacaaguacgacaaggcaggaaaccgcacacagcaagucaaggccguaagaguagaacaaguacagaaaaccggcguaugggugcgcaaccacaacggaaucgcagauaacgccacaaugguaagagucgacguuuucgaaaaaggggacaaguauuaucuaguccccaucuacaguuggcaaguagccaaagggauacuccccgaccgggcaguagugcaaggcaaggacgaggaagacuggcaacucauagacgauucauucaacuuuaaguucagccuccacccgaacgaccuaguggaagucauaaccaagaaagccagaauguucgguuacuucgcaagcugccaccgaggaacggguaacaucaacauacgaauacacgaccucgaccacaaaaucggcaaaaacggaauacuagaaggcauaggagugaagaccgcccucagcuuccaaaaguaccagauagacgaacuaggaaaagaaauacgaccaugucgauuaaagaaacgacccccagugagguga

SEQ ID NO: 6193 - RNA, 3249 nt, Artificial Sequence
  Cas9 variant
auggcagcguucaaacccaacccaaucaacuacauacuagggcucgacauaggcaucgccagcguaggaugggccaugguugaaaucgacgaagacgaaaaccccaucugccuaaucgaccuaggcguacgcguauucgagagagccgaaguccccaagaccggggacucacuagcggccgcccgcagacuagcccgcagugucaggaggcuaacccgaagacgugcgcaucggcuccuaagagccaggcggcuccuuaagcgagaagggguacugcaagccgccgacuucgacgaaaauggacucauaaagagccuacccaacaccccauggcaauuacgcgcagccgcccuagaccggaagcuaacgccccuagaauggucugcaguccuacugcaccuaauaaaacacagaggauaccuaucacaacggaaaaacgaaggagaaaccgcagacaaagaacucggagcacuccucaagggaguagccgacaacgcccacgcccuccaaaccggggacuuccgaacgccagcagaacuagcccuaaacaaauucgaaaaagaauccggccauauaaggaaccagcgcggcgacuacucccacaccuuuuccaggaaagaccuucaagcggaacugauucugcuauucgaaaaacaaaaagaguucggcaacccacacgucucgggcggccucaaagaaggaauagaaaccuuacucaugacacaacgucccgcacucucaggcgacgcagugcaaaagaugcucggccacugcacauuugaaccggccgagcccaaagcagcgaaaaacacauacacagccgaacguuuuaucuggcucacaaaacuuaacaaccuaagaauacucgaacaaggauccgaacgcccacuaacagacacagaacgcgcaacccuaauggacgaacccuaccgcaaaagcaaacugacguaugcccaggcccgcaagcuccucggccuggaagacaccgccuucuucaaaggccugcgcuacggcaaagacaacgcagaagcgaguacccuaauggaaaugaaagccuaccaugcaaucagcagagcucuagaaaaggaagggcucaaggacaagaaaagcccgcugaaucuaagccccgaacuacaagacgaaauaggcacagccuuuagucuauucaaaaccgacgaagacauaaccggccgacucaaagacagaguccaaccugaaauccucgaagcccugcugaaacacaucagcuucgacaaauucguccaaaucagccucaaagcacuccgacgcaucgugccacugauggaacaaggcaaacgauacgacgaagcaugcgccgaaauauacggagaccauuacggaaagaaaaacaccgaggagaaaauauaccucccuccuaucccagcggacgaaaucagaaacccaguaguucuucgggcacuaucacaggcacgaaaagucauaaauggaguaguaagacgcuacggaucaccggcccgaauccacaucgagacagcucgggaaguaggcaaaucguucaaagaccguaaagaaauagaaaagcgccaagaagaaaacagaaaagacagagaaaaagcugcagccaaauuccgggaauacuucccaaacuucgugggagaaccuaaaucaaaagacauauuaaaacuaagacuguacgagcaacagcacgguaaaugccucuacagcggaaaggaaaucaaucuaggcagacuaaacgaaaaaggauacgucgagauagaccacgcucucccguucuccagaacaugggacgacagcuuuaacaacaaaguccuaguccuugguagcgaaaaucagaacaagggaaaccagacgccauacgaauacuucaacggcaaagacaacuccagagaguggcaagaguucaaggcaagaguagaaaccucccgauucccacgcucaaagaaacagagaauacuacuccaaaaauucgacgaagacggcuucaaagaacgaaaccuaaaugauacacgcuacgugaaccgcuuccucugccaauucguugccgaccgaaugcggcuaacgggaaaagggaagaaaagaguauucgccagcaacggccaaaucaccaacuuacugcgcggauucuggggauuacgaaaaguacgagccgagaacgaccgccaccacgcguuagacgcagucguuguggcaugcagcacggucgccaugcaacaaaagauaacccgcuucgucagguacaaagagaugaacgcguucgacggcaaaaccauagacaaagaaaccggagaaguacugcaccagaaaacucacuucccacaacccugggaauuuuucgcacaagaggucaugauaagggucuucggaaaaccggacggcaaaccggaguucgaagaagccgacacaccagagaagcuccgcacccuccuggcagagaagcuaucaagucggcccgaagcaguccacgaauaugucacuccccuauuugucagccgcgccccaaaccgcaagaugagcggacaaggucacauggagacagucaaauccgcaaagcgccucgacgagggcguaucggugcuaagaguaccccucacccaacuaaaacucaaagaucuugagaaaaugguaaacagagaaagagaacccaaacucuaugaagcgcuaaaagcccgccuugaagcgcacaaagacgacccagcuaaggccuucgcggaaccguucuacaaauacgauaaagccggaaacaggacccaacaagucaaagccgugaggguagaacagguacagaaaaccggggucuggguccggaaccacaacggaaucgccgacaaugccaccaugguaagagucgacguauucgaaaaaggcgacaaauacuaccucgucccuaucuacagcuggcagguagccaaaggcauacuccccgaccgcgcaguaguacagggcaaagaugaagaggacuggcaacuaauagacgacuccuuuaacuucaaauucucccuccaccccaaugaccuagucgaagucaucacuaagaaagcacgaauguucggguacuucgccuccugccaccgcgggaccggaaacauaaacauacgcauccacgaccuggaccacaaaauagggaaaaacgguauacucgagggcaucggggucaaaaccgcccuguccuuccaaaaauaccaaaucgacgaacuaggcaaagaaaucaggccgugccgacuaaagaaacgaccucccguccguuga

SEQ ID NO: 6194 - RNA, 3249 nt, Artificial Sequence
  Cas9 variant
auggcagcguucaaacccaaccccaucaauuacauacucggcuuagacauaggcauagccucggucggaugggccauggucgaaauagacgaggaggaaaaccccauacgacucaucgaccuaggggugcgaguauucgaacgggccgaaguccccaaaacgggcgacagucuugcaauggccagaagacucgcacggagcgucagaagacugacccgccgacgugcccacagacuacucagaacaaggcgccuacucaaaagggaagggguccuucaagcagcaaacuuugacgaaaacggccucauaaaaagucuccccaacacacucuggcaauugcgggcagcagcacuagaccgaaaacugacgccccucgagugguccgcaguacuccuccaucucauaaaacaccgcggguaccucucccaacgcaaaaacgagggcgagacugccgacaaagaacuaggagcccuacuuaaagguguagcaggcaacgcucacgcacuacaaaccggagacuuccgaacacccgcagaacuggcccuuaacaaguucgagaaagagagcggacacauccgcaaccaaagaggggacuauucucauacauucagccgcaaagaccuacaggccgagcuaaaccuacuauucgaaaaacaaaaagaguucgggaacccgcacauaagcgacggccuaaaagagggaauagaaacccuacucaugacccagcgaccagcgcuuucaggcgacgcuguccagaaaaugcuagggcacugcaccuucgaaccaacggaacccaaagcggccaaaaauacauacacgaccgaacgauucauauggcucacaaagcucaacaaccuaagaauccucgagcaaggguccgagcgcccgcuaacggacaccgaacgggcaacgcuaauggaugagccuuacagaaagagcaaacuaaccuacgcacaagcccgaaaacugcucgaacuagacgacauugcauuuuucaaaggccuccgcuacggcaaagauaacgcagaggccucgacacucauggaaaugaaagccuaccacgcaaucucacgagcacucgaaaaagagggccuaaaagacaagaaaagcccacucaaccuauccccagaacuccaagacgaaauaggcaccgccuucagucuuuucaaaacagacgaagacaucacagggcgcuugaaagaccgcauccaaccagaaauacuagaagcgcuacugaaacacauuaacuuugauaaauucguccaaaucagccucaaggcccuccgacgaaucguuccccucauggagcaaggcaaaagauaugacgaagcaugcgcagaaauuuacggagaccacuacggaaagaaaaacaccgaagagaaaauagaccucccaccaauacccgccgacgaaauacacaacccugucguuuuacgcgcacucagucaagcacggaaaguaaucaacggcgucguccgccgguacggaucacccgcgaggauucacaucgaaaccgcacgagaaguggguaagagcuucaaagaccgaaaagaaaucgaaaaacgccaagaggaaaaccguaaagacagagaaaaagcagcagcaaaguuccgcgaauacuucccaaacuucgugggcgaacccaaguccaaagacauccuaaagcugcgacucuacgaacagcagcacggcaaaugccuauacucaggcaaggaaaucaaccuaggcaggcucaaugaaaaaggguacgucgaaauagaucacgcccuacccuucucucgcaccugggacgacagcuucaacaacaaagugcucguccucgguuccgaaaaccaaaacaaaggaaaccaaacaccauacgaauacuucaacgggaaagacaacucucgcgaauggcaggaguucaaagcucgcguagaaaccucccgguuuccgcgaucaaagaaacaacggauucuccuccagaaauucgacgaggacggguucaaagagcgaaaccucaacgacacuagauacgucaaccgcuuccucugccaguucguagccgaccgcaugcggcucacgggcaaaggaaagaaacgaguguucgcguccaacggccaaauuaccaaccuccuacgaggguucuggggccuccgaaaaguaagagccgagaacgaccggcaccaugcacucgacgcaguagucgucgcaugcuccaccgucgcaaugcaacagaaaauaacacgcuucguacgcuacaaagagaugaacgccuucgacggcaaaacgaucgacaaagaaaccggcgagguguuacaucagaaaacccacuucccccaacccugggaguucuucgcccaagaaguaaugauucgaguauucgguaaaccagacggcaaaccagaguucgaggaggccgauacacccgaaaaacuacgaacccuacucacggaaaaacuaagcuccaggccagaggccguacacgaauacgucacaccccuguucgucagccgcgcacccaaucgaaaaaugagcggacaaggucacauggaaaccgucaaauccgccaaaagacuagacgaagggaucagcguacuaagagucccauuaacgcaauuaaaacucaaagaccuggagaaaauggucaaccgggaacgggaacccaaacuauacgaagcccucaaagcacgucucgaagcacauaaggacgacccggccaaagccuucgccgagccuuucuauaaauacgacaaagccggcaacaggacccaacaaguaaaagcgaugcgugucgaacaaguacaaaagacuggugugugggugcgaaaccacaacggaauagcggacaacgcgaccauggugagagucgacguauucgaaaaaggcgauaaauacuaccucguaccgaucuauagcuggcaaguagccaaaggcauacuaccggaccgcgcagucguccaaggaaaagaugaggaggacuggcaacucauagacgacucauuuaacuucaaauuuucccugcaccccaacgaccucguagaggucauaacgaaaaaggccagaauguucgguuacuucgcaagcugccaccgcggcacaggcaacaucaacauucgcauccacgaccucgaucacaaaauaggcaaaaacggaauccuagaaggaauaggcguaaagacagcgcucucguuccaaaaauaucaaauagacgaauuaggaaaagaaaucagaccguguagacuaaagaaacgaccacccguccgcuga

SEQ ID NO: 6195 - RNA, 3249 nt, Artificial Sequence
  Cas9 variant
auggccgccuucaaacccaacccaauaaauuacauacucggccuagacaucggcauagcgagcgucggcugggccauggucgagaucgacgaagacgaaaacccgaucugccucaucgaccuagggguacgcgucuucgaacgggccgaaguacccaaaacuggggacagccuugccauggcacgacggcucgcucgcuccguaagacgauuaacacgcagacgugcacaccgauuacuccgagcgcgacgucuccugaaacgggaaggcguacuacaagcagcggacuucgacgaaaacggcuuaauaaaaagccuuccgaacacacccuggcaacuacgcgcagcagcccuugacagaaaacuaacaccccuugaaugguccgcggugcuauuacaccugauaaaacacaggggauaccuaucacagaggaagaacgaaggagaaaccgcagacaaagaacucggcgcccuccucaaagggguagccgacaacgcacacgcacugcagacuggagacuuccgaacccccgcagagcuagcacuaaacaaauucgagaaggaaucaggccacauacggaaccagagaggagauuacucccacaccuuuucccgcaaagaccuccaagcggaacugaaccuccucuucgagaaacaaaaagaguucggaaacccgcacaucucagauggacuuaaggagggaaucgagacccuucucaugacccaaagacccgcacuaucaggagacgccguccagaaaaugcuaggacacugcaccuucgagccggccgaacccaaggccgccaaaaacacauauacagcagagcgcuucauaugguuaacuaaacucaauaaccuccgaauccuagaacaaggcuccgaaagaccacucacugacaccgaacgcacgacacucaucgacgagccuuacagaaaaucaaaacucacauacgcacaagcaagaaaacuccucgaacucgauaacacagcauucuucaaagggcuacgguacggaaaagauaaugccgaagcgucgacccucauggaaaugaaagccuaucaugccaucucacgagcccuggaaaaggagggacuaaaggacaagaaaucgccccucaaccuaucccccgaacuccaagacgagauaggaacagcauucucgcuauucaaaaccgacgaagacaucacgggccgacuaaaagaccgcguacaacccgagauacuggaagcacuacugaaacacaucucuuucgacaaauucgugcagauaagccuaaaagcacuacgaaggauaguaccacuaauggaacaagguaaacgcuacgaugaggcuugcgccgaaaucuacggcgaccacuacggcaaaaagaacacggaagagaaaaucgaucuaccaccaaucccagccgaugaaauccgaaauccugugguacuccgcgcacucucccaagcccgaaaagucaucaauggcgucguccgccgcuacggcagcccggcccgcauccacauagaaaccgcccgggaagucggaaagagcuuuaaagaccgcaaagaaaucgaaaagcgccaagaagaaaaccgcaaagaccgcgaaaaggccgcaaccaaauuccgcgaauacuucccaaacuucgucggcgaacccaaaagcaaagauauacugaagcugagacuauacgaacaacagcauggaaagugccuauacagcggaaaggaaauaaaccuaggacgacucaacgaaaagggauacguagaaaucgaucaugcacucccauucagcagaacaugggacgauucauucaacaacaaaguccuaguacugggcucagaaaaccaaaacaaaggcaaucaaaccccauacgaauacuucaacggaaaagauaauucgagagaauggcaagaguucaaagcuagaguggaaaccagcagauucccaagauccaaaaagcaaagaauacugcuucagaaauucgacgaagaaggcuucaaggaacgaaaccuaaacgacacccgcuacguaaacagauuccugugccaauucguggcggaccauaugcuccuaaccggcaaaggcaaacgccgcguauucgcauccaacggacaaaucaccaaccugcuacgcggcuucuggggccucaggaaagugcgagcagagaacgaccgccaucacgcacucgacgccgucgucguagcaugcucgaccguugcuaugcaacagaaaaucacgcgcuucguacgcuauaaagaaaugaacgccuucgacggaaaaacaaucgacaaagaaaccggcgagguccuacaccagaaaacccacuucccccaaccaugggaguucuucgcccaagaaguuaugauccgcgucuucgguaaaccagacggaaagcccgaguucgaagaagccgauacccccgaaaaacuacgcacacuccuagccgaaaaacuaagcucccgccccgaagcaguacacgaauacgugacaccccucuucgugucacgcgccccaaaucgaaaaaugagcggacaaggacacauggagaccguaaagagcgccaaacgacucgacgaaggcgucucaguccuccgggucccacucacgcaacucaaacucaaagaccuggaaaagaugguaaaccgcgagcgcgagcccaagcuauacgaagcauuaaaagcccgccucgaggcccauaaggacgacccggcaaaggcauucgcggagccauucuacaaauacgauaaagcaggaaacaggacacaacaagugaaagcgguacgaguggagcaaguucagaaaacgggcgugugggugcgaaaccacaacggcaucgcagacaacgcaaccaugguccgcguagacgucuucgagaaaggcgacaaguacuacuuaguaccaauauacagcuggcaagucgcgaagggcauucuaccagacagagcaguagugcaaggaaaagacgaagaagacuggcaacucauagaugacagcuucaacuuuaaauucucccuacaccccaacgaccucguagaaguuaucacaaagaaagcccgaauguucggguacuucgcaagcugccaccgcgguaccgggaacaucaauauacgcauacacgaucuggaccacaaaauagggaaaaacggcauucuggaaggcauaggcgucaaaaccgcgcugucauuucaaaaauaccaaauagaugaacucgguaaagaaauacgccccugccggcuaaagaaacgcccaccagucagauga

SEQ ID NO: 6196 - RNA, 3249 nt, Artificial Sequence
  Cas9 variant
auggcagcguucaagcccaacccgaugaacuacauccuaggauuagacaucggaaucgcaagcguaggcugggcaaucguagaaauugacgaagaagagaacccgaucaggcucauagaccugggcguccgagucuucgaacgggccgaagucccgaagaccggagacucacuggccgcagcacgccggcuggcgagaucgguacgcaggcuaacgcgccgacgugcacacaggcuacugcgagcaagacgucugcuaaagcgagagggaguacuccaagccgcugacuuugacgagaacgggcugauaaagagccuccccaacaccccauggcaacuccgcgccgcagcacuagaccggaaauuaaccccacuagaauggagcgcaguccuacugcaccuaauaaaacaucgcggauaccucagccagcguaaaaacgaaggagaaacagccgacaaggaacuaggagcacugcuaaaaggcgucgcagacaacacacacgcacuccagacaggcgacuuccgaaccccagcagaacucgcacuaaacaaguucgagaaagagagcgggcacauccggaaucagcgaggagacuacagccacacauuuaacaggaaagaccuacaggcagagcuaaacuugcuauucgaaaaacaaaaagaguucggaaacccccacgugagcgauggccucaaagaaggaauagaaacgcuucucaugacccaacgcccggcacuaucaggugacgcaguccagaaaaugcucggacauuguaccuucgagcccacagagcccaaggccgcaaagaacaccuacacggccgaacgcuucguauggcucacaaaauuaaacaaccuacgaaucuuagaacaaggaagcgaaagaccccucacugacaccgaacgcgccacacucauggacgaaccauaccgaaaaagcaagcucacguacgcacaagcccgaaaacuguuagaccuagaugacaccgccuucuuuaagggacuacgcuacggaaaggacaacgcagaagcgagcacccucauggagaugaaggcuuaccacgccaucucacgcgcacucgaaaaggaaggccucaaagacaagaaaaguccucucaaccucuccccagaacuccaagacgagaucggaacggcauucagccuguucaaaacagacgaagacaucaccggacgccucaaagaccgcguucaacccgagauccucgaagcccuguuaaaacauaucucauucgacaaauucguacaaaucuccuugaaagcgcuaagacggaucgucccacugauggaacaagguaacagauacgacgaagcaugcacagaaauuuacggcgaccacuacggaaagaaaaacacagaagagaaaaucuaccugccgcccauaccagccgacgaaaucagaaaccccgucgugcuccgagcacucagccaggcaaggaagguaaucaauggagucgugcgacgcuacggcagucccgcccgcauucacaucgaaacggcacgagaagucggaaagagcuucaaagacaggaaggaaaucgaaaagcgccaagaagaaaauaggaaggaucgcgaaaaaucagcggcaaaguucagagaauacuucccaaacuucguaggggaacccaaaaguaaggacauacuaaaacuccgccucuacgaacaacaacacggaaaauguuuguacagcggcaaagaaauaaaccugggacgccucaaugagaaaggcuacgucgaaaucgaccacgcccuccccuucucucgaacuugggacgacagcuucaacaacaaaguccuggcacucggcagcgaaaaccaaaacaaagggaaccaaaccccauacgaauacuucaacggcaaagacaacucgcgcgaauggcaggaauuuaaagcacgaguagaaacaucccgauuccccagaucgaagaaacaacgaauccuccuacaaaaauucgacgaagacggcuucaaagaacggaaccuuaacgacaccagguacauaaacagauuccuaugccaauucgucgcugaccacauguuacugaccggaaaaggaaagcgccgcguauucgcuagcaacggccaaaucacaaaccuacucagaggcuucuggggacugcguaaagucagagcugaaaacgaccgacaccacgccuuggacgcaguggucguagccuguuccacuauagcuaugcaacagaaaaucaccagguucgugagauacaaagaaaugaacgccuucgacggaaaaacgaucgacaaagaaaccggcgaagugcuccaucaaaaggcccacuucccccaaccuugggaguucuucgcucaagaagucaugauucgaguauucggcaaaccagauggaaaaccggaguucgaagaagcggacacacccgaaaagcuccgaacccuacuagccgaaaaacugagcucucgacccgaagccguccacaaauacgucacgccacucuucaucagcagggccccgaaccgaaaaaugaguggacaaggccacauggagacaguaaaaucagcgaaaagacuggacgaaggcaucucaguacuacgaguaccccuaacccaacugaaacucaaagaccucgagaaaauggugaaucgcgaacgcgagcccaaacuauacgaagcccucaaagcccgacuagaagcccacaaggacgacccagccaaagccuuugcggaaccuuucuacaaauacgacaaagcaggcaacaggacgcaacaggugaaggccguacgcguagaacaaguccaaaagaccggggucuggguccacaaccacaacgggauagcggacaacgcgaccauaguacgcguggacguauucgagaaggguggcaaauacuaccuaguccccaucuacagcuggcaaguagccaaaggcauccucccagacagagcugucguacagggaaaagacgaagaagacuggacggucauggacgacuccuucgaguucaaauucguucuguacgcaaacgaucucaucaaacucacagccaaaaagaacgaguuccuaggcuacuucgugagucucaaccgcgccacaggagccaucgacauacgcacccacgacacagauagcacaaaaggcaaaaacggaauuuuccaaucaguaggaguaaaaaccgcccucucguuccaaaaauaccagaucgacgaacuaggaaaggaaaucagacccugccgacucaagaaacgaccaccuguucgcuga

SEQ ID NO: 6197 - RNA, 3249 nt, Artificial Sequence
  Cas9 variant
auggcagcauucaaaccaaacucgaucaauuauauccuagggcucgacauaggcaucgcgagcgucggcugggccauggucgaaaucgauaaagaggagaacccaaucagacuaaucgaccucggcguccgagucuucgaacgggccgaagugcccaagacaggcgauucccuugccgccgcgcggcgccucgcccgauccguaagaagacuaacccgccgcagggcccaccgacuccuacgcaccagacgccuacuaaaacgggaaggaguccugcaagccgcaaacuucgacaagaacggacucauaaaaucacuucccaauacacuauggcaacuacgagcagcggcccuggacagaaaacucacaccccuggaauggagugccgugcugcuacaccuaauaaaacaccgaggauaccucucacaacgcaaaaacgaaggcgaaacagcagacaaagaacucggcgcccuacucaaaggaguggcagggaacgcacaugcacuacagacgggugacuuucgaaccccugccgaacuggcgcucaacaaguucgaaaaagaaucaggccacauacgaaaccagagaggcgacuacucccacacguuuagccguaaagaccuccaagcggaacuaaaccugcuauucgaaaagcaaaaagaguucggaaacccccacauaucaggaggucuaaaagaaggaaucgaaacacuccucaugacacaacgaccggcccuuagcggggaugcaguacagaaaaugcugggccacugcacuuucgaaccgaccgagccaaaggcagcuaaaaacacauauacaaccgagagauucauuuggcugaccaagcuaaacaaccuccgcauccucgaacagggaagcgaacgcccccucaccgacaccgaaagggccacacucauggacgagccauaccgcaaaucgaaguuaacguacgcacaggcucgcaagcuccuaucccuagaggacaccgccuucuuuaaaggacuacgcuacggcaaagacaacgcggaggcuagcacgcucauggaaaugaaagccuaccacaccaucagccgagcccucgagaaggaaggacuaaaagauaagaaaagcccccuaaaccuaagcccggagcugcaggacgaaauuggcaccgcauucucacuguucaaaaccgacgaagacauaacgggcagacucaaagaccgcauacagccagaaauccucgaggcccuccucaaacacaucagcuucgauaaauucguccaaauaagccucaaagcccuucgccgcauagucccgcucauggagcagggcaaaagauacgacgaggcuugcgccgaaauauacggggaccacuacggcaagaaaaacaccgaagagaaaauauaccucccgccaauccccgccgacgaaauacgcaaucccguggugcuacgcgcacugucacaagcccguaaagucauaaacgggguggugcgaagauacggaagcccggcccguauacauaucgaaacagcaagagaaguuggcaaaucauucaaagaccgaaaagaaaucgaaaaacggcaagaagaaaaccgaaaagaccgagagaaagccgcggcuaaguuccgagaauacuucccgaacuuuguaggagaacccaaaucaaaggacauccuuaaacuacgacuauacgaacaacagcacggcaaaugccucuacagcggaaaagaaaucaaccucgucagacuaaaugagaaaggguacgucgaaaucgaccacgcccugcccuucagccgcaccugggacgacagcuucaacaacaaaguacuugugcuagguagcgaaaaccagaacaagggcaaccaaacaccauacgaauacuuuaacggcaaggacaacucgagagaauggcaagaguucaaagcccgcguugaaacgucacguuuuccaagaagcaagaaacaacgaauacuccuccaaaaauucgacgaagacggcuucaaagaacguaaccuaaaugacacaagauacgucaaccgcuuucucugccaauucgucgccgaccauauacugcucacaggaaagggcaaacgacgagucuuugcguccaauggacaaauaaccaaccuacuacgcggauucuggggacuccguaaaguccgagcggaaaacgaucgacaccaugcacucgacgcaguagucguagccugcuccacggucgccaugcaacagaaaauaacacgcuucguacgauauaaagaaaugaacgcauucgacggcaagaccauagauaaagaaaccggggaaguucugcaccagaaaacacacuuuccccaacccugggaguucuucgcccaagaaguaaugaucagaguauucggaaagccagaugggaaacccgaguucgaagaagcagacacgcucgagaaacuccgaacacuccuagcagagaaauugagcagccgccccgaggcaguacacgaauacguaacaccccuauuugugagucgagccccaaaccguaaaaugucaggccaaggccauauggaaaccgucaaguccgcaaaaagacuagacgagggaguaagcguacugcgcgugccacuuacccaacucaaacuaaaagaccucgagaaaauggugaaccgcgaacgugaaccaaaacucuacgaagcccucaaagccagacuagaggcacacaaagacgacccagcuaaagccuucgcagaaccguucuacaaauacgacaaggcaggaaaccgaacccaacaaguaaaagcuguccgcguugaacaaguacagaaaacgggcguauggguccgcaaccacaacgggauagccgacaacgccacaaugguccgggucgacgucuucgaaaaaggcgacaaauacuaucugguaccgauauacagcuggcaaguagccaaggguauacugcccgaccgcgccguaguccaaggaaaagacgaagaagacuggcaacucaucgacgacuccuucaauuucaaauuuucccugcacccaaacgaccuaguagaagucauaacaaagaaagcccgaauguucggguacuuugccagcugccacagaggcacgggaaacaucaacauacguauacacgaccucgaccacaaaauuggcaaaaauggcauccucgaggguauaggagugaaaaccgcacucuccuuccaaaaguaucagaucgacgaacuuggcaaagaaauacgaccgugcaggcuaaagaaacgacccccgguccgcuga

SEQ ID NO: 6198 - RNA, 3249 nt, Artificial Sequence
  Cas9 variant
auggccgccuucaaacccaaccccauaaacuacauccuaggacucgacaucggcaucgcaucagucggcugggccaugguggaaaucgacgaagaagaaaaccccauccgccuuaucgaccugggcguccgagucuucgagcgagccgagguccccaaaaccggagauucguuagccauggugcgcagacucgcacgcagcguccgccgauuaacaaggcgcagggcccacagacugcuacgcgcccggagacuccucaagagagaaggaguacuccaagccgccgacuucgacgaaaacggucugaucaagucccuacccaacacccccuggcaacuacgggcggcagcacuagaccggaaacucacgccacuggaguggagcgcagugcuucuacaccugaucaagcaccgaggcuaccucucacaaaggaagaacgaaggggagacagcagacaaagaacuuggagcccuccuaaaaggaguagcagacaacgcgcacgcguuacaaaccggagacuuccggacaccagccgaauuagcccucaauaaauucgaaaaagaaucaggccacauccgcaaccagcgcggggacuacucccacaccuucagccgcaaggaccuacaggcagagcugauucuccuauuugaaaaacaaaaagaguucgggaacccccacaucuccggaggacucaaagaaggcauagagacacuacuaaugacucaacgcccugcccugagcggggacgcaguacagaaaaugcuggggcacuguacguucgaaccagcggaacccaaagccgcaaagaacaccuacacugcggaaagauucaucuggcugaccaaacugaacaaccuccgaauacucgaacaaggcagcgagcgaccucucacagauacagaaagagccacccugauggacgaaccauacaggaaauccaaacucacguacgcccaggccagaaaguuacuaggacuugaagacacagccuuuuucaaaggccuacgguacgggaaagacaacgccgaagcaagcacccucauggagaugaaagccuaccacgcaaucagucgggcacuagaaaaggaaggccucaaagacaagaaauccccgcucaaucugaguccggagcugcaagacgaaaucggcaccgccuucagccuauucaaaacagacgaagacauuaccggaagacucaaagaccgaauccagccagaaauacucgaggcccuuuugaaacauauauccuuugacaaauuuguacaaauuagccugaaagcccuacgacguaucguacccuuaauggagcaaggcaagcgauacgaugaagccugcgccgaaauuuacggggaucauuacggcaagaaaaacaccgaggagaaaauuuaccugccacccauacccgcagaugaaaucagaaaccccgucguccugagagcccugagccaagccagaaaagucauaaacggagucguccgccgauacggcagcccagcgcgcauacacauagaaaccgcgagagaggucggcaaauccuucaaagaucgaaaagagauagaaaagagacaagaagaaaaccgaaaagaccgcgaaaaggccgcggccaaauucagagaauacuucccaaacuucguuggagaaccgaaauccaaagacauacucaaacuccgccuauacgagcagcaacacggcaaaugccuauacagcggcaaagaaaucaaucucggccggcuaaacgaaaagggcuacgucgaaaucgaccacgcccuacccuucagcaggaccugggacgacagcuuuaacaacaagguccugguccuaggcuccgaaaaucagaacaaaggaaaucaaacaccauacgaauacuucaacggaaaggacaacucccgagaauggcaagaguucaaagcccgcgucgaaacgagcagguucccccggagcaagaaacaacgaauacuccuacaaaaauucgacgaagacgguuuuaaggaacgaaaccuaaacgauacccgauacgugaaccgcuuccucugccaauucguggcggacaggaugcgacucacaggaaaaggaaagaaacgaguguucgcgaguaacgggcagaucaccaaccucuuaaggggauucuggggacugagaaaagucagagcggaaaacgacagacaccaugcccuagacgccgucgucguggcaugcagcacagucgcaaugcaacagaaaauaacacgcuucgucagguacaaagaaaugaacgcauucgacggcaagacaaucgacaaagaaaccggcgaaguccugcaccagaaaacgcacuuuccccaaccaugggaguucuucgcacaagaaguaaugauaagaguauucggaaagcccgaugggaaaccggaguucgaagaagcagacacaccagaaaaacuucgaacacugcucgcagaaaagcuauccucaagaccggaagcaguacacgaauacgugacaccccucuucguaucacgcgccccaaacagaaagaugagcggacaggggcacauggaaaccgucaaaagugccaaacggcucgacgaaggaguaucgguacuacgagucccccuaacucaacucaaacucaaagaccucgagaaaauggucaauagggaacgcgaacccaaacucuaugaagcgcuaaaggcgcggcuagaagcccacaaggacgaccccgccaaagccuucgccgagccauuuuacaaauacgacaaagccggcaaccgcacccaacaagucaaagccguccgagucgagcaaguacaaaagaccggcguauggguucgaaaccauaacggaauugccgacaacgccacaaugguacgagucgaugucuucgaaaaaggcgacaaauacuaccucguccccauauacagcuggcaaguggccaaaggcauccugccggaccgagcagucguacaagggaaagacgaagaagacuggcaacuaauagacgacuccuucaacuucaaauucagcuuacaccccaacgaccuaguagaggucaucaccaagaaagcaagaauguucggauacuucgcgucgugccaccgcgguacaggaaacaucaacauaaggauccacgaccuagaccacaaaauaggcaaaaacgggauacuagaagguauaggaguaaaaacggccuuaucauuccaaaaauaccaaauagacgaacucggcaaagaaauacgacccugccggcucaaaaagcgaccgcccgugagauga

SEQ ID NO: 6199 - RNA, 3249 nt, Artificial Sequence
  Cas9 variant
augagaguacuaggccucgaugccggcauagcgagccucggaugggcauuaauagaaaucgaagaaagcaaccgaggggaacugucgcaaggaacaaucaucggagcaggaacauggauguucgacgcacccgaagaaaagacgcaggccggagcaaaacuaaaaucggaacaacggagaacauucagaggccaacggagggucguacgaaggcggcgacaaaggaugaacgaggugagaagaauacuacacagucacggccuguuaccgagcucagaccgugaugcacuaaagcagcccggacuagacccauggcggaucagggcugaagcacuagacagauuacucgggccggucgagcuagcgguagcgcucgggcacauugcacgacaccgcggauucaaaagcaacaguaaaggggcgaaaaccaacgacccagcggaugacacaucgaagaugaagcgggccguaaacgaaacccgggaaaaacuagcaagauucggguccgcggcaaagaugcucguagaggaugaaaguuucgugcuacgccaaaccccaaccaaaaauggcgccagcgaaauuguaagaagauuccgaaacagagaaggagacuacagcaggagccuccucagagacgaccucgcggcggagaugagggcgcuauuuacggcacaggcaagauuccagagcgcgauagcaaccgccgaccuacaaaccgcauucacaaaggcggcauucuuccaacgaccacugcaagauagcgaaaaacugguagggcccugcccauucgaagucgacgagaaacgagcacccaaacgaggauacucauucgagcuauucagauuucuaaguagacuaaaucacguaacccuucgggauggaaaacaggaaagaacacucacccgagacgagcuagcccuagcagccgcggacuucggcgcggcagcaaaggugagcuucacagcacuccgaaagaagcucaaauuaccagaaacuacgguauucguuggggucaaagcggaugaagagagcaagcuagacguggucgcaaggagcggaaaagccgcugaagggacugcaagacugcgaucaguaauaguggacgcacuaggggaacucgccuggggagccuuacucugcagcccagaaaagcuagauaagauagcggaaguaauaaguuucaggagcgauaucggaagaauaagcgagggucucgcgcaagccggaugcaacgcaccccucguagacgcccugaccgcagcggcaagcgacggacgcuucgauccguucacgggagcaggccauaucagcagcaaggccgcaagaaacauauuaagugggcugcggcaaggaaugacauacgauaaagcaugcugugccgcagacuacgaccacacagcaagcagggaaagaggggcauucgacguaggaggucacgggcgagaagcauuaaaacgaauacuccaggaggaaagaauaagccgcgaacucguagggagcccaacggcaaggaaagcgcugaucgaaagcaucaaacaaguaaaagccauaguagagcgcuacggcguaccagacaggauacacguagaacuagcacgagacgucgggaaaagcauagaagaaagggaagagauaacgagagguauagagaaaaggaaccgacagaaggacaagcugcgaggauuguucgaaaaggaagugggucggccaccacaggacggagcaaggggaaaagaagaacuacuuagauucgaacuauggagcgagcaaaugggacgcugccuguacacggacgauuacauaucaccgucccagcuaguagccacagacgacgcagugcaagucgaccacauacuaccauggucaagguucgccgacgacagcuacgcgaauaagacacucugcauggcaaaagcaaaccaagacaagaaaggaagaacgccauacgagugguucaaagcagagaaaacugacacagaaugggacgcauuuaucgucagaguggaagcacucgcagacaugaaaggguucaagaagaggaacuacaaacuaagaaacgcggaagaggcggccgcgaaauucagaaaccgaaaccugaacgacacgaggugggccugcaggcuacucgcagaagcacuaaagcaacucuaucccaaaggagagaaggacaaagacggaaaagagcgaagaaggguauuuucacgaccaggcgcccugacggauagguugagacgagcguggggacuacaauggaugaagaaaagcacgaaaggagaccguauuccagaugacagacaccaugcauuagacgcaauaguaauagcagcaacgaccgaaucguuacugcaaagagccacgcgcgaaguacaagagauagaggacaaaggacuacacuacgaccuggucaaaaacgugacaccgcccuggccgggcuuccgcgagcaggccgucgaggcgguugagaaagucuucguagcaagagccgagcgacgccgagcacgcggaaaagcgcacgacgcaacaauaagacauauagcagucagagagggagagcagagagucuacgaaaggcgaaaaguggcagaacuaaaacuagcggaccucgacagaguaaaggacgcagagagaaacgcacggcugauagaaaaacucagaaacuggauagaggcaggaaguccaaaagacgacccgcccuuaucaccgaagggggacccaauauucaaagugcgacuuguaacgaaauccaaagucaacaucgcacuagacacgggcaacccaaagagaccgggaacaguagaucgaggagagauggcaagaguagauguauuccgaaaagcaucgaagaaaggaaaauacgaauauuaccuaguaccuauauacccacacgacauagcaacgaugaaaaccccacccauacgcgcaguacaagcauacaaaccagaggacgaauggcccgaaauggacucgaguuacgaguucugcuggucacugguacccaugacuuaccuccagguaauaagcaguaaaggagagauauucgaaggauacuaccgaggaaugaaucgcagcgucggcgccauacaacuaucggcacacagcaacagcagcgacgucguccaggggaucggggcgagaacacucacagaguucaagaaauucaacguagaccgguuuggacgaaaacacgaaguagaacgagaacuacgaaccuggcgcggggaaacguggaggggaaaagcauacauauga

SEQ ID NO: 6200 - RNA, 3255 nt, Artificial Sequence
  Cas9 variant
augaaaaacacccuauacgggaucggucuggacaucggcguggccagcguaggaugggcagugguaggccuaaacggcacaggagaacccguaggacuacacagacucggcguccgaaucuucgacaaagcagaacaacccaaaaccggagaaagccuagccgcuccucgacgaauggccagagggaugcgccggcgacuccguagaaaagcccuaaggagagcagacguauacgcccuucuagaacggagcggccugagcacccgcgaagcacuagcccacauguucgaagcaggcggccucgaagacauauacgcccuacgaacccgagccuuagacgaacccgucggcaaagcugaguucucacgaauccuacugcaucucgcccaacggaggggcuucaaaucaaacaggcguaccgccuccgacggagaagacggccgacuccuagcggccgucaacgaaaaucgccgaagaauggcccaaggcggauggcgaaccgucggagaaaugcucuaccgacacgaggcuuucgccuuacacaaaagaaacaaagcagaugaauaccucucuaccguaggcagagacaugguagcugaagaagcaagccuccuauuccaacgacaacgagaacuaggcugcgccugggcaacccccgagcuacaagcagaguaccuaucgauacuacuccgccaacgcagcuucgacgagggaccaggaggcaacucccccuacgggggaaaccaaguagaaaagaugguaggccgaugcacguucgagccagacgaaccccgagccgccaaagccgcguacaguuuugaauacuucucucuccuccagaaaaucaaccacauacgccucguggaaaacggcgaaacacgaccgcugacacaacaacaacgccaacaacuacucagccuagcgcauaaaacucccgacguguccuuggcacggauaagaaaagaacucgcccugccagaaaccguccaauucaacggaguccgaugcagggcaaacgaaacguuagaagaaagcgaaaagaaagaaaaauuugcaugucuacccgcauaccacaaaaugcggaaagcccuugacggaguaguaaagggccgaauuuccagccucagcaucucacaacgagacgcagcagcaaccgcacucagccuguacaaaaacgaagacacccugagagccaaacuaaccgaagccgguuuccaagcaccagaaaucgaugcccuagcaggccucacgggauucaguaaauucggacaccucagcuugaaagcaugucgcaagcugaucccacaccuagaacaaggacucaccuacgaccaagccugcucagcggccggcuacgacuucaaaggacacggagcaggagaaagggccuucacccugccagccgcggcaccugaaauggaacaaauaacaucgcccguaguacgccgcgccguugcccaaaccauaaaaguaguaaacggaaucauccgcgaaauggacgcaagcccagcauggguaagaaucgaacuagcccgcgaacugaguaaaacauucggagaacgacaagagauggaccgcagcaugagggaaaacgcagcgcaaaacgagagacugaugcaggaacugagggacacuuuccaccucuuaagccccaccgggcaagaccucguuaaguaucgccucuggaaggaacaggacggagucugcgcguacagcuuacgccggcuggacgucgaacggcuauucgagccaggcuacguagacguggaccacaucguccccuauucauugucauucgacgaccgcagaucaaacaagguccugguacuaucauccgaaaacagacaaaaaggaaaccgacucccacuucaauaccuacaaggaaaacgccgagaagacuuuauaguauggaccaacagcagcguucgagauuaucgaaagagacagaaccuccuaagagaaaaacucucgggcgacgaagccgagggcuucagacaaaggaaccuacaagacacacagcacauggcgagauucuuauacaauuacauaagcgaccaccuugccuuugcccaaucggaggcccuaggcaagaaacgcguauuugccgucagcggagcgguaacgagccaucugcggaaacgcuggggacucuccaaaguacgcgcagacggcgaccuccaccacgcacuugacgcagccguaauagcaugcaccacagacgguaugauacgacgcaucucaggguauuacggacacaucgaaggagaauaucugcaagacgcggacggagcuggaucgcaacacgcccgaacgaaagagcgcuuccccgcgcccuggccaagguucagagacgaacucauaguucggcucagcgaacagccaggcgaacaccuacuggacaucaacccagaguucuacugugaauaugguacagaacacauccgcccgguauuugugucacgaaugccgcgccgcaaagucaccggaccaggacauaaagaaaccauaaaaggagcagccgcggcagacgaaggacuacucacaguacggaaagcgcugaccgaauuaaaacucgacaaagacggcgaaauaaaagacuacuacaugccaucuucagacacacuacuauacgaagcacuaaaggcccaacuacgccgauucgggggagacagcaaaaaggcuuucgcagagccuuuuuacaaacccaaagccgacggcacacccggcccucucgugaggaaaguaaaaaccaccgagaaagcaacgcugaccgugccaguacacggcggagccgcaagcaacgauacgauggucagggucgacguauuccuugucccaggagacggauacuacuggguaccagucuacaccgccgacacacucaaaccagaacuacccaacagggccgucguacaggggaaaccauacucggaauggaaagaaaugcgagaggaagacuucaucuucucacuguaccccaacgaccucgucuacguagaacacaaaagcgggcuaaaauucacccugcaaaacgcagauaguacauuagagaaaacgcgaacccaaacauccgccuucguauauuucguaggcgggucgauauccaccgcaaguauaacaauccguacgcacgacaacgccuauggcauaccaagccucggggucaagacccugaagacauuccacaaguaccaagucgacguacugggaaacguauuuccaguccacaaagaaacccgacaaaaauuucgguga

SEQ ID NO: 6201 - RNA, 3255 nt, Artificial Sequence
  Cas9 variant
augaaaaacacacuauacgggaucggacuggacaucgggguagcaagcgucggaugggcaguugucggccucaauggaacaggugaaccaguaggccugcaccgucucggcgucaggaucuucgauaaggcggaacaaccaaaaacgggagaaagccuagcggcaccgcgacgcauggcacgcggcaugcgucguagacuaaggagaaaagcccuucggagggccgacgucuaugcacuccuggaacguagcggacuaucgacucgggaggcacucgcccaaauguucgaagccgguggccucgaagacauauacgcacucaggacgcgcgcauuagaugaacccguaggcaaagcagaauuuagccgcauauuacuacaucuagcacagcgcagaggguucaaaagcaaccgccggacagcauccgacggcgaagacgguagauuacuagccgcagucaacgaaaaccgacgacgaauggcacaagguggcuggaggacggugggcgaaaugcucuaccgacacgaagcguucgcccuacacaaacggaacaaagccgaugacuaccugagcacaguaggcagagacaugguugccgaagaagccagccuacucuuccaacgccaacgcgaacucggcugcgcaugggcaacaccagaacuccaggccgaauaccuauccauccucuuacgccaacgcagcuuugacgaaggacccggaggugacucaccguacggaggcaaccaaguagagaaaauggugggccgaugcaccuuugaaccagaugaaccacgcgcagcuaaggccgcauacuccuuugaauacuuuagccugcuccagaaaauaaaccacaucagacucgccgagaacggagaaacaagaccgcuaacccaaccacaacgacaacaacuacuaagccuagcacacaaaaccccggacaugucccuugcgcgcaucagaaaagaacuagcccuccccgagacaguucaauucaacggcguccgcugcagagccaacgaaacccuagaggaaucugagaaaaaggaaaaauucgcaugccuaccagcguaccacaaaaugagaaaagcacucggaggagucguaaaaggucgcauaucaucacucucaauuucacagcgcgacgccgcagcaacagcccucucccuauacaaaaacgaagacacacucagagccaaacuaaccgaggcaggcuuucaagcaccagaaaucgacgccuuagccggccucacaggauucucgaaauuuggacaccugucgcuaaaagcaugcagaaaacuaauaccacaucucgagcaggggcugacguacgaccaggcuugcagugcagcaggauacgacuucaagggacauggugccggagagcgagccuucacacuuccggccgccgccccagaaauggaacaaaucaccucacccguaguaagacgagccguagcgcagacaaucaaagucgucaacggcauaaucagagaaauggacgcaagccccgccuggguaagaaucgagcuagcccgagaacugucaaaaaccuucggcgaacgccaagaaauggaucgaagcaugcgcgaaaacgcagccaaaaacgaaaggcuaaugcaggaauuacgagacaccuuccaccuccuuagccccaccgggcaagaccuagugaaauaccgccuauggaaagaacaagacggagucugugcauacagccuucaacgccuagacguagaacaacuauuugaacccggauacgucgacguagaccacauaguaccguacagccucucauucgacgaucgcagguccaacaagguccuagugcuaagcucagagaaccgucaaaaagggaaucgacucccauuacaguaccuccaaggcaaaagacgcgaagacuucauaguauggacgaacagcuccgugcacgacuaccgcaaacgacagaauuuacuaagggaaaaacuaucagacgacgaagcggaaggauucagacaacgcaaccuacaggacacgcaacacauggcucgcuuccuuuacaacuacauuagugaccaccuggccuucgcgcaauccgaggcccucgggaagaaaagagucuucgccguuagcggcgcaguaacaucacaccucaggaaaagauggggacucagcaaagugagggccgacggggaccuacaccacgcgcuagacgccgccgucguugcgugcaccacagacggaaugauccggagaauuucuggguauuacggccacauugaaggggaauacuuccaagacgccgacggagccggcagccaacacgcgagaacgaaggagcguuucccagccccauggccgcgcuuccgcgacgaauuaauaguccgccucagcgagcaaccgggagaaccccuacuagacaucaacccagcuuucuacugcgaguacggcaccgaacacaucagaccgguauuugucagcagaaugccacgccggaaagugaccgggccaucccacaaagaaacaguaaagggcgccgcagccgcagacgaaggccuacuaacaguuaggaaagcacuaacagaacucaagcuagacaaggacggcgaaauaaaagacuacuacaugcccuccucagauaccuugcuauacgaagccuugaaagcccaacuccggcgcuucggcggcgacggcaaaaaggcuuucgcggagcccuucuauaaaccaaaagccgauggaacaccagggccccuagugcgaaaagugaaaacaacagaaaaagccacacucaccguaccaguucacggcggggcagccuccaacgacacuauggugagaaucgacgucuuuuucaugccaggggacgguuacuacuggguuccccucuacgucgccgacacacugaaacccgaacuaccaaaccgagccgucguugcccauaaaccuuacuccgaauggcaggagaugcgagaagaagacuuuguauucagccucuacccaaacgaucucgucuacgucgaacacaaaucagaacuaaaauucaccguccagaacgcagacagcacccuagagaaaaccagaacgcaagccagcgcauucguauacuucgugagcggaggaauaagcggcgggacgaucaccguccgcacacaugacaacagcuacggaaucccaagccucggacuaaaaacgcucaaaucacucugcaaauaucaagucgacgugcucggaaaugucuuccccgugcacaaagaaacccgacagaaauuccgcuga

SEQ ID NO: 6202 - RNA, 3255 nt, Artificial Sequence
  Cas9 variant
augaaaaacaccuuauacggcauuggccuggacauaggcguagccuccgucgguugggcaguagucggccucaacgggacgggggaaccaguagggcuacaucgccucggcguaagaaucuucgacaaggcggaacaacccaaaacaggggaaucacuagcagcaccacgccgcauggccaggggcaugagaagaaggcuacgcagaaaagcccugcgacgcgcagacguauaugcacugcucgaacgcagcggacugagcacacgcgaagaacuggcccaaauguucgaagcaggagggcucgaagacauauacgcauuacgcacaagagcccuagaugaaccgguaggaaaggccgaguucagcagaauccuccuccaccuggcacaaagacguggauucaaguccaaccgacgcacagcgucggacggagaggacggcagacuacucgccgcggugaacgaaaacagacgacgaauggcucagggcgguuggagaacagucggcgagaugcucuacagacaugaggccuucgcccuacauaaacgcaacaaagcagacgacuaccucuccacagucggacgggacaugguugcagaagaagcauccauacuauucgaaaggcagagggcaauggggugcagcugggcagcaccugaacuacaagccgaguaccuaucuauucuccuccgccaacgguccuucgacgaaggucccggaggcaacucacccuacgggggcaaucaaguggagaaaauggugggccgaugcacauucgaaccggacgaaccgcgugcagccaaagccgcuuacucguucgaauacuuuagccugcugcaaaaacuaaaccacauucggcuagcagaaaacggcgagaccaggccgcucacccaaccccaaagacaacaguuacucagccucgcacauaagaccccagacaucagucuggcaagaauacgaaaagagcuagcccuacccgaaacaguacaauucaauggcguccgaugucgagcuaaugaaacccuagaagaaagugaaaagaaggaaaaauucgccugccuccccgcuuaccauaaaaugcgaaaagcucuagacggcgucguaaaaggccgaaucucaucacucucaaucagccaaagagacgcagcagcgaccgcccucucccuauacaaaaacgaggacacacugcgcgcaaaacugacagaagcaggcuuccaagcacccgaaauugacgcccuggcaggacuaacaggauucucaaaguuuggacaccucagccucaaggcuugucgcaaacuaaucccgcaccuggaacaaggacucacauaugaccaggccuguaccgccgcaggauacgacuucaaaggccacggcgcgggggaaagggccuucacacuccccgccgcagcaccagaaauggaacaaauaacaucccccguagucaggagagccgucgcacagaccauaaaagucguaaacggcaucauaagagaaauggacgccucacccgcguggguccgaaucgaacuggcgcgcgaacuaaguaagacauucggcgaacgacaagaaauggacagaagcaugcgcgagaacgccgcacaaaacgaacgacucaugcaggaacuaagagacaccuuccaccuccucagccccacaggccaagaccuugucaaauaccgacuguggaaagagcaagacggaguaugcgccuacucccuccguagacucgacguggaaagacuauucgaacccggauacguagacguagaccacaucguccccuauagccucucuuucgacgaccgccgaaguaacaaagucuugguacucucaagcgaaaacagacaaaagggaaacaggcucccacuccaauaucuucagggcaaaaggcgagaggauuucauaguguggacaaacagcuccgugcaugacuaccgaaaacggcagaaccuccugcgcgagaaauuaucaggagaugaggcagaaggauuccgccagcggaaucuacaggauacgcagcauauggcucgguuucucuacaacuacaucagcgaccaccuagcauucgcccagagcgaagcacucggcaagaaacgcguauucgccguaagcggagcagucacuucccaccuuaggaaacgaugggggcucagcaaagucagagccgacggggaccugcaccacgcccucgacgccgcaguaguugccugcacaacagacggcaugauacggcgcauaucgggauacuauggccacaucgaaggcgaguaccuacaagacgcggauggagcaggaagccaacacgcccgcaccaaagagagguuucccgcgccguggccacgguuccgcgaugagcuaaucgugagacucucggaacagccagccgaaccacuacucgacaucaacccagaauuuuacugugaguacggcacagaacauauacgccccgucuucgucucucgcaugccgagaagaaaagucacaggcccaggccauaaggaaaccaucaaaggcgcugcggcagccgacgaaggacugcugacaguucgcaaggcccuaaccgaacuaaaacuagacaaagacggcgagauaaaagacuacuacaugcccagcucagacacacugcuauaugaagcacuaaaggcccagcugcgucgguucggaggcgacggcaagaaagcauucgcagagcccuucuacaaaccaaaagcagacggaacccccggcccacucgugcggaagguuaaaaccacagaaaaagcaacauuaacgguaccaguucacggcggagccgccagcaacgacacaaugguacgaguagacguguuccuugugccaggcgacggauacuacugggucccagucuauaccgccgacacgcucaaacccgaacuaccaaacagagcaguaguccaagguaagccauacagcgaauggaaagaaaugagagaagaagauuucauauuuucccuguaccccaacgaccugguguacgucgagcacaaaucaggccuuaaauucacccuacaaaacgccgacuccacccuagagaaaacacgcacccaaaccucggcauuugcauacuuugugagcggguccaucagcaccgccuccaucacgaucagaacacaugacaacgccuauggaaucccaagccucggagucaaaacacuaaagaccuuccacaaauaccaaguggauguccucggaaauguauucccgguucacaaagaaacacgacaaaaauucagauga

SEQ ID NO: 6203 - RNA, 3255 nt, Artificial Sequence
  Cas9 variant
augaggcuagggcucgacaucggaacaaacagcauaggcugguggcuauacggaacggaaggcgggcgcauaacagaagucguagacgggggagugcgaaucuucucagacggaagagacccucaaagcaaagccucgcuggcugucgacagacgggccgcgcgcucgcaaagacgccgacgcgaccgcuaccuccgcaggaaggccgcacuaaugaaacgcauggcgcagguaggccuuaugccggcagacccagcagaggccaaagugcuagaaguacucaacccauacgaacuaagggccucaggccuggacgggccacuaccacugacccauuucggccgcgcccucuuccaucugaaccaacgcagaggauucaaaucgaaucggaaaaccgaccgcggagacaaugagagcggaaaaauaaaagacgcgaccgcgagacuagaccaagcaaugauggccaaaggagcgcgcacguacggagaauuucuacacaugagacgcgcggccgcacucgaccccaaguccguacccucgguacgaacuagguuaacagucgcgcgcagagacgacgccgaaaaagaagaagcgggcuacgacuucuacccggacaggaaacaccucagcgaagaguucgacaaacuaugggcggcucaggccagacacgcaccagacguacucacagaagaucuacgagacgaaauagccacaauaauauuccaucagcggccucugaaaacaccagaaguaggacuaugccuauucaccggacaacacggugucccagaacgcgacaagcgaaucccgagugcacacccgcucaaucaacgacgcauacuaauggaaacuguaaauaaccuuaaagucgcagcgcaaggagaaccgagcaggccauugacccgggaagaacgagaccaaauaguacacgcccuggacaacaagaaacauacgaaaagucucagcggcaugaccaugaaacugaaagcacuaggcaaaguaauaaaacuccgaccggaacaaggauucacacuagaaacagcaaacagagacgcgaucgcuugcgacccagugcgagcaagccuaucccacccagacagauucggagcacgcuggagcacacucgagagcgcgggccagugggacgucguacaaaggaucagggcagugcaaucagacgcggaacacgccgaccucguuggcuggcucauggacguacacggacucgaccgagaccacgccgaagagacggcgaacgcacccuuaccugaaggcuaugggaggcucggguuaacggcaacgacacgcauacuagcugccuuagaggccgacguacucaacuacagcgccgccgucgcggcgugcggcuggcaccacucugacggaagaaccggcgaaguucucgaaucacuacccuauuacggagagauacuagaaaggcacguaauaccaggcacaggcgacccgaacgaugaugacgugaaacgcuacggacggauaacaaaccccacgguccacauagggcugaaccaacugcguagguuaguaaaccgaaucauaaccguauacgggcgcccagacgagaucguggucgagcuagcacgcgaccugaagcucagcgaggaccagaagaaagacguacagcgagauauaaagaaaaacaccgaggccgcuauaaggcgcggcaagaaacucgaagaaaugggagugcccaauacaggcgcaaaccggaugguacuccgacucugggaagaucucggagacgacgugaugacaagaaacugcccuuacacuggaaaacgaauaagcgccggaaugcuauuugacgggucaugcgaugucgaccauauucuccccuauagcagaacacucgacgacaguuucgccaaccgaacacuuugccuaaaagaagcgaaccggcagaaaaccgacaaaacgcccugggaggcauggggagaaaccgaacaaugggaagcaaucgcagcgaacuuaaagaaccuaccagcaaauaaagcguggcgauucgcaccagaugcuauggaacgguucgagggcgaaaaagauuucuccgcaagagcacuggcagacacacaauaccugagcagaauagcccgcgcauacuuagacgcgcuauaugacggagacgacgguaaaagucauguaugggucguaccgggacgacuaacagaaaugcuccggcgacacuggggguuaaacgggguagcagcacuaaccgacagcgacaaacaaaccgugaaagccaaaaaucgcacggaccaccgccaccacgcaauugacgccgcaguagucgcagcaacagauagaggacugauaaaacguaucgcagacauggcaaaacgcgacgaauuuaacggggccgaagagguagcgagaagcaucccuccacccugggaaggauuccgcgacgacguuucagcacaagugacgcgaauaauaguuagccaccgcgcggaccauggcagaaucgaccccgcagcgagaaaaucagggagagacagcacaaguggccagcuacacaacgacacagcuuacggaaucgggcgggacgggacaguagucagucgaaaaccgcuagcgagccuaucaccaaacgauauagucgucaccaaaagaggagcuaacauacgcgauguggaccuucagaaacaccuagcccgaguaacccacggacuagacggaaaggccuucgaggcagcacucuuagccuucgcagcaagcccaauacuacccgauaacacggauaacccauacuucggacuaagaagaguacgacucgaggagacccuacaagaaagcgcacgaguagagguagcagaccaagaaggcaggcccuacaaagcauacaaaggcgauagcaaucacugcuacgaaaucuggugccugccagauggcaagauaaaaccgcaaguuguaaccacauaugaggcacaccaauccggugcagagaagaaaccacauccagccgcuaagcgucuaaugagaauauucaagagagauauggucaugcuagagagagacggagagacgaucauaggauauguacagaaaaugaaacaaaacgggagcauauucguggcaccucacacagaagcaaacgcagacgcgcgagaccgcgacccaaaagacgacuuuaagcugauucaacuuggagccggcucgcuagugaaagcgaaagcacguagaguaaucgucgacgaaaugggccgacucagggaccccgguccaccacuauga

SEQ ID NO: 6204 - RNA, 3258 nt, Artificial Sequence
  Cas9 variant
auggacaaagggacaaacuccauaggcugggcugcacugaggcuggacgaacaaggagagccuguuggcauaauagaagccggcgucagaaucuacgccgacggcagagaacccaaaucaggcacaucacuagccgaggggcgcagaaucgccaggggaaugagcagaaggcgagacagguacaaaaggcgacggagaacaguacuaaacacgcugacagaguucggacucaugccagccacaaaagcagcgaggaaagcccugguagcagaaacgaaugauagacgauucggggaaguagcaagcaacguguacgcauuacgagcaagggcacucgaugaaaaacuaccccucuaccaacuagggagagcacucuuccaccucaaccagagacggggauucaaaucaaaucgaaagacugauaaacgcgacaacgaccagggaaagauagcgucggcgauaagcaggcuagggcgaaaauuagacgaggcgggggcccgaacgcucggggaguuccuacacaaacaacacgcagcaggaaaauggguaagggucaggccaucccgcguaccgggcgaagacgacaaagaagaggacggauacggguucuaucccgaacgcagcuuccucgaacgagaguucgcagcgaucugggaggcgcaagcagcauucuacccugaacuccuuacagaagaacguagagaccaccuccacuggguaauguuuuuccaacgaccccuaaaacggcccacgguuggcaaaugcucguuccaucccgacgaagaucgacugcccaaagcccacccacuauuccaagaguucaggcugauuaaagaacuaaacgaacuugaagugguacaccgaggagaucggagggaaaagcuaacccccgaccaaagagaccgauuauucaaucagcuacgaacacaaaggucgucagcauucacagcacuccgaaaaacaaucaaagcaccaaccggcaccagguucaacaaagagagugacgccagagacaaacugaagggagacgaaguggccgcagaaaugagccacaaagacagauuuggacaagcguggauaggcaugccacuggccgaaagaugggcaguagucgcaaugcuauuggauaccgaggacccacucgaaguaaaagcauggcuggaggaacgauauggguucgcagcagaucgcauagacgcaaucgccgccgcaaaacuacccaccggauacggacgccucggagagacagcccugagggacaugcucgacgaauuaaggaacggcaccgucaaagacgacgccgggcgcgacguaguucucacagaaaggcaagccauggacaacaucuggggcgacaaccccgcgcuccaacgagccguaacagacgcgcgagagcucccgccauaccaagaaguacugggaagaaggaucccaccgggaacgggcaaacccgccgacccauacgacguacaaaagggaagacuaacaaacccaacgguacauaucggguuaaaccaacuaaaacgcaucgugaacguccuaaugcgacgacacgggagaccugaacagauagcacuagagcuagcaagagaccucaaacugaacgaagaacaaaaagcagagaaaaaccgcgaaaucgcaaggaacaccaaagcagccgaagcuagagguaagaaauuagaggaacucggacacgccaauaacggauacaaccgcguacuacucaaacucugggaggacuuaaaccucaagcagccagaaaacagagaaugcaucuacugcgggaaagcuauaggaauaggaacacuacuaagcaaccaaguagacauugaucauauacuuccauggagcaaaacgcucgaugacagucaagcaaacaggaucgugugccauguagagugcaacagacaaaaagggaaccacgcaccagcagagguaccacaauggcacgaccguuacgacgacauuuuggcccgagccgagagacuaccacgaaacaaagcguggagauucgggagggaagcaaugaagaaauucaaagacgacgagagcuuccuugcgcgacagcugacggacacucaauaccuaagcagauuggcccacgaauaccuaggagcgcucuauccagacgaagaaccggacgaauggggcggcccagcgagaagaaaccacgucaggguaauaccaggccgcaugaccgaaaugcuacgaagacaauggggcuuaaacgccauaaucucggaccacaaccagaaaaaccgaaacgaucaccgccaccacgccauagacgcaauaguagugggggugacaacacgaagacucuuacaaaggaucgcgaccguggcgggaggcagagaagcccuagcacuggaagaaacgauagguaaaauugaaccaccauggccaggcuucuacgacgacguaaaggccgccauagaccgcauagucguaagccacaaaccggaccacgggucgcuaccgaaaccuggcaaaccaggacgcacagcagggcaacuacacaacgacaccgcauacggcuuuacaggcgaagcaagaaacggggugccaauaaugguccaccgaguacccuucgcaucacuaaccgaaaaagacauaccaagcauuagggacaggcaacucgccgaugcucuauacgcggcgaucucaggaauaagcgggaaagcggaacuagccgcagcacuagcacgguucucagaaagcggaccguacaaagggaucagacacguaagagugguagagcccguaagcgucauagccauaaaagaccaagcgggcaaagccuacaaaggauauaaaggagaugcaaacuaccgcuacgacguaugggaacugccaaacgggaaauggacgcacgaagucguaaguauguuuaacgcgcaccgcccggacuggcaaucggaaauacgaaguaagaacccagcggccaggaaaguccugagccugcaccaaaacgauauggucgcguacgaacacccacaagacggcuauacuauaggcagagucguaaaauucagcgcgggcggccagauggcacuggcaggcaacagagaaggaggagcccugaaaagcagagacgccgacccggaagaucgauuccgcuacuuuuacaaaucaggaggggccaugagggacguccagcuaagacagguucguguagacgaaaccggcagggucuuugaccccggaccccaagaccgagagucaagaaacgcacgaaaacaaaacgacgccggauga

SEQ ID NO: 6205 - RNA, 3264 nt, Artificial Sequence
  Cas9 variant
augcgcuacaagaucggccucgacaucggaauaaccuccgucggcugggcaguaaugaaccuagacaucccccgaauagaggaccuaggagugcgaaucuucgaccgggccgaaaacccccaaacgggcgaaagccuagcgcuaccccgacgccucgcgcggagcgccagacggcgccugcgacgcagaaaacaccggcuggaacgcauccgaagacuuguaauccgagaaggcaucuugacaaaagaagaacucgacaagcuguucgaggaaaaacacgagauagacguauggcaacugcgcguagaagcacucgaccguaaacuuaacaacgacgagcucgcaagaguccuacuccaccucgccaaacgacgcggauuuaagaguaaccgaaaauccgaacgcagcaacaaagagaacuccacaaugcuaaaacauaucgaggagaaccgcgcaauacuauccagcuaucgaaccgugggcgagaugauaguaaaagacccaaaguucgcucuacacaagagaaacaaaggcgaaaacuacacuaacaccauugcgagggacgaccucgaacgagaaaucagacucaucuuuagcaaacaacgcgaguucggcaacaugucauguacagaagaguucgaaaacgaauacauaaccauaugggcgagucaacgcccgguugccagcaaagacgacaucgaaaagaaaguaggauucugcaccuuugagccuaaagaaaagcgagcacccaaagccacauacaccuuccagagcuucauugccugggaacacauuaauaaacuucgccucauaagccccuccggggcgcgcggccuuaccgacgaagaacggcgccuacuauacgaacaagccuuccagaaaaacaaaauaaccuaccaugacauccgcacccuccuccaccuccccgaugacacuuacuucaaaggcaucgucuacgacagaggggaaucccgaaaacaaaaugagaacaucagauuccucgaacucgacgccuaucaccaaaucaggaaagccguggacaaaguguacgguaaaggaaaaucauccuccuuccuacccaucgacuucgacaccuucggcuacgcacucacauuauucaaagacgaugcagacauacacagcuaccugagaaacgaauacgagcaaaaugguaaacggaugcccaaccuagcaaacaaaguauacgacaacgaacuaaucgaagaacuccuaaaccuguccuucacgaaauucggccaccuuucacuuaaggcccucagauccauccuacccuauauggaacaaggcgaaguauauucuagcgcaugcgagagagccggauacaccuuuaccggacccaaaaagaaacagaaaaccauguugcucccaaauauucccccaaucgccaaccccguagugaugagagcucugacccaagcccgcaaagucguaaacgccaucauaaagaaauacggcucccccguaucuauacacauagagcucgcacgagaccucagccaaacauucgacgaacgacgaaaaaccaagaaggagcaagacgaaaaucgcaagaaaaacgaaacagcuaucagacaacucauggaauacggccuaacccucaaccccaccggccaugacauaguaaaauucaagcuguggagcgagcaaaacggacgcugcgccuacagccuccaaccaauagagauagagcgacuacuagagccagguuacgucgaagucgaccacguaauccccuauagccgcagccuagacgauuccuacacaaacaaggugcuaguucuaacccgcgaaaaccgagagaaggguaaccgcauaccagccgaauaccucggcguuggcacagaacgcuggcaacaauucgagaccuucguacucacaaacaaacaauucagcaaaaagaaaagggaccggcuacuccgccuacacuaugacgaaaacgaggaaaccgaguucaaaaaccgaaaccugaacgacacucgcuacauaucuagauucuucgcaaacuucauaagagaacaccucaaguuugcggaaucugacgacaaacaaaagguauauacagugaacgggcgggucacggcacaccuacguucacggugggaguucaacaaaaacagagaagaauccgaucuacaccacgcuguggacgcaguaauugucgccugcaccacgcccagugacaucgccaaaguaacagcauucuaccaaagacgagaacaaaauaaagaauuagcaaagaagaaagaaccccacuucccgcaaccguggccacacuucgccgacgaacuccgcgcacgguuaucaaaacaccccaaagaaucgauaaaagcacugaaccucgggaacuacgacgaccaaaaacuugagagccugcaacccgucuuuguaucccggaugcccaaacgauccgucacaggcgcugcacaccaagaaacccuccgacgcuacguaggcaucgacgaaagauccgggaaaauccaaacagucguaaaaacaaaacucagcgaaauaaaacuggacgcgucaggacacuuccccauguacgggaaagagagcgauccgcgcacauacgaagccauccgacaaagacuauuggaacacaacaaugaccccaagaaagccuuccaggaaccccuauacaaaccaaagaaaaacggggagcccgggccagucauacgcacugucaaaaucaucgacacgaaaaaccaggucauuccuuuaaacgacggcaaaacggucgcauacaacagcaacauagugcguguagacgucuucgaaaaagacggaaaauacuacuguguaccgguauacacgauggacaucaugaaaggcauacuacccaacaaagcaauagaacccaacaaaccauacagcgaauggaaagaaaugacagaagacuacacauuucgauucucacucuaccccaacgaccuaauuaggauugagcugccacgcgagaaaaccgugaaaacggccgccggagaagagaucaacgugaaagacgucuucgucuacuacaaaacaauagacucagcgaauggaggccuagaacucaucucccacgaucaccgcuucucccuacgaggcgucggaaguaggacccucaaacgauucgaaaaauaccaaguugacguccuagguaacaucuacaaaguccgaggggaaaagaggguagggcucgccuccucggcacacuccaaacccggcaagaccauccgcccgcuccagagcacaagagacuga

SEQ ID NO: 6206 - RNA, 3264 nt, Artificial Sequence
  Cas9 variant
augcuccgcaugaaauacgccauaggccuugacaucggcauagcaagcgucggcuacgccgucuuggcccuugaccacgaagaaaacccguggggcaucauacgucuagggagccggaucuucgacgucgcagaaaacccaaaagacggggccucacuugcacucccccgacgcgaagcccgcagcguccgacggagguuacggagacaucaccaucgccuagaacgcauuaaaaaccuccuuauaaacaccgaguucauaacaaaagacgaacuccuacaccuauacgacgguaaccuauccgacgucuacgagcuccgcgucaaagcgcucgacuacucaguuaccaacgccgaacucacacgcauucuacugcaccuggcccagcggcgcggguucaaaagcaaccgaaaaucagaugccaacgacaaagaagccggccaacuccucgaagcagucucugcaaaugcaaagcgaaugcaagaaaaccacuacagaacgguaggagaaauguucuacaaagacgaucucuuuuccaaguauaaacggaacaaagggggcacuuaccucaccaccguccaccgagacaugaucgcugccgaagcccgcaccaucuuggaaaagcaguuugcccuaggcaacaacauaugcacccaggacuucaucgacaaguaccuaaguauccuccugucccagcgacaauucgacgaaggccccggcgaaccgucgcccuacgcaggcaaucaaauagcgaacaugaucggaaaguguacauucgaacccaaugaguaccgagccgcaaaagcaucuuacucguucgagagguuuaaccuucuacaaaagguaaaccaccuacggcuucuccuagaaggcaaguccaucgcacuagacaaugaacaaagaaagaaaaucaucgcccuggcccacgacaaagccgaucuccgcuacagccacauccgcaaagcccucggccucgaugaaaaaguccucuucaacacgauaaccuacaacgacgacguuuccguaaucgagaaaaagacuaaauucaacuuucuccaagcauaccaccaaaucaagaaaguacuagcagaagauaugcaaaagcucaccaccgaacaacuagacaacaucggucaaauacucuccacguacaaaucagacaacaaaagaacagaagaacuauccgcccucggccucgaaaagaaaauaauagacgcacuacuuggaauaaacggacugagcaaauuugcccaccuaucccucaaagcgcuacgcaaaauaaaccccuaccucgaagaagggaaaauauacaacgaagccugcacagcagccggcuacgacuucaaagcccacgccaacacacaaaagaccgaacucuuacccgcauacaaagaagaaauggacgacaucaccucccccgucgcccgucgcgcgaucgcccaauccauaaaaguaaucaacgcaaucauacgugagcagaaaggcagcccacucuacaucaacauugaacuggccagagaaauggccaaagguuucgacgaacgcacacaaauagacaaagcuaacaaagagaaccaggcaaagaacgagcgaaucauggagcgcauccgaaccgaguuccacaaagcaaacccaacaggaauggaccuuauuaagcucaagcucugggaagaacaggacggucguuccccauacagccaaaaagccaucucuauaaaccgccucuucgaacccggcuacgucgacauagaccacauugugcccuacagcaucucauuugaugacucauucaaaaacaaaguccuaguguuuagcgacgaaaaccgugauaagggaaaucgacucccaaucgcauaccuacaaucaaaguucggcgccaaagccgcugaaaacuucaugaucuggguccagucaaacauaaaagauuacaagaaacgacagaagcuccugaaaagggaaaucacagaagaagauaucaauaaauuuaaagagcgcaaccuccaagacaccaaaaccaucucccgguuucucuacaacuacaucaacgacuaccuacucuucgcucccucagacaccggcaaaaagaaaagagucaccgcgguaaacggaaccaucaccgccuaccuccgaaagcgauggggcauaaacaagauacgcgcuaacggcgacaaacaccacgcagucgaugccgucguaaucgccuguaccaccgacaaaaugaucaaggaccuuagcucguucucaagauaucacgagcucgaauacacgcacaccgauacagagagcuuucuagucaacucacugacaggggaaauacuaaaacgguuccccuaccccugggaggacuuccgccccgaacugauggccaggcuuuccgacaauccagccgacgccuuacggaaacuaaacuuaauauucuaccacggcaucgaccuaagcacuauaaaacccauauucgucucccguaugccucggcacaaagugaccggcgccgcccacaaagcaaccauaaagucagcaagaugccuugacaacggcaucguaaucugcaagaccucacuccaaaaccuaaaacuagacaaagaaggagagauugcuaacuauuacgcacccgaauccgacacuauacucuacaacgcacuuaaggaaagacugaggagcuacgacaacaaaccagccaaggccuucgccgaaccauucuacaagccaaaagccgauggcacgccagguccacucgucaagaaaguaaaaguauacgaaaaaucaacccuaaaugucgcaguccaacaaaacaccgcggucgccgacaacgacaguaugguucgugucgacgucuuccacgucaaaggcaacggauacuaccucguucccauauauaucgccgacacccuaaagaaagagcucccaaacaaagccaucgucgcauacaaacccuacgcagauuggccggugauggaugacuccaacuucaucuuuucacuauaccccaacgaccuaauaaaauuugaacacaaaaauuccguaaaauuugcaaaagucaacaaagaauccacacucaacgacuucuacuccacgaaauccgagauagucuacuucaaagguuguaacaucaacaccggggccaucaccaucauaaaccacgaaaacacauaugugguuagcagccucggcgucaaaacccucccgucacuggaaaaauaucaggccgaugugcucggaaacuacaccaaaguuaagaaagaaguucgcaaacccuuccgcuga

SEQ ID NO: 6207 - RNA, 3264 nt, Artificial Sequence
  Cas9 variant
augcguuacaagauaggacucgacaucggcaucacaagcgucgggugggccguaauaaaccucgacaucccacgaaucgaagaccugggagugcguauauucgaucgcgccgaaaacccacagaccggagagucccucgcacucccacgucgccuagcccgaagcgcaagacgccgucuacgccgacgcaagcacaggcuagaacgaauccgccgacucaucaucagggaaggcauccucacaaaagaagaacuugacaaauuauucgaagaaaaacacgaaauagacgucuggcagcuucgaguagaagcgcuagaccgcaaacuuaacaacgacgaacuggcccggguacugcuacaccucgccaaacgcagaggcuucaaaagcaaccgaaaauccgagcggagcaauaaagaaaauucaaccaugcuaaaacacauagaggaaaaccgagcuauccugucguccuaucggacugugggagaaaugaucguaaaagaccccaaauucgcccuacacaaacgaaauaaaggagagaacuacacuaacacgauagcucgcgacgaucucgaacgggaaauccgauuaauauucuccaaacaacgcgaguucggaaacaugagcugcaccgaagaguucgaaaacgaauacaucgcaauaugggcuucacaacgcccaguugcaucaaaggacgauaucgaaaagaaagucggcuucuguaccuucgaacccaaggaaaaacgagcccccaaagccacguacaccuuccagagcuucaucgccugggaacauauaaauaaacuccgccuaaucucccccucaggaacacgaggccugaccgacgaagagagaagacuacucuaugagcaagccuuccagaaaaacaagauaacauaccacgacauaaggacacuacuacaucuaccugacgacacauacuucaaaggaaucguauacgaccguggcgaaucccguaaacaaaaugaaaacauacgcuuccuagagcucgacgccuaccaccaaauccgcaaagcggucgacaaagucuacggcaagggaaaaucaucgucauuccucccgauagacuucgacaccuucggauacgcacuaacauuguuuaaggacgacgccgacauaagaucauaccuucgcaaugaauacgaacaaaacggcaaacgaaugccaaaccuggcaaauaaggucuaugacaacgaacuaauagaagaacuauuaaaccucagcuucaccaaauuuggacaccucucccuaaaagcacuccgcagcaucuuaccauacauggaacaaggagaaguuuacuccagcgcaugcgaacgagcaggcuacacguuuaccggaccgaaaaagaaacaaaagaccaugcuccucccaaacauucccccgaucgcaaaccccgucgucaugcgagcccuaacgcaagcccgaaaaguagucaacgcaaucaucaagaaauacggaagccccgucagcauacacaucgaacuagcgcgcgaccuaucgcaaaccuucgacgaacgucgaaaaacaaagaaagaacaagacgaaaaccguaagaaaaacgaaacagccaucagacaacucauggaguacggacucacccuaaauccaaccggccaugacaucguaaaauucaaacucuggucggaacaaaacggccgaugcgcauacagccuacaaccaaucgaaauugaacgacuccuagaaccaggauacaccgaaguagaccacguuaucccauacucgagaucucucgacgacaguuacacaaauaaaguccucguccucacaaaagagaaccgcgaaaaaggcaaccgaauccccgccgaauaccucggagucggaacagaacgcuggcagcaauucgaaacauucgucuuaaccaacaaacaauucucgaagaagaaacgggaccgacuucuccgacuacacuacgacgagaacgaagaaaccgaauuuaaaaaccggaaccuaaaugacacaagauacauaucccgcuucuucgccaacuucauccgcgaacaccucaaauucgccgaauccgacgauaaacaaaaaguuuacaccgucaauggcagggugaccgcccaucuacggucaagaugggaguucaacaaaaaccgggaagaaucugaucuccaccacgcagucgacgcugugauagucgcaugcacaacccccuccgacauagcuaaagugaccgccuucuaccaacgccgcgaacaaaacaaagaacucgccaagaaaaccgagccccacuucccgcaacccuggccgcacuucgccgacgaacuacgcgcacgccuaagcaaacaccccaaagaaucgaucaaagcacuaaaccugggcaacuacgacgaccaaaaacucgaaagccuacaacccguguuugucucccgaaugccgaaacgcagcguaacuggugcggcgcaccaagaaacacuacggcgauacgucggcauagacgagcgaucaggaaagauacaaacagucgucaaaaccaaacuaagugagaucaagcuagacgcaagcggacacuuucccauguacggaaaagagagcgacccacgcacguacgaggccauacggcagagacuccucgaacacaacaacgacccuaaaaaggcuuuccaagaaccacuuuacaaacccaagaagaacggcgagcccggucccguuauccgcaccguaaagaucaucgauaccaaaaaccaagucauaccucuuaacgacggcaagacgguagcauacaacagcaacauaguccgaguggacguauucgaaaaagacgggaaguacuacugcgucccaguauacaccauggacaucaugaaaggcauacugccaaacaaagccauagaaccaaacaaaccauacagcgaguggaaagaaaugaccgaagacuacacauuccgcuucucccuauaccccaacgaccucauccgcauagaacuacccagagagaagaucaucaaaaccgcgggaggcgaggaaauuaaaaucaaagaccucuucgccuacuacaaaaccauccacagcgggacggccggucucgaacuuguaagccacgacugcagcuucagccuaagcggggucggcagucggacacuaaaaagauucgaaaaauaccagguggacguacugggcaacaucuacaaagugcgaggggagaaacgggucggucuagcuuccagcgcacacuccaagaccggugaaacaauccggccacuccaaagcacacgcgacuga

SEQ ID NO: 6208 - RNA, 3264 nt, Artificial Sequence
  Cas9 variant
augcgguacaagauaggccucgacauagggauaacgagcguagguugggccgucaucaaccucgaccuaccccggauagaggaccuaggcgugcgcauauucgaccgugccgaaaauccccagacaggggagucccucgcccuaccccgcaggcuagcacgcucggcccgccgacgucugcgacgccgaagacaccgcuuagagcgaauacgaagacuacuaacgcgagagaacguccuaacgcaagaggaacuggacaaacuguucgaaaagaaacacgaaaucgacgucuggcaacucagggucgaggccuuagacagaaaacucaacaacgacgaacuagcccguguccuucuccaccuggcuaaaagaagaggauucaaaucaaaucgcaaaucagagcgguccaacaaagaaaacuccaccaugcuaaaacacauagaggaaaacaggagcauccucacaggcuaucggaccguaggcgaaaugauagugcgggacccgaaauucguacuccauaaacgcaauaaaggcgaaaacuacaccaacaccauagcacgcgaugaucucgaacgugaaauccaacucauauucgccaggcaaagggaguucgggaacaugaucugcaccgaagccuucgagaacgaauacaucgccaucugguccucccaacgacccgucgccuccaaggaugacauagaaaagaaaguaggcuucuguaccuucgaaccgaaagaaaaacgcgcacccaaagccacguacaccuuccagagcuucauagcgugggaacacauaaacaaacuaagacucguaucccccucuggcacacgggaacucacagacgaagaacggcggcuauuguacgaacaagccuuccagaaaaacaaacuaaccuaccacgacauaagaacccugcugcaucucccagacgacacauacuucaaagggauagucuacgacuggggagaaccacuaaaacaaaacgaaaacauccgcuuccuagaacucgacgcguaccaucaaauucgcaaaacaguagacaaagucuacgggcgcggaaaaagcagcuccuucuugcccauagacuucgacacauuuggguacgccuuaacucucuuuaaagacgacgcccacauccgcuccuaccuccgcaacgaauaugaacaaaaugggaagcgaaucgcaaaccuagccaacaaagucuacgacaaugaacugauagaggaacuccucaaccucucauucaccaaauucggacaccucucuuuaaaagcccuacggaacauucucccauacauggaacaaggcgaagucuacucgucggccugcgaaagagccggcuacaccuucacaggccccacuaaaaagcaaaagaccguccucuuaccuacuauaccaccaaucgcuaacccagucguaaugcgcgcgcuuacacaagcacgaaaagucgucaacgccaucaucaaaaaguacgggagcccagucagcauucauaucgaacuagcacgagaccucagccagacuuucgaugaacgcaagaaaaccaagaaagaacaggacgagaaccgaaaacgaaaugaaaccgcuauaaggcagcucaucgaauauggccuaaccagaaaccccaccggccaugacaucgucaaauucaaacuuuggucagaacaaaacggccgcugcgccuacucacuccagccaaucgaaaucaaacgacuacucgaaccgggcuacguagaaguagaccacgucaucccguacagcagaucgcucgacgacuccuacaccaauaaaguacucguacuaaccaaagaaaaccgcgaaaaaggcaaccgaaucccagcagaauaccugggagucgguaccgagcgguggcagcaguucgaaacauucguacuaacaaacaaacaauucuccaaaaagaaacgcgaccgccuacuccgacuucacuacgaugagaacgaagaagcagaauggaaaaaccggagcuuaaacgacacccgauacaucagcagguucuucgcaaacuucauacgagagcaucugaaauucgccgacagcgacgacaaacagaaaguguauacggucaauggcggcgucaccgcgcaccuacgcucucgaugggauuucaacaaaaaccgcgaagaaagcgaccugcaccacgccgucgacgccgcgauaguagcaugcacaacgcucucggacauagcgaggguaaccgccuucuaccaacgacgagagcaagcaaaagaacuggccaagaaaacagaaccccauuucccccaaccauggccccacuucgcggacgaacuccgagcacggcucagcaaaaaccccaaagaaucaaucaaagcccucaaccuaggcaacuacgacaacgagaagcuagaaucucugcaaccaguauucguaucccgcaugccuaagagaagcgugacaggagcagcccaucaagaaacacuacggagauacauagguaucgacgaacguucagguaagauccaaaccgucguuaagaccaagcucagcgaaauaaagcucgacgccagcggccacuucccuauguacgggaaagaauccgacccccgcaccuaugaggcaauacgguuacgccuacuugaacacaacaacgaucccaggaaggccuuucaggaaccguuauacaagccaaagaaaaacggcgaacucggccccaucauaagaacaguaaaaaucauagacaccaaaaaccaggugaucccgcuuaacgacgggaaaacaguagccuacaacuccaacaucguccgaguggacgucuucgaaaaagauggaaaguacuacugcguaccggucuacacaauggacauaaugaaaaagguccugcccaacaaagccauagagcccaacaaacccuacucagaauggaaagaaaugacagaagauuacacauuccgauucagccucuaccccaacgaccucauacgcaucgagcucccucgugagaagacagucaagacgacggccggucaugagaucaauaucaaagacgucuucguauacuacaagacaauagacucagcaacaggaggccuagaacugaucagccaugacaacagcuucucccuacgugggauaggcucgcgcacccucaagcgcuucgaaaaauaccagguagacguccuaggcaacaucuacaaagugcgcggagaaaagagagucggacucgcuagcagcgcgcauccugaaacccgcgaaacaauccggccccugcaaagcacccgugacuga

SEQ ID NO: 6209 - RNA, 3264 nt, Artificial Sequence
  Cas9 variant
augaaaaagcuaguccuaggccuagacauaggaguggcauccgugggcuggggaaucaucgacgccgagaacggcgacgucguagacaccgggguccggcuuuucagcucucgagacgccucagaaaaugagagcaggcgcacaagccgccagucacgacgccucucacgccgaaagaaacaccgcagagaacgaaucaaacaauuacuucuggcccacgauauggacaucugcgacaucguaaacgaaaacccguaugaacuaagagucaaaggccuaaacgaaaaauuagaagucuccgaaaucuacguagcgcuaacccaccucgccaaacgacgcggugucuccuaccucgacgacguagucgaagaaggcggaaccaucaaauccgaacacuugaacaaaaacauggaagaaaucaaaucaggcaaaaugccaugcgagauacaacuugaaagauuugaaaaauacggccaaguccgagguaugaucgaaaucaaccaggauacugaagaaaguuccuuccuagugaacaucuucagaacuucggacuacauaaaagaggccaaaaccauccuagcgacccaacagaaguuucacaaacagauuaccaacgaguucaucgaugaguacauacacaucauggcaucaaaacgagacuauuucauuggcccuggaaacgagaaaagccgaaccgauuacggcguauaccgcacgaacggcgacacaugggacaacuuauucgaaauccucauaggcaaaugcucaguauuuccggaagaaacacgggcagcgcgcuccagcuacgucgcacaggaguucaaccuucuaaacgaccucaacaacuuaaagaucaguaaucucgaaagcggcaaacucagugccucacaaaagcacgacaucguggaaaaggucaagaacagcaagaaauucggcaccaaagaccugcuaaaauauauagcauccgugugcgaaugcaaaaucgaggacauuggaggaugccgaguagacaaaaaucgcaaacccauaaugcacaccuucgaaaauuacaggaaaguacacaacgcccucaaugaagccgguguagaccuacgccugucggaaaccgauuacgaugagcuaaugaagaucaugacacucaacagcgaaacccuggaaaucaagaaacagugcaaagaaaaacuaccacagcucaccgaggauuaccucaacguaugcuuggucuuaaacaaaaagggugcguucagcggauggcacgcccuaagccucaaagcaaugaaacucaugaugccugaacuauacggaaccucgaaaaaccagaugcaaaucauccacaccaugcaacuaggcaaagccuaucuaaagccccuaaaccaacaaaaauaccuaaacucggaagccauccucgaagaaaucuacaacccuaucgccgcucgaagcauacgccaaacgaucaaagucaccaacgccauacuaaagaaauacggccaccuagacagcgucaucaucgagaugcccagggacuaccaaacauccgaggacgagcgaaaaaugaucgaaaagaugcagaaagaaaacgaaaaagagaagaaagcagcgcucaaacgcgcucgcgaagaauacccguuccccgacgaagccuuccgaaaccacaaagaacucgcaacaaagcuacgacucugguaccaacaagaucaguucugcguauacuccggccgcaagaucagcguagucgaccuuguacgcaaccccaaccaauucgaaaucgaccacaucaucccccagucaguaagucuagacgacucccuaaacaacaaaguccuuugcuucagugaggagaaccaaaagaaaggacaacaaacgccguucuacuaucacaaaggcaagucugguaacuggacuuaugaacaguacaaacuauucguagagaaguuguucgacaagaagaaaauaagcaacaagaaacgggaacuccuacucuucgaagaggacaucaacaagugggacguucgccgcggcuucauagcacggaaucuagucgacacuagauacgccagccgagugauacuaaacucauaccaacaguacuucggcaaccaugaaaugggcacaaagguaaagguaguacgcggcaaauucacaucccaacuacgcaagaaguggcgcauauucaaggaccgcaacgaaagccauucacaccacgccaucgacgcacuaaucgucgcagccaccgcaaaccuacgccuauggaagaaaaacacccucggcguaagcgacgagggcaaaguuuacgacaaagaaaccggcgagauccucccauucgagaaacugacggaaucggaauauaacgaaaugaugaauaaggaaccauaccucaacuucaaaacgaaacuccagaacauagaaaccaaaguuaaguacucauacagaguaagcaagaaagucaaccgcaaaaucuccgaugcgacgauauacucaacccgagaacgcgauggaaucgacuacaucgugggaaagaucaaaaacaucuacgacgucaagacauacaaagaccaauuccucaaacgcuacaaaaagaacaaagaacaguuccuaauguaccaacacgacccccaaacguucgccauacucgagaacauaauggccaccuaccaagacgcugaaaacccguuccuagccuacaagaaagaauacggggucauaagaaaauacagcaagaaaggcgguggaagcccagucacaucgcuuaaauucaucgacaaaguguugggccagaaaaucgaccugaccgccaaaaaccaagcagcccucccgaaaaacaagaaagugguccuccagagcaucacacccuaccgcgcagacguuuacuacgacgagaucgacaaaagauaccaucucaucggcgucaaauacagccucuucucguucucaaaacagggauacgugauaaauccaaucgcguaccagaaacugcucgagaaagagcaaauccacucagaaaugaaauucugcuucagccucuaucgggaggauaucaucgaguucggggaagacccggacucacugacccgcuaccgguucuggucgaaaaacgaaagcggaaagaacaaaauagaggucaaaccgaucgaaaagccaaacuucgaaaaacaaaccguccuaaccaucacgaaaaagaucaaaauacucaacaaauaccaaacagacguacugggaaacucguucaaagcacaagaggaaaaagacccgcgcaacaucgaauga

SEQ ID NO: 6210 - RNA, 3264 nt, Artificial Sequence
  Cas9 variant
augcgcuacaaaauaggccuagacauaggaaucaccagcgucggaugggcggucaugaaccucgacauccccaggaucgaagaccuagguguuagaauuuucgaccgagccgaaaacccccaaaccggagaaagccuagcccuaccccgaaggcuugcucgcucagcucgccgcagacuccgacgccggaagcaccgacucgagcgaauccgacggcuagucauucgagaaggcauucuuacaaaagaagaacucgacaaacuauucgaggagaaacaugagaucgacguauggcaacugcgagucgaagcccuugaccgaaaacuuaacaacgacgaacucgcacggguacuccuccacuuagcgaaacggcgaggcuuuaaauccaaccguaaaagcgaacggucgaacaaggagaacucgaccaugcucaaacacaucgaagagaaccgagccauccuaucaucguaccggacuguaggcgaaaugaucguaaaagacccgaaauuugcccuccacaaaagaaacaaaggcgaaaacuacacaaauaccaucgcgcgcgacgaccuagaaagagaaauaagauugaucuucucaaagcagcgagaguucggaaacaugagcugcacagaagaguucgaaaacgaauacauaacaaucugggcaagccaacgccccguagccuccaaggaugacaucgaaaagaaagucggcuucugcaccuucgaaccaaaagaaaaacgagccccgaaggccacuuacaccuuccagagcuucaucgccugggaacacauuaacaaacuccgccuaaucucacccucaggcgcccgcggccucaccgacgaagaaaggcgccuucuguaugagcaagcauuccagaaaaacaaaauuaccuaccacgacauucggacacuucuacaccuccccgacgacaccuacuucaagggaaucguuuacgaccgcggcgaaucccgaaagcaaaacgaaaacauccgcuucuuagaacuagacgcguaccaccaaauacguaaggcggucgacaaggucuacggcaaaggcaaaagcagcaguuuccuacccaucgacuuugacaccuucggauacgcccucacacucuucaaagacgacgcagacauccacagcuaccucagaaacgaauacgagcaaaacgggaaacgcaugcccaaccucgcgaacaaggucuacgacaacgagcuaauagaagaacuucuaaaccuauccuucacgaaguucggacaccuaucccucaaagcacuucgcagcauacuucccuacauggaacaaggagaaguauacuccagcgcgugcgagcgggccggcuacaccuucaccggccccaagaagaaacagaaaacaaugcuacucccaaacauacccccaaucgcgaacccagucguuaugcgggcccucacccaagcccgaaaaguagugaacgcaaucaucaagaaauacggcagcccaguuucaauccacaucgaacucgcccgggaccucucccaaacauucgacgagcgacggaaaaccaagaaagagcaggacgaaaaccgaaagaaaaaugagacggcuauacgacagcucauggaauacggccucacacuaaauccuaccggccaugacaucguaaaauucaaacuauggucagaacaaaacggaagaugcgcauacucccuucaacccaucgaaaucgaaaggcuccuugaacccggauaugucgaaguagaccacgucauaccguacucucgaucucuagacgacuccuacacaaacaaaguccucgucuuaacacgcgaaaaccgagaaaaagggaaccgcauaccagcggaauaccucggcguaggcacagaacgauggcaacaauucgagaccuucguccuaacaaacaaacaauucuccaaaaagaaacgagaccgccuccuucgacuacacuacgacgaaaacgaagaaacugaguuuaaaaaccgaaaccucaacgacacacgcuacaucucgagguucuucgcaaacuucauacgggaacaccuuaaauucgccgagagcgacgauaaacagaaaguauacacugucaacggacgagugacagcacaccuacgcucgcgaugggaguucaacaaaaaccgcgaagaaucagaccuccaccacgcagucgacgccgccaucgucgcuugcacaaccccaucagacaucgcuaaggucaccgccuucuaccaacgacgggagcaaaacaaagaacuagcgaagaaaacagaaccacacuucccccagcccuggccgcacuucgcggacgaacugcgcgccagacuaagcaaacacccuaaagaauccaucaaagcgcuaaaccucggaaacuacgacgaccaaaaacuagaaagccuccaacccguauucguaucccgaaugcccaaacgcuccgucaccggugcagcacaccaagaaacccuacgccgguacguaggcaucgacgagcgcucgggaaaaauccaaaccguaguaaaaacaaaacuauccgaaaucaaauuagacgccucggggcacuuucccauguacggcaaagaaagcgacccccgcaccuaugaagcaauccgccaacgccuccucgaacacaacaacgacccaaagaaagccuuucaggaaccucuguacaaacccaagaaaaacggggaacccggcccaguaauucgaaccgucaaaaucauugacaccaaaaaccaaguaauaccacuuaacgacggcaaaaccguggcguacaacagcaauauagucagaguagacguauucgagaaagacggaaaauacuauuguguaccgguauacaccauggacauaaugaaaggcauacuccccaacaaggccauagagcccaacaaacccuauucagaguggaaggaaaugacggaggacuauaccuuccgcuucucccucuaccccaacgaucuaauacgcauugaguuacccagggagaaaaccgucaaaacagcagcaggcgaagaaauuaacgugaaggacgucuucgucuacuacaagaccaucgacuccgccaacggcggauuagaacucaucagccacgaucaucguuucagccuuagaggcgucggaagcaggacacucaaacguuuugaaaaauaccaaguugacguccucggcaacauauacaaaguacgcggugaaaaacgggucgggcuggcaaguuccgcccacagcaaaaccggagaaacaguacgcccacuccaaaguacccgcgacuga

SEQ ID NO: 6211 - RNA, 3264 nt, Artificial Sequence
  Cas9 variant
augcgcuacaaaauuggguuagacaucggaauaacgucaguaggcugggcgguaaugaacuuggacaucccgcggauugaagaccuaggcgugcgcaucuucgaccgcgcagaaaacccacaaacaggcgagagccucgcgcuacccagacgccucgcacgauccgcccgcagacgccuccggcgccgcaaacaccgucucgaaaggauacgccgccuagucauaagagaaggaauacugaccaaagaggaacuagacaaacucuucgaggaaaaacacgaaaucgacguauggcaacuccguguagaagcccuagaccgcaaacuaaacaacgacgaacucgccaggguacuccuccaccucgcaaaacgacgaggauucaaaagcaacagaaaaagugaacgcuccaauaaggaaaacucaacaaugcugaaacacaucgaagaaaaucgagccauccucagcucauaccguaccguaggagaaaugaucguuaaagaccccaaauuugcacuacauaaacggaacaagggagaaaacuauaccaacacaauagcccgcgacgaccuggaacgagaaauccgccuuaucuucagcaagcaacgagaguucggaaacaugagcugcacagaagaauuugaaaacgaguacaucacaauaugggccagccagcgccccguagcauccaaagacgacaucgaaaagaaaguaggcuucuguacguucgaaccaaaagagaaaagggcccccaaagccaccuacaccuuccaguccuucaucgccugggaacacaucaacaaacugcgccuaauauccccaucgggcgcccgcggacucacugacgaagaacgccgccugcucuacgagcaagcauuucagaaaaacaaaauaaccuaccacgauaucagaaccuuacugcaccuaccggaugacacauacuucaaaggcaucguuuacgaccgcggagagucucgcaaacaaaacgaaaauauacgguuccucgaacucgaugccuaccaccaaaucagaaaggcagucgacaaggucuacggcaaaggcaaaucaucauccuuucucccgaucgacuucgacaccuucggcuacgcccucacccuuuucaaagacgacgcagacauucacagcuaccuaaggaacgaguacgaacaaaacgggaaacggaugccaaaccuagcaaacaaagucuacgauaacgaacuaauagaggaacugcuaaaucucagcuucacaaaguuuggacaccuaucccugaaggcccuccgauccaucuuaccguauauggaacaaggagaggucuacucaagugcaugcgaacgcgcgggcuacaccuucaccggacccaaaaagaaacagaaaacuaugcuccuacccaauaucccgccaaucgccaaucccguaguaaugcgggcucuuacacaagcacggaaagucgucaacgccauaaucaagaaguacggaucacccguaucaauccacauagaacucgccagagaucuaucccaaacauuugaugaaaggaggaaaaccaagaaagaacaggacgaaaaccgcaagaaaaacgaaacagccaucaggcaacucauggaauauggacucacgcucaacccaaccgggcaugacaucgucaaauucaaacucuggagcgaacaaaacggccgaugugccuacucccuccaaccgaucgaaaucgagcgccuccucgaacccggauaugucgaggucgaccacguaauccccuacucccgcucacuugacgacagcuacacgaacaaaguccuaguacuuacacgcgagaaccgcgaaaaaggaaaccggauaccagcagaauaccuaggcguagggaccgaaagguggcaacaguucgaaacauucguacucacuaacaaacaguuuagcaaaaagaaaagggacagacuccuccgacugcacuacgacgaaaacgaagaaacagaguucaaaaaucgaaauuugaaugacacccgauacauaagcagauucuucgcaaacuucauacgagaacaccucaaauucgccgaguccgacgacaaacaaaaaguauacacaguuaacggcagaguuacggcccaccuaaggagcagaugggaauuuaacaaaaaccgcgaagaaucagaccuacaccacgccguagacgcagucaucguagccugcaccacacccuccgauaucgcgaaagucaccgccuucuaccaacgacgagaacaaaacaaagagcuagcuaaaaagacagaaccgcacuucccacagccguggccacacuucgcagacgaacuucgugcccgccugagcaaacaccccaaggaaagcaucaaagcacuaaaccucggaaacuaugacgaccaaaagcuagaaagccugcagccaguauucgucagccgcaugccgaaacgaagcgucacaggcgccgcccaccaggaaacacuacgcagauauguaggcaucgacgaacgcuccggaaagauacaaacaguaguaaaaacaaagcucucagaaaucaaacuagacgccuccggacacuucccgauguacggaaaggaaagcgacccacgcacauaugaagcaauacgucagcgacuauuagaacacaacaacgaccccaagaaagcguuccaagaaccacuauacaaacccaagaaaaacggagagcccggccccguaauccggaccgucaaaaucauagacaccaaaaaccaagugauaccccuaaaugacgggaaaacaguagccuacaacuccaacaucgugcgcgucgacgucuucgagaaagacggcaaauacuacugcgugccagucuacaccauggauauaaugaagggcauccugcccaacaaggcuaucgaacccaacaaacccuacucggaauggaaggaaaugacggaggacuacaccuuucgcuucagccuauacccgaaugaccuuauaagaauagagcucccacgcgaaaagaccguaaaaacagcggccggugaagagaucaacguuaaagacguguucguguacuacaaaaccauagacagugcaaauggcggccuggaacuaauaucccacgaccaccgcuucucccugagaggcgucgggagccgcacccuuaagcguuucgaaaaauaucaaguggacguacucgggaacauauacaagguacguggcgaaaaacgaguaggacuagccucuucugcacacucgaaaccgggcaaaacaauacgaccccuacaauccacccgggacuga

SEQ ID NO: 6212 - RNA, 3264 nt, Artificial Sequence
  Cas9 variant
augagguacaaaauaggccuagacauagggaucaccagcguaggcugggcagucaucaaccucgacaucccccgaaucgaagaccugggcgugcgaauauucgaccgagcagaaaacccccaaaccggcgaaucccucgcauugccccgccgcuuagcccgcucggcgaggcgccgccuacgacggcgcaaacaccgucuggaacggauaagacgacugaucaucagggaaggcauacuaacaaaagaagaacuggacaagcuguuugaagaaaaacacgaaaucgacguguggcaguuacgaguugaggcauuagaccgcaaacuaaacaacgacgaacuagccagaguccuucuccaccucgcaaaaagacgaggcuucaaaucgaacaggaaaucugaaaggucgaauaaggagaacuccacgaugcuuaagcacauagaggaaaaccgcgccauccucagcggguaccgaacaguaggcgagaugauagucaaagaccccaaauucgcccuccacaaacgcaacaaaggagaaaacuacacaaacaccaucgcccgcgacgacuuagagcacgaaauccgguuaaucuucuccaaacagcgcgaguucggcaacaugagcugcacugaaaaauucgaaaaugaauacauuacaaucugggccucccagcgcccagucgcgucgaaagacgauauagagaaaaagguaggauucugcaccuucgagccaaaagaaaaacgcgcacccaaggccacuuacaccuuccaaucauucauugccugggaacacaucaacaaacuccgccuaauauucccaucaggcgcccgaggucugaccgaugaagaacgccgucuacuauaugaacaagccuuccagaaaaacaaaauaacauaccacgacauccgcacacuguuacaccuccccgacgacacauacuucaaaggaauaguguacgaccgaggagaaagcagaaaacaaaacgagaacauccgcuuccuagaacucgaugccuaccaccaaauccggaaagccguugacaaaguauacggaaaaggcaaguccagcuccuuccuacccauagacuuugacacuuucggauacgcacuaacacucuucaaagacgacgcagacauacacagcuaccuaagaaacgaauacgaacaaaacggaaaacggaugccaaaccucgccaacaaaguauacgacaacgagcucaucgaagaacuccuaaaccucuccuucacgaaguucggccaucucagccugaaagcacuacggucaaucuuaccauacauggagcaaggcgaagucuacuccuccgccugcgaacgagcaggauacacauucaccggcccgaaaaagaagcagaaaaccaugcuacuacccaacauaccgcccaucgccaacccggucgugaugcgggcacuaacgcaagcccgaaaggucgucaacgccauaauaaagaaauacggaagccccgucagcauacacaucgagcucgcccgggaccuaucccaaaccuucgacgaacgcaggaaaaccaagaaagaacaagacgagaaccgcaagaaaaacgagacagcgauacggcaacucauggaauaugggcucacgcucaaccccacuggccacgacaucguuaaauucaaacuauggagcgagcaaaacggacgaugcgcuuacucccuacaacccauagaaaucgagcgccuacucgaaccaggcuacguagaagucgaucacgucaucccauacagccgcucacuagacgacagcuauaccaacaaaguauuaguccuaacaagggaaaaccgugaaaaaggcaaucgcauacccgccgaguaccucggcgucgggaccgagcgauggcaacaauucgaaacguucguccucacaaauaagcaauucagcaaaaagaaacgggaccgccugcuccggcuacacuacgacgaaaacgaggagaccgaguucaaaaacagaaaccucaacgacaccagguacaucagccgauucuucgcaaacuuuauccgggaacaucucaaauucgcagaauccgacgacaaacaaaaaguauacaccgugaacggccgcgucaccucccaccuccgcucccguugggacuucaacaaaaacagggaagaaagcgaccuacaccacgcuguggacgccgcgauagucgcgugcaccaccccaucagacauagcaaaaguuacggcguucuaccaacggcgagaacaaaacaaagaacuagccaagaaaacggaaccccacuucccccaacccuggccacacuucgcugaugaacucagagcccgccucagcaaacacccuaaagaauccaucaaagcgcucaaccugggaaacuacgacgaccaaaaacucgaaagccuccaacccgucuucguaagccguaugccaaaacgaucagucaccggcgcugcccaccaagaaacccuuaggagguauaucgggaucgacgaacgaaguggcaaaauucaaaccgucguaaaaacaaaacucucggagauaaaacuagacgccucaggccacuuccccauguacggcaaagaaucggacccucgcaccuacgaagcgauaagacaaagauuacuggagcauaacaacgaccccaagaaagcauuucaagagccacucuacaaacccaaaaagaacggcgaacccggccccaucauacgcaccgugaaaauaauagacacuaaaaaccaaguaaucccccugaacgacggcaaaacaguagcguacaacagcaauauaguacgcguggacgucuucgaaaaagauggcaaguacuacuguguacccgucuacaccauggacaucaugaaggguauacuccccaacaaagcaauagagcccaacaaacccuauucagaauggaaagaaaugaccgaagacuacaccuuccgguucagccuauaccccaacgaccucauccguauagaacuaccaagagagaaaaccgucaaaacaaccacaggagaagaaaucaacgucaaagauguauucguguacuacaaaacuauagacucagcaaccggcggccucgaacugauaagccacgauaaucgauucucgcuacgagguguaggcucccgaacccucaaacgauucgaaaaguaccagguagacguccuaggaaacauuuacaaggugcgcggggaaaaacgaguaggcuuggccuccuccgcccacuccaaaacaggagaaacaaucagaccccuacagaguacacgcgacuga

SEQ ID NO: 6213 - RNA, 3264 nt, Artificial Sequence
  Cas9 variant
augcgauauaaaauaggacuagacaucggcauuaccuccguggggugggcagucaucaaccuagauauacccaggaucgaagaucucggaguccgcauuuucgaccgcgcagaaaauccccagaccggcgaaucacucgcccucccgcgacgccucgcgcgaagcgccaggagacgccucagacgucgaaaacaccgucuugagagaauaaggcgauugcucauccgcgagggagucuuaacgaaggaggagcuggacaaacucuucgaggaaaaacacgaaaucgacguauggcaacuacgcgucgaagcgcuggaccgaaaacucaacaaugaugaacucguccgcguacuccuccaccucgccaaacgacgagguuucaagucgaaccggcaauccgaaagaucaaacaaagaaaacagcaccaugcucaaacauauugaagagaaccgcgccauacuauccggcuacagaacgguaggagagaugaucguaaaagaccccaaauucgcgcuacacaaacgaaacaaaggcgagaacuauaccaacacaauagcccgcgacgaucuagaacgagaaauacgacugauauucucaaaacaacgugaauuuggaaacaugagcugcaccgaggaguucgaaaacgaauacaucgcgaucugggccagccagcgaccgguggccuccaaagacgacaucgaaaagaagguaggcuucugcacuuucgaaccaaaggaaaaacgcgccccaaaggccacauacacauuccaauccuuuaucgcaugggaacacaucaacaaacucagacuaauuagccccagcggaacccgaggacuuacggacgaggaacgcagacuccuguacgaacaagccuuccagaaaaacaaaauuaccuaccacgacauccggaccuuacuccaucuccccgacgacacguacuucaaaggaaucguauacgacuggggcgaaagccuaaaacaaaacgagaacauacgcuuccucgaacucgacgcauaccaccaaaucaggaaagcgauagacaagguuuaugggaaaggcaaaagcuccagcuuccuccccauagacuucgauacauucgguuacgcacucacacuauucaaggacgacgccgacauccgcuccuauuugcggaacgaauacgaacagaacggcaagcgaaucgcaaaccuagcaaacaaggucuacgacaacgaacucaucgaggagcuccugaaccuuaguuuuaccaaauucggccaccugagccucaaagcccucaggaacauccuccccuacauggaacagggugaaguauacucaagcgcgugugagaaagcaggcuacacauucaccggccccaaaaagaagcagaagaccguacugcucccaacgauaccaccuaucgucaacccgguugucaugagggcacucacccaagcacgaaaagucgucaacgccaucauaaagaaauacgguagcccggucuccauccacaucgaacucgcccgagaccucucucaaaccuuugacgagcgucgaaaaaccaaacgcgagcaagaugaaaaccgaaaacggaacgaaaccgcgaucaggcaacuaauggaauauggacuuacucugaaccccacaggacucgacaucguaaaguucaaacucuggagcgagcaaaacggcagaugugcauacucacuacaacccauagaaaucgagaggcuacuugaaccaggcuaugucgaaguugaucaugugaucccguacagccgcagccuggacgacaguuacacgaacaagguccucguccucaccaaggaaaacagagaaaaggggaaucgcauaccagccgaauacuuaggcgucggaacagaacgauggcaacaauucgagacguucguccucaccaacaaacaauucuccaagaagaaaagggaccgccuccucagacuccacuaugacgaaaacgaagagauggaauuuaaaagccgcaaucucaacgacacccgauacauuagccgcuuuuucgccaauuucauaagggagcaucuaaaauucgccgagucagacgacaaacaaaaagucuacaccgugaacgggcgcguaaccucccaccucagaucaagaugggacuucaacaagaacagagaagaaagcgaccuccaccacgccgucgacgcagccaucguagcuugcaccacgccaucagauaucgcaaagguaaccgccuucuaccagcggcgugaacagaacaaagaacuggccaagaaaaccgaaccacaauucccacaaccauggccccacuuugccgacgaacuccgcgcccgccuaagcaaacacccaaaagaaucaauaaaagcccuaaaccuuggcaacuacgacgaccagaaacucgaaucacuucagcccguauucgugucccgaaugccaaaacgaaguguaaccggggccgcccaucaggagacacuccgucgguacaucggaauagacgaacguuccgggaaaauccaaacaguaguuaaaaccaaacucagcgaaauaaaacucgacgccucaggacacuucccaauguacggcaaggaauccgacccacgcacauaugaagcaauaagacagcgccucuuagaacacaacaacgacccaaagaaagcauuccaggagccccuauacaaacccaagaaaaacggcgaacccggccccauaauccgcacagucaaaauaaucgacaccaaaaaccaaguuaucccgcuuaacgauggaaagacagucgccuacaacagcaauaucguaagaauagacguguucgaaaaagacggcaaauacuauugcguccccgucuacacaauggacaucaugaaaggaguacuccccaacaaagcaaucgagcccaacaaaccguauuccgaguggaaagagaugaccgaagacuauaccuuccgcuucucccuguaucccaacgaccuaauacgcauugaacuaccgcgcgagaaaacagucaaaacagccgcaggcgaagaaauaaacaucaaggacauguucguauacuacaaaaccaucgacucagcaaauggaggccucgaacuaauuucucaugacaacuccuucucacuucgaggcgugggaucccgcacacuaaaacgcuucgaaaaauaccaggucgauguacuaggcaacaucuauaaaguacgcggcgagaaaagaguagggcuggcuucaagcgcacacuccaaaacuggagaaacaauccgcccccuacagucgacaagagacuga

SEQ ID NO: 6214 - RNA, 3267 nt, Artificial Sequence
  Cas9 variant
augcccaaagaguucgacccccucaaacccgccaaauacagauuagcuuuggacauaggauccaagucaauaggauuugccaucauauuccuaaaggaggacguaaacaaacuacucaagccauacgccaucguccgguccggagucaggauauucggagacggacgaaccccugccgcccccggacagcuaggauccagccuugcagccgaacgacgcgucaagcgcagcauacggcgccaguacgcccgaaaacgcaaacgccuucaacgacuccuccgcaacuugaaggaacucggcuuuuuccccgaugacucuaaacucugcaagagcuucgaggaccucaaccccuacgaacuccgccacaaaggacucaccaaagaacuaaaaccucacgaguucggcagauugcucaugcauauggccaaaaaucgagguuuccagaguaaccgcaaaguggaccuauuggccgacaacauagacagccaagcaaaggcagaaacguccgccaugaaaagugccaucgcgacccuucaaagccggcucaauggagaguucgaaacgcuaggcgccuaccuguacgaacguuucaaaaagggcgagacaaucaaaagcagcaaaacacagaagggacaaaaggcagaguaugaguucagcauuagccgcaggaugguuaaacaagaguucgaccgacucugggcagcccaagaacaauucaacccagaacucuucaacgaacaagccaagaacacccuaaaagacaccaucuucuuucagcguaaccuccucccacaaaaggucggaaaaugcaccuuucuaccagaacacgaacgagccuccaaggcacuaccaucaucccaauacuuucgcaucaucagcgaacugaauaagauaucauucaccgacgcggaaggacucauccucccaauaucacucgaacagcgcaacaaacuucuaaaaucucugcgcaucaaacaaaaacuaucauucgacagaaucagaacugaacucaaccucgacagcaccguacuuauuaaccuagaacacgccagcaaggauuccaucgaaggggacaaaacgggcuaccuccuaagcaagaaagaguacuucgggcccgccuggagggaccucagucuggaaacacaagacgccaucgucaccgcacuccucacacacgaaaacgaagccgaacucgugcaaaagcuaguagacgacuucaacauagcacaugacguagccaaagccuuagccaacgcacgccuagagagccaguacaugagacuaagcaaagaagccaucgaacgauuaauacccgaacucgagaaaggcgucgacucccaggacggcuauaaaguacccguaaaauaucaugaagccaccgaagccgcaggcuucggacaccacucggccuuacaagaaaauugggccgacuuccccacccucgaccucaaacaacuacacuccgaugacaacgacaaauauacggucgccgaacuaccacugcccuacuacggaaaagucaucacaagacaaguugccuucggaacaggcgacgucaacgacccaguggaaaaacgauucgguaaaaucgcaaacccgaccguccacauuugccugaaccaagugcggguacuccuagacgaaaucaucgcaaaauacggauauccuuacgaaguuaacauagagcuagcccgggaacuuaaacagaaccacgaacagcggcaacgaucuaucaagcaacaagccgccaacaagaaagagaacgaagaaauaagacgcgaaauaaagcaagcauacaaaguagagaaggcacggauaaucacggacuccgaaauaucaagagcagacaucgagaaguggagguuauggcgacgcucgaaaaguaaacucugugucuacagcggcaagaaaauaugcgaaaccaugauccuaaauaacgaaguggaggucgaccacauccuaccucgaagccgaaccggcgacaacuccuaccaaaacaaaguccuaguacuuaacaaagcgaaccgcaucaagucaaaccgcacccccugggaagccaaagaauuauucgaggcccaaggcuggagcuacgaggacauacuaaaucgcaugcgagcacuagacaaacaccaacuguuuagauucgccgagaacucgauggauaucugggacaaaaacuaccgcagcuucgaagcucgagcgcuaaaugacacccgauacauuagccgggucgucaaggauuaucucaaagucguaugccacaaagaccggauaguaguaagcaauggcgcccacacugcacuaauacgccgggaguucggucuaaacgaccucuuaggaaagaaaggcgagaaaaaccgagacgaccaccgacaccacgcgaucgacgcgugcgucaucggcgcacuagauaggagcaugcuccgaaaacuacaaaucgcaauggaagucgccgaaaaacaaaacucugccaggaacuucgucggccuacaagaacccugguucaacuucuccacacaaguaagacgguccauagggcagaucuacguaucacacaagccaaaccacaacuacgaaggcgaaaucuucgaggccucgaucuacgggcuaagacucaucagcgacaaacgcacagaaaaauacgucggcaucaaacgcaaccccgagaccgguaaaacugacaagcccaagaaauccguggucgucauuuccgacccgaaaacccaaaaucgcuacggacucagacacaaauuccacagcgaaggcuuacccaagaaauauuaugggcucucaucgucaagcguuuucugccuagagaucuacagagacgaaaaaggaaacuggcaagcauacaccauaccccgauacgaagccuaccgaauagucaaacgcagaggcguaaacgcucuauacgacaauaaacgaagcaacuucgaaggucgaccgcucgugaugcgacuuaugcgagacgacugcauagcauucgaaaagaacggagugaaagaaguguaccggauccagaaaauaaacggccucaagaaaaacauaacacuuacgagacacuucgacgccaacguugacgaccgcuaccgacgaauguuaaaagcccaaaaggccgaaaaagcuggggaagauuucgacagcgaagaccuaugugacgaccucguauucagcuccuucggcgccuccucccucuacagcaacaaggcacgaaaggucaccauaucacccaugggcguacuacgcgaccccggcuucaagggcuga

SEQ ID NO: 6215 - RNA, 3267 nt, Artificial Sequence
  Cas9 variant
augaagaaacucgugcucggacuagauaucggggucgcaucuguaggcuggggcaucaucgacgcggaaaacggcgacguccucgacgcgggcgucaggcuguucucaagccgagacgcauccgaaaacgaaagucgccgaaccagccgcaggcaaucacgacggcugucccggagaaagaaacaccggcgugaacguaucaaacaacuacuccucgcacacgacauggacgucugcgacaucgucaaugaaaauccauaccaacuacgcgucaaggggcucaaugaaaaacucgaaaucuccgagauauacgucgcacucacccaccucgccaaacgacguggcguaagcuaccuggacgacguuguagaagagggaggcgccaucaaaagcgaacaccucaacaaaaauauggaagaaauaaaaucaggaaagaugccgugcgaaauccaacuagaaagauucgaaaaguacggucaaguacgaggcaugauagaaaucaaccaagacaccgaggaaagcagcuuccucgucaacauauuccgcacaagcgacuacaucaaagaagccaaaaccauccucgccacccaacagaaauuccacaaacaaauaacuaacgaguucaucgacgaauacaucaacauaauggcgucgaaaagggacuacuucauagggcccgggaacgagaaaagcaggaccgauuacggaguguaccgaaccaacggcgacaccugggacaaucuauucgaaauccugauaggcaaguguucgguauucccggaggaaacacgcgccgcucgcagcagcuacgucgcgcaagaguucaaccuacuaaacgaccuuaauaaccucaaaaucucaucgcuagaauccggcaaacucagcaccagccagaaacacgacaucgucgaaaaagucaaaaacagcaagaaauuuggaaccaaagaccugcuaaaauacaucgccagcguaugcgaauguaaaauugaaaacauagacggaugccgaaaagacaaaaaccgcaagcccauaaugcacaccuucgaaaacuaccgcaaaguccacaacgcccuaaacgaggccggcguugaccuaagacucagcgaagcagacuacgacgaacuuaugaaaauaaugacacugaacucggaaacccucgaaauaaagaaacaaugcaaagaaaaacucccacaucucaccgaggacuaccucaaugucugucuagugcuaaacaagaaaggcgccuucagcggauggcacgcccucucacuuaaggcaaugaaacucaugaugccagaguuauacggaaccuccaaaaaucaaaugcaaaucauccacacgaugcagcuaggcaaagcauacaucaaaccacucaaccaacagaaguacuugaauagcgaggccauucuagaagagauauauaaccccaucgccgcgcgcucaauaagacaaacuaucaaagucacaaacgccauccuaaagaaauacggcccccuagacagcguaaucauagaaaugccgcgagacuaccagacgucggaggacgaacgcaaaaugauagagaaaaugcaaaaagagaacgaaaaagagaaaaaggccgcacugaaacgcgcccgcgaagaauacccguuccccgacgaggcguucaggaaccauaaagaacucgccacaaaacucagacugugguaccagcaagaccaauucugcgucuacagcggacgcaaaaucagcgucgucgaccugguacgcaacccaaaccaauucgagauagaucacaucaucccacaauccguaagucuggacgacucguuaaauaacaaaguccugugcuucuccgaagagaaccaaaagaaaggacaacagacccccuucuacuaccauaaaggaaaaagcgggaacuggaccuacgagcaauacaaacucuucguugagaagcuauucgacaagaaaaagauaagcaacaagaaaagggagcuccuccucuuugaggaggacaucaacaaaugggacguccgcaggggcuucauagcgcggaaccuaguagacacccgguacgccucgcgcgucaucuuaaauuccuaccaacaauacuucggcaaccacgagaugggaaccaaaguaaaagucguccgaggcaaauucaccagccaacuacgaaagaaauggaaaaucuucaaagacagaaaugagucucauucccaccaugccaucgacgcgcucauugucgccgcuaccgcuaacuuacggcucuggaagaagaacaaacucggcauaucggacgagggcaaaguuuacgacaaggaaacgggagaaauccuaccauucgagaaacucaccgccagcgaguacaacgaaaugaugaacaaagagccauaccuaaacuucaaaaccaagcugcagaacauagaaaccaaggucaaauacagcuauaaggucuccaagaaagucaaccgaaaaauaagcaaugacacaaucuacucaacccgagaacgggacgggaucgacuacaucguggggaaaaucaagaacauauacgacgugaaaaccuacaaagaccaauuccuuaaaagguacaaaaagaacaaagagcaauuccucauguaccagcaugacccccaaaccuucgcaaucuuagaaucaaucauggcgacuuacccagacgcagaaaaccccuucuuggcauacaagaaagaacacggcguaauaaggaaauacgccaaaaacaaggcaggagcacccguaacgucgcuaaaauucaucgacggagcguuagggcagaaaauagacguaaccuacaagaauaaagcagcacucccgaaaaacaagaaagucgucuugcaaaguaucaaacccuaccgcgcagacguguauuacgacgagggcaauaaacgcuaccaccucaucgggguaaaauacucacuauucagcuucagcaaacaaggcuacgucaucaacccuauagccuaucaaaagcuacuggaaaaggaacaaauccacagugagaugaaauucugcuucucccucuaccgcgaagacauaauagaaagcggcgaagaccccgacagccugacccgcuaccgauucuggucgaaaaacgagucaggcaaaaacaagauugaaguuaaaccgaucgaaaagccgaacuucgaagacagaaaagucaucacaaucacaaagaaaaucaaaauacuaaacaaauaccaaaccgacguccuaggaaacaguuucaaagcccaagaggagaaagacccucggagcauagaguga

SEQ ID NO: 6216 - RNA, 3267 nt, Artificial Sequence
  Cas9 variant
augaacuauaaaaugggccuagacaucggcauagccuccgucggcugggcaguaaucaaccuagaccucaaacguauugaagaccuuggagucagaaucuucgacaaagcagagcacccccaaaacggggagucucuagcgcucccacgcagaaucgcccgaagcgcccgccgcagacuccgaagacgaaaacaucgccucgaaagaaucagaagacuccucguaagcgaaaacguccucaccaaagaagagaugaaccuuuuguucaagcagaagaaacaaaucgacguauggcaacuacgagucgaugcccucgaaaggaaacuaaacaacgacgaacucgcgcgcguccuccuccaccuagcaaaacgccgcggauucaaaucaaacagaaaaucagaaagaaacuccaaagaauccucggaguuccugaaaaacaucgaagaaaaccaaagcauccuagcucaauacagaagcguaggcgaaaugauaguuaaagacuccaaguucgcauaucacaagagaaacaaacuagacagcuacagcaacaugaucgcacgcgaugaccucgaacgagaaauaaaacucaucuuugaaaagcaacgcgaguucaacaaccccgucugcaccgaaagacuagaagaaaaauaccuaaacauauggagcagccaacgccccuucgcuagcaaggaggacaucgaaaagaaaguaggauucugcacuuucgagccgaaagagaagagggcccccaaagccacauacaccuuccaguccuuuaucgucugggagcacaucaacaagcuccggcucgugagccccgacgagacacgcgcccuaaccgaaauagagagaaaccugcuauacaaacaagccuucagcaaaaacaaaaugaccuacuacgacauacggaaacuauuaaaccucucagacgacauccacuucaaaggccugcucuacgacccgaaaucgucccucaaacagaucgaaaacauccgcuuccucgaacuagacagcuaccacaaaauccgcaaaugcauagaaaacgucuacggaaaagacggaauccgaauguucaacgagaccgacaucgacaccuucggcuacgcccucaccaucuuuaaggacgacgaagacaucgucgcguaccugcaaaacgaauacaucaccaaaaacggcaaaagaguguccaaccucgcaaacaaagucuacgacaaaagccuaaucgacgagcuccuaaaccugucauucucaaaauucgcacaccucuccaugaaagccauccguaacauacuccccuacauggaacagggcgagaucuacaguaaagccugugaacuagcaggauauaacuucaccggacccaaaaagaaagagaaagcacuucucuugccgguaaucccaaacaucgccaaucccgucguaaugcgggcacucacgcaaagcaggaaggucgucaacgcuauaaucaaaaaguacgguuccccagucagcauucacaucgagcucgcccgcgaccugucacacagcuucgacgaacggaaaaagauccaaaaagaccaaaccgagaaucgaaagaaaaaugagacagccaucaagcaacuaauugaguacgaacuaaccaaaaacccaaccgggcuagauauaguaaaauucaaacucuggucagagcaacaagggagaugcauguacucucuaaaaccaauagaacucgaacgccuccucgagcccggauacguagaaguagaucacauacucccauacucaaggagccucgaugacagcuacgccaacaaaguacugguacuaacgaaagagaacagagaaaagggcaaccacaccccagucgaguaccuaggucucggaagcgaaagauggaagaaauucgagaaauucguacucgcaaacaaacaauucucgaaaaagaagaaacaaaaccuccuuagacuaagguacgaagagacugaagaaaaagaguucaaagaacgcaaccuaaacgacacccgauacaucuccaaguucuucgcuaacuucauuaaagaacaccuuaaguucgcagacggcgacggaggccagaaaguguacaccaucaacggcaaaauaacagcacaccuaaggagccgaugggacuucaacaaaaaucgcgaagagagcgaucuacaccacgcgguugacgcaguaaucgucgccugcgcaacacagggaaugauaaagaaaaucaccgaauuuuauaaagcccgagagcagaacaaggaauccgcgaagaagaaagagccaaucuucccccaaccauggccacauuucgccgacgagcucaaagcucgccucuccaaauucccccaggagagcaucgaagcauucgcccuaggcaauuacgaccgaaagaaacuagaaucacugcgccccguauucgucucacgaaugcccaaacgaagcgucacgggcgcggcccaccaagaaacacuacgacgaugcguaggcauagacgagcaaucgggaaaaauccagaccgccguuaaaaccaaacucuccgacauuaagcuggacaaggacggccacuucccaauguaccaaaaggaauccgacccacggacauaugaagccauccgccagcggcuccucgaacacaacaacgaccccaagaaagccuuccaggagccccuguacaaaccaaagaaaaacggggaacccggcccgguaauaagaaccgucaaaaucaucgacaccaaaaacaaaguaguucaccucgacggcagcaaaaccgucgcauacaacucaaauauaguacgcacagaugucuucgaaaaagaugguaaauacuacuguguaccuguauacacaauggacaucaugaaaggcacccucccaaacaaagcaaucgaagcgaacaaacccuauagcgaauggaaggagaugaccgaggaauacaccuuucaguucucccucuucccgaacgaccugguccgcaucguccucccacgcgagaaaaccauaaagacgucaacuaacgaagaaaucauaaucaaggacauauuugcauacuacaaaaccauagacagcgcaacuggcggacuugaacuaaucucacaugaccgaaacuucucccuuagagggguuggcagcaaaacccuaaaacgcuucgaaaaauaucaagucgacguccuaggaaacauacacaaagucaaaggcgaaaagcgcgucgggcucgccgcacccacgaaccaaaagaaaggcaaaaccguagacagucuccagucaguaagugacuga

SEQ ID NO: 6217 - RNA, 3270 nt, Artificial Sequence
  Cas9 variant
augaccgccuucaaacccaacccuuugaauuacaucuugggccuagacauaggaauagcaucaguagggugggcuaugguagaaaucgacgacaaagagaacccgguccgccuaauagaucucggcguccgcgucuuugaacgagcagaaaugcccaaaacaggagacucccucgcagccgcacgacgccucgcucgguccgugaggcggcucacccgcagacgagcccaccgacugcucagagcaaggcgacuacuaaagcacgaagguguacuaaaacccgaggacuucgacgaaaacgggcucguaaagccacugcccuacauccccaaacaaccacgaaacaccccauggcagcuccgagccgcagcccuggaccguaaacucaccccacuagaaugggcagcaguacuucuccacuuaguaaaacauaggggcuaucuaucacaaaggaaaaacgagggagagaccgacgacaaggaacugggagcccucuuaaagggagucgccgauaacacucacgcccuccaagcagggaacuuucggacaccggcagaacucgcauugaacaaauuugaaaaggaaagcggacauaucagaaaccaaaggggcgauuacucgcacacauucucccguaaagaccugcaggcggaacugguacuacuauucgaaaaacaaaaagaguucgggaaccccuacguaucggacgaccugaaaaacggaauagaaaaccuguuaaugacacaacgccccgcacuuuccggagacgcaauucagaaaaugcuaggccauugcacauucgaaccagccgaaccaaaagccgccaaaaacacauacacagcagaaagguucaucuggcugacaaaacucaacaacuugcgaauacucaaccaagguaacgaacgcccgcuuacggacgcagaacgcacuacacuaauggacgagccauacaaaaagucgaagcuaacguacgcccaagccagaaaacuucuagaccucgacgacaccgcguucuucaagggccuccgcuacgguaaagacaacgccgaaucagcaacacucauggaaaugaaggcuuaccaugccauuucacgcgcccucgaaaaagaggggcucaaagacaagaaauccccacucagccucagcccagaacuccaagaugaaauaggcacggcauuuagcuuauucaaaacggaugaagagauaacuggccgccuaaaaggcugccuucaaccagaaauacucgacgcccuccuaaaacacaucagcuuugacaaauucguccaaauaagccucaaggcccuucgccgaauuguaccgcucauggaacaaggaaaaagauacgacgaagccugcgccgaaaucuacggagaccaccacggucgacgaaacagcgaagagacccuauaucucccgcccauaccagccgacgagauccgaaacccgguaguccugcgcgcgcucucgcaggcacggaaaguaaucaacggggucggccgaagauacggcaguccugcccgcauacacauagagaccgcacgagaaguaggcaaaucauucaaagaccggaaagaaaucgaaaaacgacaagaggaaaaccguaaagacagagaaaaagcggccgccgaguuccaggaauacuucccuaacuucgucggagaacccaaauccaaagacauacuaaaacuucgccuauacagacaacaaaacugcaaaugccuauacucaggaaaagagaucaaccucggccggcuaaacgaaaaaggauacguagaaaucgaccacgcacucccguucagccgaaccugggacgacucauucaauaacaaaguacugguccugggcucagaaaaccaaaauaaaggcaaccggacgccauacgaauaccucaacggaaaagauaacuccagagaguggcaggaguucaaagcacgcguggaaacaucccgauucccccacuccaagaaacagagaauauuacugcaaaaauucgacgaagaaggcuucaaagaacgaaaccucaacgauacgagauacguaaaccgauuccuaugcaaauucguagcagaucacaugcaauuaacgggcaagggcaagcgcagaguauucgccagcaacggccaaaucacuaaucuacuacggggcuucuggggacugaggaaaguccgcgcggaaaacgacaggcaccacgcacuagacgcaguggucguagcaugcagcaccguggcaaugcaacagaggaucacacgauucgugagauacaaagaaaugaacgcauuugauggaaaaaccguagacaaggagaccggagagguccuucaucagaaaacccacuucccccaaccaugggaauuuuucgcacaggaggucaugauccgaguauucggaaaaccagacggaaaaccagaacucgaagaggccgacacccccgaaaaacuaagagcacuacuggcagaaaaacucaguucacgacccgaagcuguacaugaguaugucgcaccauuauucguaucuagagccccaaaccgaaaaauguccggacaaggacacauggaaacgauaaaaucacccaaacgccuugacgaaggcaucucagucgugcgcguuccccuaacacaacuaaaacugaaagaccucgagaaaaugguaaaccgggaacgugaacccaagcucuacgaagcacucaaagcccgccuggaagcccacaaagacgacccagccaaagcauucgccgaacccuucuacaaacaggacaaggcaggaaaucgcacccaacaaguaaaggcaguucgaaucgaacaaguccagaaaacgggcguauggguccgaaaccaaaacgggauagccgacaaugccaccauggucagagucgacgucuucgagaagggaggcaaguacuaccugguaccaaucuacagcuggcaagucgcaaaaggcauccuacccgacaaagcaauuaucgcauucaaggacgaagaagaguggcaacuaaucgacgacucuuucaacuucaaauucccccuccaccccaacgaccucgucgaagucauaacaaagaaagcgcguauauucggcuacuuugccagcugccaccgcggcaccggaaacaucaacauuagaauacacgaccuagacaacaaagucggcaaaaacggaauccuagagggaaucggcgucaaaaccgcccuaucauuccaaaaguaccaaaucgacgaacuaggcaaagaaauccgcccaugcagacuaaagaaaaggcccccaguacgcuga

SEQ ID NO: 6218 - RNA, 3270 nt, Artificial Sequence
  Cas9 variant
augaauguacgauacaaaauaggccucgacaucggcaucaccagcguaggaugggcagucgucaaccuugacauuccuagaaucgaagaccuaggcguccgcauuuucgaucgagccgaaaauccacaaaccggagaaucccucgcccuaccaagacgacucgcccgcagcgcgcgacggcgccugcgccggagaaagcaccgccuggaacgaauuagacgacuacugauaagggaggggauucucaugaaagaggaacuagacaaacucuucgaggagcgccacgaaaucgacguauggcagcucagaguggaggcccuggaucgcaaacucaacucagacgagcucgcacgaguacuacuccaucucgccaaaagaagaggcuuuaaauccaacaggaaaucagaacacaacucucgcgaaaacuccaccaugcucaaacacaucgaagaaaaccgcgccauacuaagcuccuaccgaacaguggccgaaaugauagucaaagacccuaaauucgcccuccauaaaagaaacaagggcgagcauuauacaaacacgaucgcaagggacgaucuggagcgcgaaauccagcucauauucacgaaacaaagggaguucggcaacaugaacuguaccaaagaguucgaaaacgaauauaucgccaucugggccucccaaagaccauuugccuccaaagacgacaucgaaaagaaaguaggauucugcacguucgaaccaaaagagaaaagggcaccaaaagcaacuuacaccuuucagagcuucaucgcaugggaacacaucaacaaacuccgucucguuaguccggcgggaaccaggggacucacagacgaagaaagacgacuccuguacgaacaagccuuccagaaaaacaaaaucacauaccacgauauaagaacccuccuccggcugcccgacgacaccuacuucaagggcgucguguacgaccgaaacaugccacucaaacaaaacgaaaccauacgcuuccucgaauuggaugccuaccaccaaauucggaaggucaucgacaaagcguacgggaaaggaaaauccagcucauuccucccaaucgacuucgacaccuucggauacgcccucacucucuucaaggacgaugccgaugucagaagcuacuuacaaaacgaauacgaacaaaacggcaaaccaaugcccaaccucgccaacaaaaccuacgacaacgaacuaauagaggaacuacuaaaucucagcuuuaccaaauuuggacaccuaucccucaaagcgcuccacaacauccugccauacauggaacaaggcgaagucuauagcagugccugugaacgggcaggguacaaauucaccggaccgcguaagaaacagaaaaccaugcuacuccccaauaucccaucaauagccaaucccgucgucaugcgggcacugacccaagcgagaaaagucgucaaugcaaucaucaagaaauacgggucaccagucaguauucacaucgaacuugcccgcgaccuaagucaaaccuucgacgaacgccgaaaaacaaaacgcgagcaagacgaaaaccgcaagaaaaacgaaaccgcgauucgacaacugauggaguacgggcucacacucaacccaacgggccaugacauugucaaauucaaacucuggucagaacagaacggcagaugcgccuacucacuccaaccgauagaaaucgagcgacuccuggaaccuggguacacagaaguggaccacgucauaccauacucgcgcucccuggacgacucguacaccaacaaaguccuaguccuaacgaaagagaaccgagagaaagggaaccgaaccccugcagaauaccucggcgucggaacggaacgcuggcaccaauucgaaacauucguccucacaaacaaacaguucuccaaaaagaaaagagaccgucuccuuagacuacacuacgaugaaaacgaagagaccgaguucaaaaaccgcaaccucaacgauacacgguacaucucacgguucuucgccaacuucauccgcgaacaccucaaauucgcggaaagcgacgacaaacagaaaguauacaccguuaacggccgcaucacagcccaccuucgcucacgcugggaguucaacaaaaaccgggaagaaucagaccuccaccaugcggucgacgcugccauaguagcaugcacaacaccauccgacaucgcaaaaaucacggccuucuaccaacgaagagaacaaaacaaagaacucgccaagaaaaccgaaccacauuucccacaacccuggccacacuucgcggacgaacuacgcgccagacuaucaaaacaccccaaagaaaguaucaaagcucuaaaccuaggaaacuaugacaacgagaaacuugaaucacuccaccccgucuucguaagccgaaugcccaaacgcuccgucaccggagccgcgcaccaagaaacccugaggcgcuacgucggaauagaugaacguucaggaaaaauccaaacgguagugaaaacgaaauugagcgaaaucaaacuggaugcauccggacauuucccuauguacgggaaagaaucggacccgcgaacguacgaagcuauccgacagcggcuguuggagcacaauaacgacccaaagaaagccuuccaagaaccgcuuuacaaaccuaagaaaaauggggaaccaggcccaauaauuagaaccgugaaaauaauagacaccaaaaaccaagucgucccucucaacgacggcaaaaccgucgcauacaacaguaacauagucagagucgacguauucgagaaagacggaaaauacuacugcguacccguauauacgauggauauaaugaaaggcguccucccaaacaaagcaauugaacccaauaaaccauacuccgaauggaaagaaaugaccgaagacuacaccuuccaguucagccuguaccccaacgaccuaauaagaauagaacucccgcgagagaaagccauccgaacauccaccggugaggaaauuaagaucaaggauuucuucgcauacuauaaaaccauccacucuggcacaggcgguauggaacugaucucucacgaccgcagcuucucccucucgggcguaggaaguaggacccucaaaagauucgagaaguaccaaguagacguccuaggcaacauauacaaaguacgcggggaaaaacgcgucggacuggcguccagcgcccacuccaagaccggaaaaaccguccgcccacuccaaagcacacgagacuga

SEQ ID NO: 6219 - RNA, 3273 nt, Artificial Sequence
  Cas9 variant
augagauggcgccuaggacuggacaugggcgcugguucacuaggauggugugcagucggacuugacgaccaaggauacccggauucaauccuggcagccggaucccacaucuucggagaugggcgagcaccaucccgaggggaccagcaagggaccccacugggcgucgagcgcagggcagcaaaggcaaugaggcgcagacgcgaucgcuuccugggaagacaggcaaaacugcuugcgagacucacacucgcgggcuuguucccagcagaccccgugagagcgaaagcacucgagcuccuggacccauacguacuaagagcccgcgcacuggacgaagcacuuccaccucaccagcuaggacgagcguucuuucaccucaaccagcguaggggcuucaagucaaacagaaagacagaccgaggcguagacgacgaggccggaaagaucgcaaucggcaucgacagauuacgcgcugcaauagcagcggcugaagcaagaaccaugggagaguuccuacacaaacgacggcaaucagccccggacguaaaucaaauaccaaguguaagaacgcgauuacgaccagaaacaggcgaagaagcaaaaggugacggguacgauuucuacccaggacgcgaacucguggaagaggaguucgacgcaauaugggacgcacaagcaccacaucacccaagucuacuaacaccugauaacagagcccuccuucacgaagcaaucuucuaucaacgcccgcuaaaagcaccuaagauaggcaagugcacacuacugaacaacgaaccucgccucccaaaagcacacccauuauuccagagaagacgacuacucgaagaaguaaacgcgcucagaaucgugcggccgggcgaagucgcgaccaagcuaacaugcgaacaaagagaccuacucaugcucaaacugaaggacaaggcaaaaguuagcuucgaaacccuacggucaaaaguacucaaacuagagccagaggccagguucaacaaagagggagaaaaccggaccgagcuaguaggagacgaaguuugcgcacaaaugagugcgaaaacaagauucggcaaagcgugggcgcacuucacggacgagaaaaggugggccauccuaagccgacucaucgaagaagaagacgaagaaagauuagacacauggcugagaacggaacacggccuggaugccgaacaagcacgagcagucgccggggcacggcuccccgccgguuucggacgcuucggcgaaacagcaaccagaagacuaaucgcggcccugcaagcggaaguaaucguauacucagaagcaguggucgcagcaggcuuaggacaccacucagacaugcgcacgggcgaaguauuagcagagcucccauacuauggcaugacacuggaaagacaccuacucccaggcacgggagacaaagccgacccagaagaacuccggaucgggagacuuacuaaccccacgguacacauagcacucaacaggcugaggcgaauaguaaacagacucauaaaaaccuacgggcgccccgaacagauagccaucgagcugggaagagaacuaaaacuaaccgacgaagauaaacaacggcugucaagacaaaacaacagaaaccgagcagacgccgaagcacgcuccaagaaauuggcagaacucggacaagccgacaacggggcaaacagagcacgacugaaacugugggaagaacuaaaccgcgaaaacgcucuggaccgcagaugcauauacucaggccaacaaaucuccauagcaaugcuauucagugacgcggucgagguagaccacauccucccauucgacgcaacucuugaugacagcaacaauaacagaauacucugccuacgagaguggaaccgcaggaaaagaaagcagaguccuuacgaagccuggggacacacagacuacuggccagauaucgcagcaagggcagcaagacuccccaaagaaaagagauggcgcuuugaaccagacgccaugcaacgauucagcgcggaggaucgauucaucgcgcgccacuuaguagacacucaauacaugucgcgacuagcuagagaguaucucgaagcccuauacccagaaaagggcgaagggucaggccacguauggguaucaccuggccgacugaccgagcuaauaagacgaaaacuaggccugaaugaacuccugccagaccacaauuucgcuggugucaaaaaccgacuggaccaucgccaccacacuauagaugccuucgucguggcagugaccgaccggagucuccugcaaggcauaucacgagcaagcgcucucgagggagaggaagggcgagagagagucaucgugcccgaaccaugggacggcuuccgagaagcacuccgcacaacacucaacaccauaaccguauggcaccgccaggaucacggcaccgccaguaaagccggacuagcacaaggacgcgaccagaccgcgggcaaacuccacaacgauaccgcuuacggacucacgggaagacaagacacaaaaggaaacgaccugguggugagcagaaaaccacucaugucccuaaaaccagccgacaucgagcccguacccgacgucgcccccaucaccaaaggcgugagagauagagaccuaaggaaagcccucgcacacuucacccaagcaacggaaggaaagggguucuuacaggcgcucgaaagauucacgcggcucgggccccugcacuuucgcgguauucgacgagugcgacuaauccaaccccuagccguuaucccgauaaaaggccccggaggcgucccauacaagggcuaucuaggaggcgaaaauuuccgcugugaugugugggaaaugcccgacggugccuggaaaccggaaguaaccagcauguuucaggcccaccaaccgggguggacguccgccaucagagcagcguguccgacagcccgaaaggucuuaagccuacacaagagagacaugaucgcuauagagcgcgaagaagggguacgcacacugauggucgucgcccagaucuggagcaacggacaagucacgcuagucgaaccacacgaagcaggagaccucaacaaacgaaacaagagcgaagacgaccccuucggauacuucaugccgacagcgggagggcuaaaacgauugaaagcaagacagguucgagucgacgaguugggccgaguacaagaccccggauuccccgcaagaaaagccaggagacggaccaggccuaaacagguagacuga

SEQ ID NO: 6220 - RNA, 3273 nt, Artificial Sequence
  Cas9 variant
auggacuggcgacuaggacuagaccuaggcgcaaacagccucggaugggccgcacuuaggcuagaccgggcaggagaccccauaggcauacuggcgauggggucgcgaaucuucucagacggccgcgacccuaaaaguggcgcgucucuggccguggaccgcagggcugcacgagcaaugcggcgccgccgagacagauucaaacaacgacaagcagcccuccugaaauacuuaauaagggauggccucuuccccgcagaccaagcagacagacaacgccucgcagacgaagacccguacgcacugcgggccagagcgcuugacgaagaacucucccuauucgagaucgggagagcccuauuccaccuaaaccagcgaagaggauuccaaagcaaccgaaaagcggaccgaggacaagacgacgaagcgggcaaaaucgcagugggcguugacagacuuaaccaacagauggaagaacagggcgcccgaaccuuaggagaguuccuccaccaacgaaggcgagcagccaccgacgcaaaccacauccccucggugcggaccaggcuccgcccagaaacgggcgaaggagcgaaaggagacggauacgacuucuaccccucaagggcacucaucgcagaagaguucgaagagaucugggcagcacaagccccacauuaccccgacacacuaacccaacaaguccaugaccgacuauacgaaaucaucuuccaccagcgcccccuacgcgcaccccaaguaggccagugcacccugguagccggagaaaccagacuaccaaaagcacacccacuauuccagaaacgcagacuuuuagaggaaaucaacgcacuuaugauagugagacccggagagauagcacaacgacuaaccccagaagagagagacacucuauaccugaaacucaaagauaagcgaacaguuucauucgcaacacuuagaaagacccuaaaacuggacuccgccgcccgguucaacaaagagucggaaaaccgaacagaacuaaagggagacgaaguagccgccgaacuuggagccaaaacucgacuaggaaccagguggcaacaccucagcggagaccagcagugggagguaguacaccgucucauggcacuagaaagccaagcggacgaagcagccuuccgggacuggaucagccaaacuuacgaccuacugccagaacaagccgcugcaguacucggggcacgccucccacaaggacacggcagguucggaccaacggcaacaacaacccuaaucgauucacuccugcacgaccgaacagaagacggcaggguagucguauacucagaagcaguacaacgaucagggcuaggccaccacucagaccuccgacacgacagagacgacgaggacguuaccgaacuacccuacuacggcguggcacucgaaagacauauaaugccaggcacagcggaacccaccgacccagaagagaugcgaaucgggcgacuaaccaacccgacgguccacaucggacucaaucaacuacgacaugucguaaaccgcuuaauuagagccuacggaccgccaaaggaaaucgccauugaacucgcacgagaacuaaaacucagcgaagacgagaaaaagaaacgaaacagcgaaaaccgagacaacagacuagcagcagaaggcagguccaagaaacuugaagaaauacggcaaagagacaccggcgccaaccgcgcccucuuaaaacuaugggaagaacuaaaccccggaaauguccuagacagacgcugcaucuauacuggagagcagaucaguauagacaugcucuuuagcgacagagucgagguugaccacauccuuccauucgcccaaacccuagaugauuccaacggaaacaaacuacucugccugagagaagccaaucgggagaaaagaagacgcucaccauacgaagcauggggacacacagacagauggccagacauagcagaaagagcuucacgacuucccaaacccaagagauggcgguucgaacccgaugcaaugcaacgcuucgcaacugaggauggauuucucgcgcgacaccuaguggacacccaguauuuaggaagauuagcgagagaguaccuaagcuggcuuuauccaggccgaggagaaggaaguggucaugugugggugagcccaggacgucugaccgaaaugguccggagaaaauuaggccuaaacgaccuacugccagaccacaacuucggagguggagcagaccaacccaaaaaccgccuagaccaccgacaucacgccaucgacgcccucguaguagcaauagucgacagaggaaugcuccaagcgauagcacgagcuucgggacaagacgggagcgagggccgcgagcgaauacacauaccggcaccgugggacggcuuuagagacgaccuccgcgucgccguuaacggcaucauagucucacaucgaccggaccacggcaccguagcuaaggcaggccucgcaagaggacgagaccaaaccgccggucgccuccacaacgacaccgccuacggccucaccggagaaacagacgcgaaaggaaacuccaucguugugaggcgcaucccacucagcgccaucaagaaaccagcagacauagcgcgcguaagagacccacuauuacgaaacgcacuagcagaguuuaccaaaggccuugacggaaaagcauucgaagcccggauaggccgauuccacgaauuagggccccuacucuaccgcggcauacgaagaguccgcgucguagaaacauuaaccgugauacccauacgggacgccgaaggcagagcauacaagggauacaagggagacagcaacuaucgauacgacgucugggaaaugccagauggaaaauggcgcugccaggucguauccauguucgacgcccaccagagcacagaacaggcccgaccacacccagcugcaagaaaaauacuaagccuccaacgaaacgacauacuugcgaucgaaagaacagaaggagacagggaacucguaagaguugucaaauucucagaaaaacaguucgcggucgcaccgccacacgagggaggcucacucaaaacaagagacggaaaugcagacgaccccuucagauaccuuuauccgagcccaaacacucucaagggguggagagcaagacaaguuagaauagacgaguuggguagaguacuggaccccggcuuucccgcgcguaagagugugagacgaacaagacccagagccgcaccaguugacuga

SEQ ID NO: 6221 - RNA, 3276 nt, Artificial Sequence
  Cas9 variant
auguacaguaaccuccuauucucuuucgacaucggcacaaauucgaucggcuggugcguauucgcacucgaugaagcaggagaacccuacagaauagucgaccuaggcgcacgcaucuacgccgacggccgagacccacaaagcaaaacauccuuagcgguagcccgccgugaagcuagagcaaugagccgcagacgcgaccgcuaccuaaggagaagaaaggcaacccuuaggacuaugaucgaauacggacuaaugcccggugacaaagccggacaagaagcaguacucagggaaaccggcgaccgcgaaggaggugacgaaucauucaaccccuacgcacucagagcccgggcccugucggagaaauuaccgccggccuacaucggucgcguccuauuccaccuaggccagaggcgcggcuucaaaagcaacagaaagacagaucgaaaggacaacgacaaaggcaaaaucgcacugggcauagacgaacucacagcggcaaugcacagauccggaagcccaacacuaggcgcauggcuggcgaugcgcagggccgaaggccacagcguacgacugcgcgccggcagcgaagucuucgacgccgaaggcuacgcuuucuacccagaacguucccuacuugaagacgaguuccgacagaucugggacgcacaagccguccaccacccagacauacugacgcccgaacgacgcgcucaucuauuccgaguaauguucuaccaacgcccguuaaagaaaccucucgugggacgaugcagcuucaacccggcggaguuccgacuaucgagagcacauccccuauuucaagaguuccgccuuuacaaagaaaucaacgaccuagaggugguccucccagaccaaagccacagaaaacugacgcucgaugaacgaaacgcgcuggucgccaaacucaagacaucccgaaaagccucauucucagcccuccggaaaacacucaaacucaccccagaccugguauucaacaaagaaucggaggcacgcaaagaacuacuaggagacgagauuuacagcguauuagccgacgcaaaaauguucggcgcgcgauggggcggauucucccgagcaagacaaugggaaauuauuacucgccuaaaagaagaagaggacccugcaucacugaguagcuggcuaaaauccgaguucgggcuagaugacgaaagagucaccgcgauagccaaugccagccuaccggacggauacgggcgucuaggcgagaccgcccuagccucaaugcuagaagaacuaaaaaccgcgguaaucccagaaucagaagcagccagacuaugcggauaugaccacuccaaccucgccaaagaacaagacgaaggccucgacacccuccccgaauaucaagaaauccucgaacgccacauaccacccgggacaggagacccagacgauauauacgaccuccgcaaaggccgaaucacaaacccgacaguccauauaggacugaaccaacuccggcgaguagugaacgcacucauacaccgguucggccgcccccaacgaauaguggucgaguuagcgagagaccuccagcucagcgaaaaacaaaaagacgaugucaaccgaaggaucgccaaaaauacgagggaagcagaaggccgcucccaaaagcuaaucgaaaugggacagcuggacacgggauacaaccgacuacuacugaaacuaugggaggaacuuaaccucgacaagcccgaagaccgagucugcaucuacagcgggaagccuauaggaauagcaaugcuuuucagcggagaagucgaugucgaucacauacucccguggagcaaaacucucgacgauucccaagcgaacaagcuccucugccucaagucagccaaucgacaaaaacgcaacagaacaccaagugacguaccagaauggcgagaccgauacgacgaaguacuagcacgagccgcacgacuuccaaggaacaagagauggcgauucgccgccgacgcaaugcaacaguucgaagccgaaggagguuuucuagcccgacaacuaacagauacccaauaccuuagccgaauggcacuagaauaccucagcgcacucuaucccagcgaagaagcggacaaaucaggggaacuaagacagaggaaaagaguacacgucguacccggacgacuaacagagcugcuacggcgcaacuggggauuaaacacccucuuacccgaccauaaucucggcgaaauggcacaagagaaaaacagacgcgaccaccgacaccacgcaaucgacgcagcgguaauaggaaccaccuccagaagccuccuacaacgcaugagcggcgccgcagccagacucgacgacguggcauucgaugacuugguaagaaccgucgucaaagacaaucccccauggccgggcuuuagagaggaacuacuggcagcaauaggacgggugaccgucagccacaagccggaucacggaacggucagucgcgcagcauacgcacaaggcaaaggacaaacagcgggcaaacugcacaacgacaccgccuacggacugacaggccuaguagacgcaaaaggcuccccucucguuguaagacgcaaaccauucauggcgcuggagguaaaggacauugcaagcauacgcgacaccgaacuacaaucugcacuguacggcgcgaucggcucucuaacagaaaagaaagcgcuccaagaagcacucaucagguuccgagacacccacccacaauucaaaggcauaaggagaguccgcguccuggaaacacucucggucauccccaucguagacagagacggcaaagcauacaaaggcuacaaaggagacgcaaacuaccgauacgaggucugggaaacuuuggacggaaaauggcauacggaaguaguguccauguucgaugcacaccagcccggauggcaaucaccguuucacaagcaaaacccagcggcacgccgcguacuaaaacuucagcagaacgauaugguugccuacgaacauccagccgacggcuacaccauagccagaguuguaaaauucucaaacgacaagaggauauacuucgcgagccaccgggaauccggcagccuaaaagcgagggacgccgacaaaggugaccccuucuccuacuucgccaaagcaaacaacggacugcgcgacaucaaaugcaggcaaguccggauugaugccgccggcaggauauucgacccaggcccccaagaccgcgaaacacgccaggcaaacaaaggggucuga

SEQ ID NO: 6222 - RNA, 3279 nt, Artificial Sequence
  Cas9 variant
auggccuacacgaugggaauagacguaggaauagccuccugcggaugggcgaucgucgaccucgaacgacaacgcaucaucgacaucggcguucgaaccuucgagaaagcagaaaaccccaaaaacggugaagcccuggcagucccacggcgagaagcccgcagcagccggcgccgacuccgccguaagaaacaccgcauugagagacuaaaauacauguucguuagaaacggccucgccguggacauacaacaccuugagcaaacgcucaggagccaaaacgaaaucgacgucuggcaacuccgcgucgacggacucgauagaaugcucacccagaaagaauggcucagaguccuaauacaccucgcacaaaggcgcggcuuucaaagcaaccgcaaaaccgacggaucgucagaagacggccaagugcucguaaacgugaccgaaaacgaccgccugauggaggaaaaggacuaccguaccguagccgaaaugaugguaaaagacgaaaaauucucggaccacaaacgcaacaaaaauggaaauuaccacggggucgucaguagagcaagccuccuagucgaaauccacacacucuucgagucccagcgccaacaccacaauuuucuagcaagcaaagacuuugaauuggaauacaucaacaucuggagcucacaacgacccguagcaaccaaagaccaaaucgagaaaaugaucgggaccugcacauuccugccaaaagaaaaacgcgcgccaaaagccucauggcacuuccaauacuucauguugcuacaaacaauaaaccacaucaggaucacgaacgcccaaggcacacgcccccugaauaaagaagaaaucgagcagguagucaauauggcccucaccaagagcaaagucagcuaccacgacauacgcaaaguccucgaccugucagaggaauaccaguucguggggcuggacuauggaaaagaggacgaaaagaagaaagucgagagcaaagaaacgaucaucaagcucgacgacuaccacaagcuaaauaaaaucuucaacgaaguugagcucgcaaaaggugaaacaugggaagcagucgauuacgacacggucgccuacgcacucacuuucuucaaggacgacgaggacauccgagacuaccuccaaaacaaguacaaggacagcaagaaccggcucgugaaaaacguagcgaacaaagaauacacaaacgagcuaauagagaaagucuccacacugucguuccgcaagguaggacaccucucacuaaaggcacugcgcaagauaauacccuuccuagaacaaggcaugaccuacgacaaagcgugucaagcggccggcuucaacuuccaagggaucucaaagaagaaacgcuccguaguacugccggugauagaccaaaucuccaaccccguugucaaccgcgcacuaacccagacgcgaaaagucauaaaugcacucauaaagaaauacggcagccccgaaacaauccacauagaaaccgcacgcgagcuaucaaaaagguucgacgaacggaaaaacaucacgaaagacuacaaagagaaccgagacaaaaacgaacgcgcaaagaaacaccucagcgagcuaggcaucaucaacccaacaggacuagacaucguaaaauacaagcucuggugcgaacaacaaggacguugcauguacucgaaccagcccaucagcuuugaacgacuaagggaauccggauacaccgaagucgaccacaucauucccuacagcagaucuaugaaugacuccuacaacaaccgcguacucgugaugacaagagaaaaccgcgaaaaaucaaaccaaacgcccuacgaauacaugggcaacgacacccaacgcugggacgaauuugaacaacgcgugacaacaaacccccaaauaaagaaagagaaaagacaaaaccuccuccuuaaaggcuucaccaaccggcgagaacucgagaugcuagaacgaaaucuaaacgauacccgccacauuaccaaauaccucagucacuucauauccacaaaccuggaguucagcccuucagacaaaaagaagaaaguagucaauacaagcggucgcauaacaucccaccuccgcagccguuggggccuggagaaaaaccgagaacaaaacgaccugcaccacgcaauggacgccguagucaucgcagugaccuccgacuccuucauacagcaaguaaccaacuacuacaaaagaaaggaacgaagggagcuaaacggagaugacaaauucccacuacccuggaaauucuuccgagaagaggugauagcacgccucagcccgaacccaaaagaacaaauagaggcacuaccaaaccacuucuacuccgaggaugaacucgcagaccugcaaccaauauucgucucucgcaugcccaaacgguccaucacaggcgaggcccaccaggcccaauuccgccgaguaguuggcaaaacaaaagagggcaaaaacauaacugcgaaaaagacggcacugguagacaucuccuacgacaaaaacggagacuucaacauguacggcagagaaaccgacccagccacguacgaagcaauuaaagagagauaucuggaguucggcggaaacgccaagaaagcguucuccaccgaccuacacaaacccaaaaaggacggaacaaaaggcccacucaucaaaagcguacguauaauggaaaacaagacguuaguccaccccguaaacaaaggcaaaggagucgucuacaacuccagcaucguccgaaccgacgucuuccaacgaaaagaaaaguacuaccuacuacccgucuacgucaccgauguaacaaaagggaaacuacccaacaaagucauagcagcaaagaaaggauacgacgacuggaucgaagucgaugacagcuucaccuuccucuauucgcuuuaccccaacgaccucaucuuuauccgccaaaacccaaagaagaaaauaagccuaaagaaacgaaucgaaagucacagcaucagcgacagcaaagaaguccaagaaaucuugacauacuacaaaggcguagacucaagcacagcggcaaucgaguucaucacacacgacggguccuacuacgcaaaaggagucggaguccagaaccuagacugcuucgaaaaauaccaaguggacauccuggguaauuacagcaaagucaaaggcgaaaaacgccuagaacuugaaaccuccgacaacaaccacaaaggaaaggacguaaacagcauaaaaucaacaucacgcuga

SEQ ID NO: 6223 - RNA, 3279 nt, Artificial Sequence
  Cas9 variant
augaaguauuccaucggccucgacaucggcauugcaagcgucggauggucagucauaaacaaagacaaagagagaaucgaagacaugggagugcggauuuuccaaaaagcggaaaaccccaaagacgggagcucacuggcaucgagcaggcgcgaaaaacggggaucacgacgccgcaacagacgcaaaaagcaccggcuagacaggauaaagaacauccuaugcgagagcgguuuagugaagaaaaacgaaauagagaaaaucuacaagaacgcauaccugaaaagcccgugggaacugcgcgcaaaaagucuagaagccaagauuucgaacaaagaaaucgcccagauacuacuccacaucgcaaaaagacgaggguucaagagcuucaggaaaaccgacagaaacgcggacgacaccggcaagcuccucaguggcauccaggaaaacaagaaaauaauggaagaaaaaggcuaccuaaccauuggggacaugguagccaaagacccaaaauucaacacccauguacgcaacaaagcggggucauaccuguucucguucagcagaaaacuccuagaggacgaggucagaaagauacaagcaaaacagaaagaacugggcaacacccacuucacagacgacguccuggaaaaauacaucgaggucuucaacucccagcgaaacuucgacgagggcccauccaaacccucacccuacuacagcgaaauaggccaaauagccaagaugauaggcaacugcacuuucgaaucaucggaaaaacgcacagccaaaaauacauggagcggagaacgauucguuuuccuccagaagcucaacaacuucagaaucgugggccucagcggaaaacgaccccuaacagaagaggagcgcgacauuguggaaaaggaaguauaccucaagaaagagguccgauacgagaaacuaaggaagauacucuaccugaaggaggaagaacgauucggggaccucaacuacucaaaggacgagaaacaggacaagaaaacggagaaaacgaaauucauaagucugaucggcaacuacacaaucaaaaagcucaaccucagcgaaaaacuaaaaagcgaaauagaagaagacaaaagcaagcucgauaaaaucauagaaauccucacauucaauaagucggacaaaacgaucgaaagcaaccucaaaaagcucgaacuaagcagagaggacauagaaauacuccugagugaagaguucuccggaacgcuaaaccucagccuaaaggcaauaaagaaaauccugccauaccuggaaaaaggccucaguuauaacgaagcgugcgaaaaagcggauuacgacuacaaaaacaacgggauaaaauucaaacgaggcgagcuccucccagugguagacaaagaucucaucgcgaacccggucguacuaagagcaauaagccaaacgcggaaagucguaaacgccaucauccggaaguacggaacuccacacacgauacacguugaggucgcacgcgaccucgcuaagucguacgacgaccgccaaacaauaaucaaggagaacaagaagcgagaacuggaaaacgaaaagacgaagaaauucauaagcgaggaauuuggaaucaaaaacguaaaaggaaaacuccuauugaaauaucgccuauaccaagaacaggaaggccgcugcgcauacucaaggaaggaacugucgcucucggaggucauccuggacgaaagcaugacggacaucgaccacaucauacccuacucccgaagcauggacgacuccuacagcaacaaaguccuuguacucuccggcgagaacagaaagaaaagcaaccuauugccaaaagaauacuucgaccgccagggacgcgacugggacacauucguccucaacguaaaagccaugaaaauacacccccgcaagaaaucgaaccuccucaaggaaaaauucacccgcgaagacaacaaagacuggaaaagccgcgcccuaaacgacaccagauacauaagccgauucgucgcgaacuaccucgaaaacgccuuggaguaccgagacgacagcccaaagaaacgcgucuucaugauccccgggcagcuaacagcccaacuccgagcccgcuggaggcucaacaaaguccgagaaaauggagaccuacaccacgcacuggacgccgcagucgucgcgguuacagaccaaaaagcgauaaacaacaucucaaacaucagccgcuacaaagaacucaaaaacugcaaagacgucauccccaguaucgaguaccacgccgacgaagagaccggggaagucuacuucgaggaaguaaaggacacaagauuuccgaugccauggagcggauucgaccuagagcuacagaagagacuugaaagcgaaaacccacgcgaagaguucuacaaccugcuaagugacaaaagguaucuaggcugguucaacuacgaagaaggcuucauagagaagcuaaggccgguauucguaucccgaaugccaaaccgcggagucaaaggacaggcacaucaagagaccauaaggagcagcaagaaaaucucaaaccaaaucgccgucucaaagaaaccccucaacucgauuaaacuuaaagaccuagagaaaaugcaaggccgagacaccgaccgcaaacuauacgaagcccuuaaaaaccgccuggaagaauacgacgacaaaccagaaaaagcauucgccgaacccuucuacaagccaacaaacucgggaaaacgcgggccacucguccguggaauaaaaguagaagaaaaacaaaacguugguguauacguaaacggaggccaagcaagcaacggaagcauggugagaaucgacgucuuccgcaaaaacggcaaauucuacacgguacccauauacguccaccagacacuccuaaaagaacucccaaaccgagcgaucaacggaaaaccauacaaggacugggaccuaauugacggcagcuuugaguuccucuacagcuuuuacccgaacgaucugaucgagauagaauuuggcaagaguaagucaauaaagaacgacaacaaacuaaccaaaaccgaaauuccggaagugaaucuaagugaaguacucggauacuaucgaggcauggauacaagcaccggagcagccaccauagacacccaagacggcaagauccaaaugcgcauaggaaucaagaccgucaaaaacaucaagaaauaccaagucgacguccucggcaacgucuacaaaguaaaaagagaaaagaggcagacguucuga

SEQ ID NO: 6224 - RNA, 3285 nt, Artificial Sequence
  Cas9 variant
augaaauccacucucgcaauagcaagcaucucaucacucggaugggucaucgaacugggcgaaaaccgaaucaugcggcucggacucgacaucgguucuacgucaauaggaugguggaucuacgaaaccaccgacggccaaauuacguccguaauagacggaggcguccgcaucuucuccgacggccgagaccccaagagcaaaggaucacuagcaguagaucgccgcgucgccagagcccaaagaagaagacgcgaucgcuaccucagacggaaagcagcacuaaugaaacggauggcagaagugggccuaaugccaagcgauccuaaacaagcaaaacaacucgaagcacuagacccauacgaacucagagcaaggggccucgaugaaacucuagaacucacagaacucggacgcgcacucuuccaccucaaccaacgaagaggcuucaaaagcaaccgcaaaaccgacgccggcgauaacgaaagcggcaaaaucaucgacgcaacagcaagacuagacugggcaaugcgugaccaucgcgcacgaaccuacggggaguuccuccacaugagaagacaaaaagccgacacaccgcgcacaacaccagccgucaggacacgacucaccauugcagccagagacggggccgaaaaggaggaguccggcuacgacuucuaccccgaccgacaacaccuccgcgacgaguuugacgcccucugggaggcucaggcagaauaccacggcguacuuacagaggaccuacgugacgaaaucgggacgauaaucuuccaucaacgaccccugaaaaccccaaagguagguaaaugcuuauucaccaacgaagaaagaguagcgagcgcacacccgcugaaccaacgacgcauccuaguagagaccguuaacgcccugcgaguagcccaacucggugaagucgccagggcacucacgcuagaagaaagagacacaauccuacacgcauuagacaauaaagcccacaccaaaucgcugagcgggaugucaaucaaacuaaaggcacuuggcaaagugauuaaacucaggaguggccaauacuucacacuagaaacugccaaccgcgacgcgaucgcgugugaccccguaagagccucacuaagcaaaccagacagaauaggcuccuacuggagcacucucgaccacaacgcccagugggaagucgugaaucgcauccgggccguacaaagcgacgcggaccaccgcgaacucgucgccuggcuggucucccaacacagacuggcagccgagcaugcagaaggcgcagcguacgcgccgcuaccggacggauacucgcgacuaggaaucaccgcgacgaaacgcauacuagcagcccuagaagcaaacgucauacccuacagcaaggcgguagaaucaugcggguggcaccacagcgacgagcgaaccggagaaguccuggaucgacuacccuacuacggcgaaauacucgaucgacacgugaucccgggcacauacgacgacagugacgacgauauaacgcgguuuggucgcaucacaaaccccaccguacacauagggcuaaaccaacuaagacgacugguaaacagaauaaucgaaguccacggcaaaccagacgaaaucgucguagaacucgcaagagaccuaaaacuaagccaagaccaaaaagcagacgucgaacgcacgaucaagaaaaacacacaggcggcaauccgcagaggagaaaagcuagaagaaaugggaguacccaacaccggcgggaaccgaauggugcugcgacuaugggaagaccucaacgaugacgacguaaugaaacgauucugcccauauaccggacaaagaaucucagccgggaugcuauucgacggcuccugcgacgucgaccacauacucccauucucgcgcacacuagacgacggauucacaaacaagacccuaugccucaaagaagccaacagaaagaaacgaaacuacgccccacaugaagccgcggaaaaaggacuccucgaccgcgaugcaauggacucaguggcaaaauaccuaccagacaacaaagccuggcgcuuugcgccggaugccaucgaaagauucgagggagaacgagacuucacagcacgagcucuuaaagacacccaauaucucuccagacuagcacgaacauacuuagacgcacuauacgacgguggcgacgacaaaagccacgucuggguugugccgggaagacucaccgaaaugcuacgccgccacuggggacucaacggacuagaagcccuagccgacuccgacgagaaaacggugaaacgaaagaacaggacggaccaccgccaccaugccauagacgcugccguaguagcagcaacagaucggagccuaauacagaaaaucagcaaaauagccgccucagaugaacaagccggcgcggaagacacccucaaaagcacacccccacccugggacagcuucagagacgacauagccgcacagcuccaaaacauuacaguuucgcauagagcagaucacggacgcaccgacucgcuagccaagggacguggagaagacacaacaucaggcgcccuccacgaagcaacagcacuaggaaucaucgacgaaacccacgucaccguaagaauaccaauagagagccuaaagagcggacaccuaaucgaaggcucaagaaacggcuauauaagagauccauaucuccgggaucaacuaacauuagcaaccaaaaauggaagcgauaaagauuucacgacgguacuacagaaauuuuucgaccgcagcaaaagguauggugggacacgccgaguaaggauaauaaagacacuacaggauacggcacgcaucucaguaccgcacaacgcaccgaucaaggcauacaaaggaggcucuaaucacgcuuucgaaauauggagauuaccaaacggcaagauagaaucacagguaauuacuacaugggaacaccacaacuuaacagaaccaaaaagaccccaccccgccgcaaaacgaauaauccgauuacacaagacagacaugguugccaucgaaagagacggcaagacagucauuugcuucguccagaaaacggaccccagcaacggcgcauuccucguaccacacuucgaggccaacgcagacggccggaaacgcaaaaaugaaccgguagagugguaucaaaugucugccaacagccucauuaaagcagacuuaagaagaguaggagucgacgaaaugggaaggguccgagacccaggacccccacccauaagauga

SEQ ID NO: 6225 - RNA, 3285 nt, Artificial Sequence
  Cas9 variant
augaaauaccgaguaggcuucgaccucgggacaaacucacucgguugggcaguagugagacuaaacgccuccggagaaccggaucgcauugaagucgccgggucgaggaucuucucagacggcagggagcccaaaagcggggcaagucuugcaggagcgagaagagacgccagagcuaugcgacgcagacgagauagauucaagcaaagacaggccgcguuaaucaaguaccuaacgcaagcaggauucuuccccgcagacgagagcgaacgcaaagcacucagcgcgcucgacccauacgagcugagggcccgagcccucgacgaggcccucccccucgcccaucuuggcagagcacuauuccaccugaaccaaagacgaggauucaagaguaaccgaaaaacggacagaggaaagaacgacgauaccgggaaaauaaggauaggcgucgcgaggcuguacgaacagaugagagacgcagacgccagaacacugggagaguuccuccacaagaggcgcgcagcagcaagcgauccaaacgccauaccgcacguacgaaccagaaucgucacauuagccgcagaagacggcaaggcaagugacguauacgacuucuacccagaccgacagacgcuagaagaagaguucgaagcgauaugggaagcgcaaacaagccaccauccggaggcacuaacagaagaacgcagagcccaauucuaugaaaucaucuuucaccagagaccguuaaaacaaccaaagauaggauuuugcacacuacucccaccugagaaacgacuacccaaggcacauccccuauuccaaagaaggcgacuacuagaagaagucaacgcacuaagaaucguucuaccaggaaaagagacaagagcacucgaaaaggcggaaagggaugcacuacuaagcaaauugaaccaacgaaagaaagcagcauacgagagcuuaaggaaggcacuaaaacucgacccagaugccagguucaauaaggaaagcgacaaccgcgaagacaugauaggagacgagauagcggcagagauggcgcacaaauccagauuugggaaaguguggcucggaaugagcgcagaagcacaagcacaagucauagagcgccugcgagggcucgaaagcgacgcagacgcagacgauuucgaagccuggcugagagacgaccacgggcuagcacaagaacaagccaaggcaguuacagcagccaaccugccggaaggcuacggacgauucggagagacggcaacccgaaaacugauagcagcacucgaacaggaggucauuguauacagcgaagcaguacaacgagcagggcugggccaccauagcgaccuaagagacggccagguauggaccgacaagaaaggcaacccagcccuaccauacuacggcgcaguacucgaacgacacaucguaccaggcacagcggacccaaacgagacggacgacgcccuccggaucggcagacuaacuaacccaaccguacacauaggcuuaaaccaacuaaggagagugguaaaugcccuuaugcgaagguacgggcaaccacaagagaucgcaaucgaacuagcacgagaacucaaauuaagcgacgacagaaagaaagaaauaaacacccggaacagagaaaacaggaaagccgcagagaaaagaagccaaaaacuaagaaacaucggucaggcagacaaagggggcaacagggcacuccuaaaacuuugggaggaacucaaccccgaaaacgugcuggacaggagaugcguauacacaggacgcgucaucagcauagacaugcuguucagcggagcagcggaaguagaccauauacucccguucaguguaagucucgacgacagcaacggaaaccgcauacuaugccuaagggaagucaacagaauaaaaaggcagaggaccccgugggaggcacgagacgacuuacgagcucacuucgggccagacgcaggaugggaagccauagccgccagggcagcacgccuuccccgagagaaaagauggcgcuucgaaccagacgcagcaaaccgauucgacgcacaaggaggauuccucgcgcgccaccugacagauacgcaacaccuaagccgacuggcaagaaguuaccuaagcgcacucuacccggagaccggcgaaggcagcggccacguauggguaagcccaggacggcuaacagaaaugcucagacgggcaugguccuuaaaccaccaccuaccagaccacaauauugccggagcugccaaccaaccgaaaaauaggaaagaccauagacaccacgcaaucgacgcaauagucguggcgcucgcagaccgcgcgaugcugaaccgaaucgccagggaaagugguaaagaaggacacgaagccgccggcagacucguggcaagcauacccgagccaugggagggcuucagugaugaaguagguagagcaguacgagcgauaaccguaagccacagaccagaccauggaaccgcaucgaaagcaggccgggcuaaagacaaagacgcgacagcgggccgucuucacaacgaaacagcauacgggcuaacaggagaaaaagaugcgcgaggccuagacauaguuguaacccgcaaaccacuaucagcauucaagaaaagugcagaccuggacgcgauacgcgacgacgaccugaaacaaaaacugaaggcuugggcagcgggaaaagaagguggggccuucgaacaagcaaugagaaguuucggagaccccgaaagaggaccacggucgcacccuggccucagaagaauccgggugaccgaaccccucucagucauuccuauaagagacagagacggccggccauacaaagcauacaaaggcgacagcaacuacagauuugacaucugggaacuaaagacaggaaaauggaaggacgagguagucagcauguucgaagcccacagaccaaacuggaccuccccaauacgggccgggaaucccacagccagaaagguacugucaguacgccagaacgaugugauagcgauagagagggaaaacggaccagaacuaaugcgcguaguaaaguuuagcgcggggagccuagcacuagcacccccucaggaagccgggucccugaaagcccgagaugcagacaaaaacgaccccuuuaaauacguauaugguucaccaucaucacuccaaagauggaaggcaagacaaguacguauagacgaacucgggagaguauuugacccaggcuucgccgucagaagccgcagaagcucagaauga

SEQ ID NO: 6226 - RNA, 3291 nt, Artificial Sequence
  Cas9 variant
augaaaaacauauucuccuuugacauaggaacaaauucaauaggaugggcaguacuggcgcucgauggcaacggggacccggucagaauagcagaugcaggaguccgcauauucucagacggccgggaccccaaaucaaaagccagccucgcagaggcaagacgaauggcccgggcgaugucaagaagaagggacagaacacuccgacgaaagcgagccacccuaagaacacuagccgaaauaggccuaaugccggacaccagcagcgcucgccaggcccaacucagagaaacuucagaccccaaaagcggaucggggcaacucacccgaaacccauacgcacuucgcgcacuggcacuagaagaaaaacuaccauuauuccauauuggacgagcccuauaccaccucggacaacggagaggcuuccaauccaaccgaaaaacggaccgcaaggacaacgacaaaggaaaaauagcgcuaggaauagaagaacuccacgcugcaaugagacaagacggagcacaaacguacggucaauggcucgccagacgccacgcacucgggcaagccguccgccucagaucuggugcgcucgaccucgaaggagagggcuacgccuucuaucccgagagaaagcugcuggaagacgaguuccaucguauaugggaagcacaggcacgacacuaccccgacauccucacgcccgaaagacgggaucaccuauucacaguaauguucuuucagagaccccuaaagaaacccaaaguaggcaagugcuccuucaacaaccaagaagaacgacuaucaaaagcccauccccucuuccaagaguuccggcuauacaaggaagugaaugaacuggaaaucguagaacccgaccugacacacaagaaacucacccucgaccaacgcaacgcccuaguaaagaaacuccaaguaucacgcgaagcaucguucgccgcccuacgaaaaguccucaaacuacgccccgaccaacgauugaacaaagagucugaaagccgcacuaaacuaaaaggaaaugaagucuacgccguccugagcgacaaaacaagguucgggcccagaugggggacguuuucacaagcagaacagugggccaucauagaaagacuaaaagaagaagaggauccaggccgacuguucgcuuggcugcgaagcgcguucggcauugaaggagagcaagcagccgacauagcaaacguccaccucccagaaggacacggcagguuaggcaaaacggcacuugaggcaaugcuggaggaacucaaagccgaggucauaacggaagccgaagccgcuaaaagaugcggguacgaccacgcccgacuaggcgggggaucagacgaaggagaaccagagcuucccccauaucaagaaaucuuacaacacagaauaccacccggaacaaauaaccccgacgacccauacgacauugaaaaaggccgauucaccaacccaaccguacacaucgcccucaaccaauuaaggcacgucaugaauacacucaucaggcgguacgguaaacccgcccaaaucgcggucgaacuagcucgggacuuaaagcucucagaacggcaaaaagaagaagucaaccgaaccauugcgagaaacaccagggacgcggaacggagaggaaagacacuagaagaaaaucgaauacccaacacaggcuacaauagaacgcuccuaaggcuaugggaggaacuaaaccccggcaagguagaagacagguguugcaucuacacugggaaacccauuagcauauccaugcuauucagcggagaaguugacaucgaccacauccugccauggucccgcacacuagacgacucccacgggaacaaacuacucugccugcgggaagccaaccgagucaaacgaaacagagcaccagccgacguaacggaauggcgugacaacuacgacgaaauccucucacgugcggcaagacuaccucaaaacaaacgggaccgauucgcaccggacgccauggaacgguucgaaaaggccggaggauuucuagcucgccaacucacagacacacaauaucugagucgaauggcacucgaauaccuugcaugccucuucccggcugaagaaauggacggauucggcgagcuccgaagacacagguacauaaacguaugcccgggccgacuaaccgaaaugcucagacgcaacuggggguuaaacaguauacucagcgacucccagcuaggagaaaccgcccaagagaaaaacagaaaggaccauaggcaccacgccauagacgcuauaguaauaggaguaaccgguagaucgcuacucaaucgaaucucguaugcagccggacgccuagaagcacaacaacucgaaacacucgucaaagaagccgccgcaacgaacaaaccuugggacggguucagagaagacgucgcaaaggucgugggcggaaucaucguaucacacaaaccagaccacgguaccgcgggucgaaaagcgaaagacccggcacgccaacaaaccgcaggacgacuccacaacgacacagccuacggccuaaccggggaaacagaugcccgaggcaacacgaucguagucagacgaaaaccauuccuuucgcuuaccagcaaagacauccccuccauccgggacgaagcccugcgagcagugcuggaacagcaccuacgaggcaucccagacggaaaagccuuucaggccgcacuagacgcguuucgaaaacaaaaaggcuuccaccauuaccacggcauaagacacguaagacugaccgaaccucuauccgucauaggcaucaaagaccgcgacggaaagguauacaaaggauacaaaggcgacgcaaaccagcgauacgacguaugggaaacccucgauggcaaauggcacgcagaaguggucucaauguucgacgcccaccaaccaggauggcaaucacgcuuccacgcagaaaacccaacagccaggcggguccuccggcuacagcaagacgacauggucgcacuaaacgcgccagacggcggccgacuauuaguacgagucguaaaauuccgccaaaacggccaaauaaccuucgccggccacaacgaguccggcaaucuaaaagccagagacgcagcgucgaacgaacaagaucccuucaaauauaucagccgaauggccagcucacucaaagacuguggcugccggcaagucagaauagacgcaaccggacaaguguucgaccccgggccccaagacagagcaucaagacuccaaaaacaaucaaaacgauga

SEQ ID NO: 6227 - RNA, 3294 nt, Artificial Sequence
  Cas9 variant
augaagaaacaaccucaaagauacauacuaggacuagaccucggcauagccagcgugggcugggcacuaaucuuaguugacggcgcagaaaacccaguaggccuacucgacugcggaguccgaaccuuugaaagagcagaaguccccaaaacuggagacucacucgcgcucgcacgucggcaagcacgguccguaagaagacucauacggcgccgugcgcaccgacugcuacgccuccgccgccuccuaaaaagagagggaauacuuagcgcggcagacuucaacucagacggccuccccaaccucccaauagaugcauggcaguuaagagucgccggccucgaacgcaaacuaacuaaccaagaaugggcagcaguucuauuacacuugguaaaacaccgcggcuaucuuagccaacgcaaaucagaaacccaaacagaaaacaaagaacuaggccgucugcucgccggcguagccgaaaacagcaagcuccucagcgaaucuuccgaacaauaccggacuccagcagaacucgccgucaagcucuuugcagaacaaucuggacaccuacgcaacaaaggaggagaauacacacacaccuucaacagacuugaccuccaaaaagaacuccaccuacucuucgaaagacaguaugcccugggaaaccccuucgcauccgccgagcugcaaucuaagguagacgaacuacucaugacccaacgaagcgcacugcaaggagaagccguccucaaaaugcuaggcaaaugcacauucgaaccaagcgaauacaaggccgccaaaaacaccuacagugcagagagguucaucuggcucaccaaacuaaacaacuugagaauacuauacaacggagaagaaagagcccuugacgaaggagaccgaaagaaacuucuugacgaaccauacaagaaagccaaacuuaccuacaaacaaguccgaagcauacucaaucuaccagaaagcgcugucuucaaaggccuccgauacggcaaagacuccgacggccuuaaggcggaaaacggcacccuaauggaaaugaaagcauaccacaaaauccgaaccauccucgacaaagccggccuaaagggcgaaugggaaaaccgcauacgcaacccagagauacucgacaaaauagggacagccuucucacuauacaaaaccgacgaggacauucaagccgccuuggccgaccuccggcuccccgagaacguacuagacgcauuacuggcgggccucaauuucgacaaauucauucaacuaucccucaaggcgcuacggaauauacuaccacugauggagagagguauccgcuacgacgaagccugcaaggaaguguacggcgaccaucgugcccucgccgaaagcaaaaaccaaguauuacugcccccaauaccagccgacgagaucagaaaccccgucguccuccguacacugacacaggcgcgcaaggugaucaacgcgauaauccgacgauacgggagcccccaaaggguccacaucgaaacagccagagagcuaggaaagucgaaacaagaaagagacaagaucgaccgcaaaaacaaagagaaccaaaacgacagaaaccgacuugcaagugacauacgcaaacacuucaacuucgaaccgacacccaaggacaucuugaaacucagauuauacgaacaacagcacggcaaaugccucuacagugaccuuagggaggaaaaaggagagugccucuauacaggaaacguaaucgaacugcaccgacucuucgaagacggguacguagagauagaccacgcacuaccccugucacgcacgugggacaacagccucaacaacaaaguacugguacuaaagagcuccaaccaaaauaaaggcaauaagacacccuacgaauggcuggauggcgcaaacaacucccgucgguggcgagaguuccaagcaagaguacaagggugccacuucccauacgucaaaaagcaacguauccagacagccaaacuugauucaaaagcagaacaaggcuuucucgaaagaaaccucaacgacacaagauacauaagcaaauucaugugccaguuuaucacugcaaaccucagacuggcagaaacguccaacgcacuaauggaagagguggcaggcgaaaaccccuacuggaaagaacgcaaacgacaacgcguauucgcccccucuggaagcaucauagcacuccuacggggccuguggggacucaagaaaguccgcgaagacaacgacagacaccaugcccucgacgccauaguagucgcaugcagcaccguuagcaugcaacagaaaauuaccaaagcgaugcaacgacgggaaacauuagagaccguggacagugaaacgggagagguaaaaacacgcaucccccagcccugggacuucuucaggcaggaggugaugauccgaguauucuccgacuccccacgugaagaacuggcggaaaaacuaaacucgcgaccggaagcacuccacgacuucguaucaccccuguucguaagccgagccccuaaccgaaagaugacgggacaaggacaccuagagaccguuaaaucugcgaagcgccugagcgagaacauaucagucguaagaaaaccacucaccgcccucaaauugaaggauauagaaaacaucgucggauacccugaccgagagcccgcccucuaccaagcccuacgcgaaagauugcuagcccacaaggaugaccccgucaaagcauucgcagacaaacccuucuacaaaccagcaaaggacggaggccaagguucccuaguaaaagcaguucggaucauagagaacacaaagcacggccugaaaauacgaaacgggaucacggacaccaacggagacaugguacgcaccgacguauaccagaaaacagacaagaaagguaaaagacaauacuucaucgugcccgucuacgccuggcaagucgagaaaaacgaacuaccaaccgucgacugcaaaggauaugaaaucgacgacaauuaugaguucugcuucucacuauacaaauacgaccuaaucgaaauccaaaacccaaacgacauaaaccaagaacuaagggcauacuacaucaacugugauagcagcgacggucgauuuuggcucgcauaccacgacaaguccgcuaaggaacaacaauuccgaauaagcacacaaaaucagccaauaaucaagaaauaccaagucgacacccuaggaaaagagauccgucucugcaaagccgagaaacguacggcucuaaacggcaaaaagaagaaauga

SEQ ID NO: 6228 - RNA, 3294 nt, Artificial Sequence
  Cas9 variant
auggguaaaggcgacauacucuucaguuucgacauaggaacgaacagcaucggguggugcguauucgcacuaucagacaauggagauccgugccgcauucucgacgcuaaugcgagaaucuucgccgacggacgagaaccaaagucaggcaacucauuagcagaaggaagacgggcagcgagagccauggccaggcgccgugaccgauacaaaagaagacggaaagcaguccuccgaacacuaacagaguacgggcuaaugccggcggacccaaaagcccgacaagcccucguagccaaaacaggcgacaggggacccaaaucagaagaagcacuagcagacguauacucgcuaagggcucgagcccuaauggaaaaacugccgcuacaccacauaggccgcgccuuauuccaccucaaucaacgcagaggauucaaaucaaacaggaagacagacagaaaaucaaaugaaaaaggcgcgauagaaaccggagucaauagacuccucgaagaaaugcgcgauaccggagccccgacacuaggcgcuuaccuagcgaagcgccgauccgacgguagacccgugagagucagggcaggagccagcgaacaagaagccgaagacggcaagcccgcaaaaacggccuacgacuucuacccaguaaggaggcuacuggaggaagaguucgacgccaucugggaaaagcaauacucuuaccauccggaagugcugaccgaagaaagaaggggacaccucuuccggguaauguuucaccaacggccacucaagcccgcaauaguaggaagaugcagcuucaacucggccgaaacccgacuagcuaaagcacacccacucuuccaagaguuuagguuauacaaggaggucaaugaacucgaaguaguaaugccagaccaaagccaucgcaaacugacccuaccagaaagagacaggcugguccuaaagcucagaggccagaggaaagcgaccuacgcagcacuacgcaaagagcuccgccugcgcgaucucagguucaacaaagagaccgaaaaucgaacagacaugaugggagacgaaguaaccgcagcccucgcagauaaggcaguauucggcaaccgaugguccggcuucagcaccgaugaaaaauggagaaucgucgagcgacuacgagaagaagaagacccauucgcgcuacacgaauggcuaguaucagaacacgggcuaucagacgcagaagccgaacaagcagccaaaguccaucugccagacggauauggccgauuaggccccacagccgucagcacaaugcuggaggagcuaaaagccgacguaauaacagaagccgacgcagcaagacuagcgggauaugaccacagccuugcgcgcgccgacgaagacggucuagacagauugccaaaauaucaagagguacucgagagaaggaucccaccgggcaccaacgacccagacgacccauacgacauagccaaaggaagaauaaccaaccccacaguacacaucgcacugaaccaguuucggcacguggucaacgcucuagcgagacgauucggcaaaccagaccaaaucgccaucgaacuggcaagagagcucaaacugaacgaccgacagaaagacgaagugaaucgggugauuggacggaacacacgagcagccgcacuaaggagccaaaagcuacgcgacauaggccaaaaagacaacgguuacaaccgagcccugcugaaacuaugggaagaacuuaaccccgacaaaccggaagaccggguaugcguuuacacggggcgcccaaucuguaucuccaugcuauucagcggcgagguagacguugaccacauacuaccguggucccgcacaauggacgacagccaagccaaccguauauuaugcguuguagaggcaaaccgagucaaagcaaaucgugcacccgcggaaguagccgaguggggaggaagguacgacgaaauacuggaaagagccgcccggcucccacgaaacaaacgguggcgcuucgcaagagacgcuauggaaaaguacaaggaaaaugagggcuuccucgcacgucaacucaccgacacacaauaccuaaguagacucgcccgcgaguacgccgaagcccuauacccaacggaagaaccugaccgccuuggcgaacuaagaaggaggaaccacguacgcguaauaccaggacgacucacggagaugcuacgaagaggcuggggccuaaacgcacucuuacccgaccacaacuucggcgcaggccaagcuaaaaacaggaaagaccaccgacaccacgcaauagacgcagcaguagucggcgucacgaccagagggcugcugcaacguaucagcacugaggcaggacuacgggaaaagcuggcacuagaagaaacaaucgcagacaucccgaugccguggccgggcuuucgcgaggaacuaaaagcggcgaucgaccgcgccguagugagccacaaaccggaccacggcacccucccaaaacccggagaacacggcagaacagcgggccagcuccacaaugacacugcauacggcauuaccggcgaaaccgacgcacgcgggaacccgauaguuguccggcgaaaaccuuuccuaagccucacagacaaagacauaccgucaauccgagacaccgagcuacgaggaagaguauacuccgcaacaucaggccucuccggaagagaacuuucagcagcacuagacuacuuccgcaagacggacaagcaguuccgcggcauacgacacguccgagucacagaaagccugucaguaauaccgaucagggacagagacggaaacauauacaaaggauacaaaggggacgcaaauuuccguuacgacgugugggaacugcccgacggcaaauggaaggcggacguagucaccauguuugacgcucacaggccagaccgcgcagcggaagaacgacgcccacacccagcagccagaaaaguacuuucgcucaaacaaaacgacaugguagcaugcgaacaccccaaagacggauacacaauaggcagagucgugaaauucaacacagccggacaaauauacuucgccgcccacaacgaagggggcagccuaaaagccagggacgcagaccgagccgaccccuucaaauacuucuccaaauccgcaucaggccucaaggaaauagccgcaagacaaguccgcauagaugccacaggacaaguacuagacccgggcccgcaagaccgagagucucgacuagcaaggaacaaacgucuagagagagaacgagccuga

SEQ ID NO: 6229 - RNA, 3303 nt, Artificial Sequence
  Cas9 variant
augaaguacaccauaggacucgacaucgggacaucaagcguaggcuggggcguaauagacacagaaagaaaccgcauccaagaccuggggguacgccucuucgaaucagccgagaaccaaaaggacggggaaagccucgcaaagccccgccgugaugcaaggaguaugcgcagacgacuggcccgccggggcucacggcucgaacgcguaaaguccauauucgaaaaagcaaaauuuuuaacccguggacagauggggaucacccacgcgcgaccaaacgaccccuaccgccugagagcagaaggccucgaccgguuacucagcaacgaggaccuauucauagcagucuaccaccucgccaaacgccgcggauacaaaucaaaccgcaaaaacguccuugaaggagacggagaagacguccgcgaggguaaagccgucuuggacggaguagcacagaacaagaaacucauggccuuccgcggauaucgcacagucggcgaaauguucuuuaaagacagcguuuucaccgaagccaaacgcaacaaagcuggcagcuauaaacacugcguccugagagaaaugcucgaagacgaacuaggaaagauacuacaugcacagcgcagccucggcaauacauuagugaccgacagcuucauauccaaacuuuuagagaagaaaaccggggucuucguuuaccagcgucccuucgccagcggaaaccaaauacucaaacucgucgguccaugcacauucgaacccgaggagaucagagccgccaaagccaccuacuccuuccaguacuucaacguccuccagcgccugaacaaccucaccauuaaaaacaccgauacggggacagaaagaaaacucaccucggaagaacgcgccaaaaugaucgcauucaucuucagccacaaagacgugcaguacgcccaaauccggcucgagcuaaaacucucagaugucgacagauuuaacauggugaacuacuucguccaaagaaaagaacucgaaacgaaaacagccgaggaacucagacgagaaauugaaaagaaaacgaaauucccguccuugucugauuacuacaccauaagaaaaacagucuccgaaauagacuccgcauucuggauucagauagagaaacagcacgacgucaucgacgccaucggcgaaaucuuuacacucuacaaaaccgacgaggacauaaucgcccaacuaaacacaagaauccccuccaucccgcgaccaguggucagcgcccuccucggccucagcuucacaaaguucggucaccuauccuuaaaagcccuaagaaaaaucaucccgcaccuagagaacggcgacacauaugacgucgccugcgcaaaagcagaccccaaauacacagacagagcaaaaacacgcgcccgcaaacuccgcccacucgauaaagaggaccacagcaucaccaacccggucgccagacgcgccauagcacaaacaauaaaagucgugaacgccaucauugacaaguacgacagccccucagagguacacauagaacucggacgagaucucgccaaaaauuucaaggagcgcaugaagauccaaaaagagcaaaagcaaaaccaagagggcaacgaacgagccauagccaagauacaugagcucuacaagcucgaaaacccgaggggccaggacaucaucaaauucaggcuguggaacgaacaaaacggccaaugcauguacucaggagaacgaaucgaugaaauucgccuauucgacaacggauacacugaaaucgaucauaucauccccuuuagccgguccuucaacgacaguuacagcaacaaaguccuaguacucaagaugcgaaaucaggagaaaaugaacaaaacacccuacgaauacaugggaggcgaugccgacaccuggcaaagauucgaaaaccuaguaaauucaaugcacaacaucggccccaggaagaaacaaaaccugcucuuaaagaaauacguagcagacgaccucacccuaagaacccuaaaugacacccgauucauugcucgguacaugaaaaacuacaucgaaaacacccuccuguuuaccgaaggaccacaaaagcaacgagucuacacagucaacggccaagccaccgcauaccugcgaaaaagauggguccugcacaaggaccgcaccgaaaacaaccgccaccaugcccaagacgcaguuguuguagcaguggccaccccaucccuuguccaaggaauaaugaggcaugcgaaaaugggcgaaauaguggacuaccuacacucacaaaaguuugcccccaacgucacagauauugaaaccggcaaacccuucgaauccgcagacauccagagcgcaaaagaacgcauaauagccaaacacgaacaccgucuccgcauccccgaaccuugggaaggcuucucagacgaacucgaugccagaaugggugacgauguaguagaaaaacucucacuccguaaauccaacauacauggcuacaaaaccacauccgacuucucgcaaauacaccccauauucgucagccgcaugccgaaacgcaaaacaacaggcagagcccaccaagaaacccugcgaucgccccgccgcuucaaagaguuccaagagucgguagugcgaacuccccuaucgagcauaaaccucaagaaacuggaggagauguccgguaaaaacucagacaaacuccucuacgacauauugcgcaaacgccuacucgcgcauggggacgacccaaagaaagcauucaccgagcccguccacaaaccccgaaaagacgggacacaaggcccccucguucgaucgaucaaaaugguaagcgaaggacaacgcuccggcauucuagucaacaacgaacaagcacuuguggaccaagacuccaugauccgcauagacauauuuuccaaaccuaacaagaagggcaaggacgaguacuacauaauacccgucuacgccuaccacuucgcccagaaggaacuacccaauaagguaauaacagcaaaagccgaagccgacuggaggacuauugacgacaccuucgcauuugaauuuucccuauacccgaacgaccucgucaaacuaacaaagggagacgauauacgcuucggguacuacucgggcugcaaccgcgcacucgccgccauucacaucuuaccacaugaccaaaauaugccacucgugaacaacggcaucaaaacucuagacaaaaucgauaaauacgucgucgacauccugggagaguaucauaaagugggcaaagaaacacgacaacaaauccaauga

SEQ ID NO: 6230 - RNA, 3303 nt, Artificial Sequence
  Cas9 variant
augggagcgacgaucguaacggauaucagcagaagcgcauucgccuucgacaucggcaccaaaaguaucggaagugcuguacuacgguuagacgacaggggagaaccaauaggaauaauaaacgcagccguaagaauauacgccgacgguagagaaccaaaaagcgggacgagcuuagcagaaggcagaagacucgcacgaggaaugaguagaagacgcgaccgguacaagagacgacgacggacgcuacucaacacacugaccgaauuuggccucaugccacccacagaugaagcaagaaaagcacuacucgccgaaacuaacgacagacgcuucggggcaguagcgggcaacguauacgcgcugagggcgagggcucucgacgaaaagcucccccuucaccaccucggucgggcccucuuccaccuaaaccaacgccgaggauucaaaucaaaccgaaaaaccgacaaaagagacaacgaccaaggcaagauagccagcggaaucagccgacuagggcaaaaguuagaugaagcgggagcacggacgcuaggcgaguuccuacacagacaacacagcgcaggcaaaugggucagaguaagaccaagcagaguaccgagcaaggacgacaaagaggaggacggauacggguucuaccccgagcgcagcuuucucgaacgagaguucgccgcaaucuggaaggcccaggcugccuucuauccagaacuucucaccgaagaacguggagaccaucugcacagaguaauguucuuccaaagaccccuaaaacgucccaaaguaggcaaaugcucauucuaucccgaugaagacaggcugccaaaagcccacccacucuuccaagaguucaggcuagugaaagaacuaaacgaacuagaagugguccaccgaggagacagaagagaaaaacuaacgcuagaacagagggacacacucuucaaucagcugcgcacacaaagaagcagcgcauuuacggcgcuacgaaagacacuaaaagccccaaccgggacgcgauucaacaaagaaagcgacgcccgcgacaaacuaaaaggcgacgaaguugccgccgagaugagccauaaagacagauucgggcaagcauggauaggcaugcccuuggcugaaagaugggcggugauagaaaugcuucuagauacagaagacccacucgaaguaaaagccuggcucgaagaacacuacggauucgcugcagaccgaauagacgcgaucgcagcggcgaaacuuccaccaggcuacggaagacucggcgagaccgcacucagagacaugcuagacgagcuuaaaaacggaaccgucaaagacgacucaggccgugacguaguacucacagaacgacaggcgauggacaacauauggaaagacaacccagccuuacaacgaguagucgcagacgcgcgagagcuucccccauaccaagaaguacuaggacgacggauacccccaggaacgggaaaaccagaagacccauacgauguucaaaaagggcgccuaaccaacccaacagugcacaucggucuaaaucaacuaaagagagucgucaacgcccugguccgccgccacgggcgaccugaccaaaucgcccuugaacuagcucgcgaacucaaacuuaacgaggaacagaaagcagaaaaagaccgugaaaucgcgagaaauacgaaagcggcacaagcacgauccgagaagcuacgccaauuggacauagacgacaacggauacaaccgaguguuacugaaacuuugggaggaccuaaaccuccgccaaccggaaaaccgcgaaugcauauauugcgguaaagcgaucggaaucggaacacuauucaguaaccaaguagacauagaccacauccuuccauggagcaaaacccucgacgacagccaagcaaacagaauaguaugccacguggaaugcaauagacaaaaaggcaaccacgcgccggcagagguaccccaguggcaugacagauacgacgacauccuggccagagcagagcgacucccaaggaacaaggcauggagauuuggcagggaagcuaugaagaaguucaaagacgacgaaucauuccucgcacgacaacucaccgacacccaauaccuaucgagaauggcccacgaguacguagcagcauuauauccugacgaggaaccagaugaguggggagucuucacacggcgcaaccacguccgagucauaccgggcagaaugacugaaaugcuacggcgccaaugggggcuaaacgcgauaaucucagaccacgaccaaaagaacaggaacgaccaccgccaccacgcaaucgacgccauagucgucggcgugacaacucgacgcuuacuccaacgaauagcgacagcagcaggagggcgagaagcacuggcacucgaagaaaccauagguaaaaucgaaccaccauggcccggcuucuacgacgacguaaaagaggcaaucgaucgaauagucguaagccacaaaccagaccacgggagucuccccaaaccgggcgaaccggcucgaacagccgggcagcugcacaacgacacagccuacggguucaccggagaagaacgcaagggugucccgauaaugguucaccgcgugccguucgcaacauuaacagaaaaggacauccccucaauccgcgaucgacagcuagcagaagcacuauacggagccauagccggaauaucggggaaagccgagcucgcagcagcauuagcgcguuucucagcaucaggaccuuacaaggguauaaggcacgucagagugguagaacccgugagcgucaucgcaaucaaggaccgcgacgguacaccguauaaaggcuacaaaggcgacgccaacuaccgauacgacguaugggaacuaccaaauggcaaauggacccacgaagucguaaguauguucgacgcacacagaccugacuggcaaagugaaauacguaacaaaaacccagcagcccgcaaaguacugucccuacaccaaaaugauaugguagccuacgagcauccccaagauggguacaccaucggacgcgucguaaaauucggcagcggcgggcaaauggcacuggcgggcaacagggaagggggagcauuaaaaagcagggacgcggaccccgaagaccguuucagauacuucuauaaaagcgggggagccaugagagacgccagacugaggcaaguacgcgucgacgagacaggcagaguauucgauccaggaccacaagaccgagaaagcagaaacgcacgcaaacaaagcgccgccggcuga

SEQ ID NO: 6231 - RNA, 3306 nt, Artificial Sequence
  Cas9 variant
augaaaacccuagguuuggaucugggcacaaacuccuuaggcugggcaaucguagaaacaagagacgaaccaacgaaauacagcgaaggaucaauugucgcaucaggaguaagaaucuucucccaaagcgaaauggcagggagagauccccaaucgaaagccagccucgcgguagcccgacggcaagcacgaggaucacgacggagacgagaccgauaccucaagagacgacaacgguuaguugacuuacuggucgaccucggccuaaugccggcagacaaagcggcacgcgcagaacuggucaaaaaucacggagacgggaagacaggggaccucucaagcagcguauacgcauugcgugcccgcgcauuggacgaagcacuaagcccguacgaaauagggagagccaucuuccaccugaaucaaagacgcggcuucaaaagcaaccgaaaagcagauagcaacgacccggagcagggaguaaucucagaaggaaugagagcacuugacgagaaaauggcagaagcaggagcacgaacaauaggugaauggcugcacaugagaagacuacaaggccugccaguacgcgcccgaaucgcaccggacggagaaggcuacgcguucuaucccagucgaggggcccuagaaagggaguucgaucgaauaauggcaagacagacacuguuccacacagaccuccuaaccgacacagcaauaagggaacuacgagagguggucuuucaccagaggccgcuuaggccaguaaagcccggaaaaugcagcuacaacccccuggaggaacgacuagcaaaggcccaccccuuguuccagaaauucagacuacuaaaggagcuaaacgaacuagaaauaguaggggaagaccaaaaacacaucaagcuaacacccgaacagaggaacgcacuggcccugcaacuccgcacgagccuaacgaaacagggcaagguaccauucucgaagcugagaucaacacuaaaacucgggcgcgaaguccguuucaacaaagagacggauaacagaagcgaccuugagggagacgucauauacuuucggaugucccgacccgaaugcuucggaaacagaugggcagaccucccuguggaaaugcaagccgcaauaaccgaaagacuuagaacggaacccgacuacaaaacacucaugaauuggcucaaagcagagacaggccuggacgaaguccacgcgcgagcgguugcagacacgcccguacccgacggguucggccgccucggccagucagcgcugacagcacuaaucgacgcacuagaaaacgaagugggagaaggaggcuucguaaucacagaggccgaggccgcgaaacggguauacggaaggacgaacagcgaagcagaucccgaucgaaaaggaguagaugaacuccccaaauaccaagaaguacucgcccggcacaucccgcccggcaccggagaacccgacgacccguaugacgacuucaugggaagaauaacaaacccgacaguacauauagcucuaaaccaauuacgaagagugguaaacgcgcuaaucagaacguacggcaagcccgacagaauugcaaucgaagucggacgagaccuaaagaugaacgaccgagaacgggacgagguaaacagaagaauaggacgaaacacaaaggccgcgaucgagaggggagucaaauuaacagaaacauucagacaacuagacacaggauacaacaggcucaggcuggaacucugggaagaccuaaaucaaaaaccagaaaacagagucugcauauauugcgggaaagccaucgcaggacacaugcuguucaacggcgagacagauauagaccacauccuaccguacaguaaaacacucgaugacuccaaggccaacagaauacuaugcugcaccucgugcaacagagagaaaaagaaccggccaccaagccgcguaccacaauggagaucacgauauggagaaauacucgcccgcgcaacgacccucccgaaaaacaagcaguggagauuugcagaagacgcaaugacccgauucggcgaagaagaaggcuuccuagcaagacagcucacagacaugcaguacaucucacggcucgcccucacauaccucgcacaccuguacgacuaugaagaaguagaccuagacggaaucuacaaaagacacgcgagagucagagccuuaccaggcagaaugaccgagaugcuucguaggcaaugggggcuaaacgagcugcuacacgaccauaaccucauagggggcgacgucgccaaacccaaaaaccgcuuagaccacagacaccacgccauagacgcgauuguuauagcuugcacaagcagagcacugauccagcgccuggccacagcgagcgccgcagccgaagaacgcggcgcggaaagggucguagaaagaauagacccacccuggagcggcuuccgagaagacguccgcgcggccgucggagcaauaguaguaagccauaaaccugaccacggaacagucggaagagagggauacgcgaaaggacgaggccaaacagccggaaaauuacacaacgacacggcauacggacauacaggggagaaggaugcaagcggaaacgauauagucguacggcggaucgcaguaacugacauacgaagcccagcggacauccgcaaaauacggacgaacgcacacggacacucagaacuccgagaccgucuauacgaagcaacaagggguuuagagggaaaggcguucgaacaagcaguccucgacuucgucaaaggagacgcaaaauucagaggaauccgccacguccgaaucaccgaaguagccaacccaguauggauaacccacggagacggaaggcauaagaaaggauacuuaccgggaggcaacgacagauucgacgucugggaacuggccgauggccgaugggacgccgaagucguuacaacuuucgacgcccacaggcccggauuuguaccacggaugagauuagaaaaccacaaugccagaaaaaucaugagccuaaagaaaggggacaugaucgccuacaacgaccccguaucaggacaaagaauuauagccauagugagaaaguucgaucaacgaaacaagcaacuguaucuggauccccacaacgaggccggcaaccuagaccgaagagaaaaagagaaaacauacaagccacugagaccaaugccaaacccacucaagaaauacagaccacggcaagucagaauagacgaaauaggacaaguguucgauccaggcccauggugggaaagacaagacggguga

SEQ ID NO: 6232 - RNA, 3306 nt, Artificial Sequence
  Cas9 variant
auggagcaaaccucccucgaccugucccaagcaaugaagaaagucgcacagccacaaaaaccauacagacucggaguagacguaggcguagcaaguauuggcgccgccgcagucacagacaccgaaauacuaggcauccacguacggacguucgaaaaaggagagaucaacggcaaaagcggccggaagccccuuaacgcagacuaccgcaggcaaaaagggcaacggaagcggcuacgcagaaagaaaaaccgccuacucucguuaagaaggcuauuccggagagucgggaugaucgaauccgcggcuaucgaagcauucccaauaaguagcaccucacccuggcaacuacgcaccgaaggccuagacaggcgccucacuaacgaagaaugggcacaaguacuauaccacaucgcaaaacaccgcggcuuccaaagcaaccgcagaguagacauggacgaagcaacaaaacucuccgacgcagcaggagauagcccggaaacaaccacuaacaccgaaucugauagcgacacaaagaaaaugcucgcaggagucgccgacaacaaacgacuacucgcugagaaaggcuaccgaacaauaggcgaagccguagcacgggacccaaaauuuucgcacaggauccgcaacaaagaagaauccuauucccacaccauaggcagagacgaaauuaacgccgaacucaacugccuguuccaggcccaaaaucacuacggaaauccacacgccaccgaggaacuaagugaacaaauaaucgaccuaauaaacuggagacgcaaaacaguuaccggagaugacaucaaacgaaugguaggcagaugcacacuagaacccaaagaguauagagcggcaauccacagcguaagcgcagaagaguuccgcuggcuaucaacccucagccgauuacguauaguaacccaaggagaaucacgcccccucacaaaaugcgaaugggacaagguaguagaccuacccuggaggcaagaagccauuacauacaccagcauccgcaaugcgauagggcuccgacacgacauccgaucccgauucaacauacgcuacgaaacagggggaaagaaaacgaaaacggacaccaaaaacgaaacgaccaaaggucaguccgccgacgcagucaccuccgaaguaaaaacagcagaaaaagaaaccgcauuuaaagcaaaaggcuaccacauccuacgaaaagcauauaaagcguucgguuacgacgaacaaugggaccgagaccgguucaacacagaacuacucgacacgcuagccacggccgucaccuucuacaaagacgacucggagauacaagcccaccucgaaacaaacgacacuccagaauacgcaauccaaaucgcucuccggcuccccacccuaacuaaguucagcaaauuaucgaacaaagcgauccucaaaauacuuccccacaugcgcgagcgacaaagcuacuccaaugcaugccuucuagccggcuacaaaaaccaccacaaacaauacgacgacacaccccaaaacggcaaaaucccaagaucugcaaucgagcacaucaaaaacaccgucgucuacagaucccuaaaccaagcaaggcguguaauaaaugcaaugguaaaagaguacggcgcgccacaggaagugcacaucgaacucgcccgcgacauggagaaaagcgcaaagaagaaagacgaaaucgaccuauggaugaagaaacgcaaaaagaaaaacgacgaacuaagagaacgguucggcaaaaacuuaagccgcgacgaacuccuaaaauacaaacuauaugaagaacagaauggacaaugcgcauauagccuacagccaauccaauuaggacgacugcuagaacccaacuacguagaaguagaccacgcacucccccgaucuaggucgauggacaauucguacaacaacaaaguccuaguacuaacaaaacaaaaccgggacaagggcgacaggaccccguucgaauacuucggagaagaccaagagagcguagacuggaagagauuuacgaacugggucgaaucuaacccacaaaugccacaggcaaaaagacgcaagcuccugacuaagagccuacaaaaaggaauccuagacaauuucuccgccagaaaccuauccgacacccguuacaucgcccgagagcucaagacccuuaucgaacacuacauccucaacacaccggaaagagaaaagacgaaguacgaaagaugcguugucauuagcgggaaacuuaccgcccaaaugcggcaacuauggggcaucucaaaagcucgcgacgucuccgaccgccaccacggcagcgacgcagccgugaucgcguguauaacgccauccaugguaagaaggaucacgcgcuaucuccaacuccaggagagacgcgccaugccgagcgcgccuggaaagggagacgaacaccccgcgguagucgcccgagccaucccccacgcgccaguacccuggccuacauucgaacaugaccuagaagccgcgcucgagaaaguacucgugucucgaccccaaucacggaaauggagcggccccauccacgcagacaccauauacggcgaacacaaagaccaggaaacaaacaccguagcaccaacacagcgaaucaaacucacccaauuaacgaagaguaacuacaagaacauaguaggcuaugacgaagaacgaaacaaagacuucaucgaccagauagaagagagacuggaaugccacaacuuuaacggcaaacaggcguucggaaccucacagucaccgauauaccgaauaaagaaaaacggagagcuaggccccgaggucaagaaagugacgaucaaacugccuaucaaaaacucgguauuccgcauacggcgcggcuacgucaagaaugccaaaaacuccacaauauacaucaauaucuaccaaaacacaaaaacgggaaaauucgaaaugcacccagucuacgcaaaggaccugacguccucggccaacgcguccaaauccuuugaguacagcccagaucuacaacucgucgacacaauacgccgcggggacuacauagagauaacaagacgaaacggagaaguaaucuccggguacuacgccacccacaacauaagcacaucaguccucgaacuacaaccgcaugacacuacagacucccguaacaaccggaccccagccauaaagaccucgcuaaacauagagcgguuccauauagacauacucggccgaaaacgccgaguaguccgacgcgccaaaaacggacuagcagacgaucgagacaaauga

SEQ ID NO: 6233 - RNA, 3309 nt, Artificial Sequence
  Cas9 variant
augggauaccgaaucggacuggacauuggaaucaccagcguaggcuacgccauccucaagacagacgagaaaggcucacccuacaagaucgaacaccuuaccucaguaauauuuccgauagcagaaaacccaaaagacggcaaaagccucgccaugccaagacgcgaacaacgcggagcacgacgaagaaaccgacgaaccaaauuccgcaaacaccgcacgaaaaugcuguucguacgaagcgaacuccucacaaucaaacaaaucgaagcuaucuacucggaaaagcagaaguuaagcagcauauacgagcuccgaaccaaagcccuaaaugaacgacucacaaaugaagaacucuucagaauacuguacuucuucagcggacaccguggcuucaagaguaaccgcaaaucggaacuuaccgaaaaagacaugggucccgugcugacugcgaucaaagacauagaggaaaaacuagccgacgggacguaucgaacccuaggagaguacauggaacucgacgaaaaguaccaggaacacaaaagaaacaaagauggaaucgaccgauaccugggcaccgccaaacgaagccugauagaagaugagauaaaacagaucauaauugcccagcaacaauucggaaacacaaaauuaacaagcggguuccaaguagccuucaucggcgacgaggaacaaacagggaucuucaacgaccaaagagaguucgaggacggacccggaaagcaaagccccuacgccgguaaccaaaucgagaaaaugauaggagcaugcacauuugaagaaaacgaaaaacgcgcaccgaaggcuucauacaccuuccaauacuuugacuucuuaugcaaacugaacaaccucaaguaccgagaaacaauaggaggggaguaucgauuucuaucccuagaacagaaaaauguccucaaggaaaaaguccucaccacccaaaagaucacauucagcggcgucaagaaauuacuagaccuccccgaacacgcacaauuuaacuugguaaauuacggaaccaaauccacagugaaagagaccgaaaccaaauccgucuucuacgcgaugauaucguaccacaaacucaagaaagccaucccagcccccauauucagcaaccucucaacagccgagcuagacgaaauaggccgcauucugacccuauacucgucggacaaagggcgcaaaaacgaauuuuacagccgacucgccaucccagaagaagucgucgaagcacuucuaccaaucaauuucagcaaguucgguaaucucucgcuuaaagcuaugcgaaaaaucauacccuaccucgagaugggccuagucuacagcgaagcggcaacccaagccggauacgacuuucgacacaagaaaaucgaccaagccuacauccaugaaaacguuaccaacccagucgucaaacgcgcggccagccaaaccauaaaaauaguaaacaacaucauacgaaaauacggagaacccgacggaaucaacaucgaacuagcacgcgaacuguccaaaaacuucuccgaacgcaaaaagaccguaaaauaucaagaggaaaaccgagcgcgaaacgaacgaaucgcagacaagcuccgcgaaugcgaacucccaguuaacggcgccaacauaacccgucucaaacucuucgaggaacaaggugaguucgaucccuacacaggacucaagauccccuucgaccgagcguucagcgaagaauacgaagucgaccacaucaucccuuacagcaaaacacuggacgacuccuacgggaacaaaauucuagucuccgcuaaagcaaaccaagagaaaggaaaccggauaccaauggaauaccuccagggcaagccggaaagaauaaagaaauuggaaagcaucacggcaacuaucaagaaccccaagaaacgcgaaaaacuccuaaagcaacaacucacgaaggaagacgucgacggcuggaaaacccggaaccucaacgacacccgcuacaucuccucacuacuccacgacuacuuuaaucagaacauaucauucgcaaaacuggaguccgagaaaaagaaacgcgugaucgcaguuaacggagccaucacgucaaaacugagagcgcgauggggcuucaacaaaauuagggaaaacggagacgaacaccacgcgcucgaugcacuaaucguagcgugcguuacugacaaauacaucaaagaaauuacgucuuucuccaaacgaaaagaagucagguuuaacgaaaaccuauggaaacgagaaaagacgccccaagagauagaacaggaaguaguacacuucaagaaagacuacgaccggauauucaaccaagcauucccccuaccauggaccaacuuucgcgaagaggucagcuguagaaugagcgagaacccggcggagcugaugaaaaaccauacaugggagaccuacacugacgacgaaaucgccgcccuucggccgauuuucaucguacggaugccaaacaugaagacaucgggacccgcacaucaagaaaccauaagaucgggcaaacuggaagaaaaaggacuuaacauuucacgaguaagcauagagaagcuaaaacucgacaaagaaggcacaaucaaauccgggaacgcgcaauucuacaaagacuccggcaacgguuggcaacuacuacaugauaaacuaaaggucgcccucgaaaaacacgacggagacggcagcaaagccuuccccgacggcgucuucaaauaccaauaucuugauaaggagcacacaguacgaaagguccgacucgucgccaaaagcacacuacaaaccagccucaacgagaagaagucagucgcugauaacggcucaaugauacgcaucgacgucuucaggaacgagcaaggcaaauaccaauucgucccaaucuacgccaaagaccgaguagccaaaaagcugcccaaccaggcggucgcagucggaaagauugcaaaagaauggccacucaucgaagaaucggacuuuaaauucagccucuacagcaacgaucucaucagaguaaagcacaagaaaggagucaaacacgucuccaaagacggcaauaaagaagaaaagucaaagacagacuucuucggcuacuacacaggagcagacaucgccaccgcauccaucucaggaauaagccccaacaauuucuucgaguucagauccaugggccuggcgacccuaauaagcaucgagaaauacaaagucgacuacuucggaaacuaccaccaggucaacgagaagguccgacagaaauucccgaaaaaccgcauguga

SEQ ID NO: 6234 - RNA, 3312 nt, Artificial Sequence
  Cas9 variant
augaaguacgacaucggcauagauauuggagucgcaagcguaggcgaggcgguaauagaccaagagggaaacauacucgaggccugcuccaaccuauucgacgaagcagacgcagccagcaacguagacagacgaaacuuucgggaaggucgcaggaacaaacgccgugagcgaacgaggguuaacgacuucaagaagcuauggaccaaauucggcuucgagaucccgaagaauguaaugaacgacacgauacuacuccggaacaaaggcauaaagugcgaacuagaccucaccgaacuguacuccguacuacuguacaugcuaaaacacagagggauaagcuaccucgaggacgcgaucgacgaagcaaagggaucaaacuaugcgaagggaauagcacuaaaccagaaggaacuaaaagaaaaacuccccugcgaaauccaacuagaacgacucaaaaucuacggaagcuaccgaggggacuguaucguuaagaaagaagacgaggacgaauaccacucgaacguguucacgaucagcgccuacaagaaagaacuggagauccuauuccgcaaccaaaaacucccagaggaguucauacaaggcuacaugaagauuuucgaacgcaaaagagaauacuacauaggaccuggaaacgagaaaucacgcacggacuaugggguguauacgaccaacaaggacgaagaagggcacuacauaacggacaaaaacauauucgaaaaacuaauaggcaagugcucggucuacaaagacgaguuccgggccgcaggggccagcuacacagcacaagaguucaacgugcucaacgaccucaacaaccucacggugaacaaccgcaagcucacggaaaacgaaaagaagaaaauaguggagaaaaucaaaucaagcaaugcagucaacaugagaagcaucaucaagaaagugcuuggugaagauaucgaacaauucggcggcgcccggaaagacaaagcggacaaagaaaucuaccacaccuucgagguauacagaaaaaugaagaaagaauuugagaaaaacggaauagauaucgcagacuucagccgcgaaaaacuagacgaaauuggaaacauacuaacgcuaaacacagaaaccgaagggauuaaaggugcccuccacgaagccaaaaacagcuucacguacuccgaaaucgagacacugauagacaucaggaaaaagaacagcagccuguucucaaaguggcagagcuuaagccuaaaaaucaugaacgaacuaauuccgcaaauguacgcacaaccgaaggaacaaaugcaacugcuaaccgaaaugggagucuucaaguucaagagcgugaaguucaagaacagcaaguacauaccaguggaagaaaucaucaaagacaucuacaacccugucguaguacgcagcgugcgcaccacuaucaaaaugauaaacgaaacgauacgaaaguacggcuaccccgacaacauaaucauagaaaugccacgggacaagaacagcacagaggaaaaagagagaaucaagaaagaacaaucgaaaaacgagaaagaguacgaagguaucuuaaagcgaaucaaggacgaauacgacauagagauaaaccgagacgacuaccgcaaacaggaaaagcucgcacuaaaacugaaacucuggaacgaacaggaaggcagauguccauacagcggaaagaugaucagcauauacgggcugcuggaggacccccaacucuucgagaucgaccacaucaucccuaaaucgaucagcuucgacgacucacgcaacaacaagguccucguauaccgaucagaaaaccagaagaagggcaacaacacaccauacauguaccucagcaaaggagauaaaaacuggaacuacgaccaauacaagaguuacguccucggccugaagaacaaaggaaacauaagcgacaaaaaggucaacaacauguuauucauggaagacaucaacaagaucgacgugcucaagggcuucauuacccggaaccuaaacgacacccgauacgccucgcgggucgugcuaaacaugcuccagagcuuuuucaacgaaaaagacggcugucccaccaaaguaaaaguaauaagagggucauucacgcaccaaaugcgcguaaaccucagaauaaacaaagacagagacgaaaguuacagccaccacgccguagacgccaugcuaauaguuuacucgcaacgcggguacgaggcguauaggaagauacaagaagcaugcgucgacuucgagacgggcgagauaauugacgaagaaagguggcagcaaugcaucuggggcaaggacuacgaccaaguaauguacgaagcuaaauggucaaagauccgagagaaaauaaucgaagccgaaaagaacgucaaguaccaccaccggguggacaagaaagucaaccgcggauuaugcaaccaaaccaucuacggaacacgaauaaaagacggcaaaauauacaaaauaaguucuuacaacauauacgacaacaaggaaugcgcaucgcuccuaaaaaugauaaaaggggguaaagaaagcaagauacucauguacaacuacgauucgaaaacauauagagacaugauaaagaucauagacgaauacagcgacgagaaaaauccuuucgucgccuacaugaaagaaacaggagacuacuuccguaaauaugccaagaaacacaacgguccgaaaauugaaaaagucaaguauuacaaagaagaagccgggagcuguaucgacauaagccacaaguacggcuaugaaaaaggcaguaagaagguaauccugggaagccucaaccccuaccgcacggacgucuucuucaacgaaagacucaagaaauacuaccuaauuggcaucaaauacaaccacaucaaaugcgagggcaacaacuacgucaucgacgaggacgcguacaacggcuuacugagagacgccggaguaaucucgcacgaaaauaccauaaaugaccucgaaaaaguaggcguaaaauaccuauucagccucuacaagaacgacauaauaaaguacgagaagaacggcgaaauguucguagagcgguuucucagccgaacgauggaguacgccaacaacuacauugagaccaaacccauccauaaaccauucuuccagaaaaaggauaagaagggcaacauaaagaacucgcaaaaccucguaggccucucgaaaacuaaauauaucggcaaacuggucaccgacgcgcuuggaaacacauacaugguagaaaaggagaaguucucccugaucguagacauauga

SEQ ID NO: 6235 - RNA, 3315 nt, Artificial Sequence
  Cas9 variant
augaagcuaauccucgcccuagacaucggaauagccagugucggcugggcgguccuugacaagaaaagcgagaccguccuugaagcaggcuccaacaucuucccggaagcguccgcggcuggcaaccaggugcggcgugaaaugcggcaagccagacggaucaagcgacggcagcgcacccggcuagacgacuucaacaagcuguggcggaaaaacaaccucuccaucccgcaguacaagagcacagagaucguaaaucucaaggugaaagcacuacgagaagaaauaagccucgacgagcuguaucuaauucucuauucauaucugaagcaccggggaaucuccuaccucgaagacgcccaagacgacagccucaguagcagcaaugcuuacacaaacgggcuucgagagaacgcgaaggcgcuggagaaacacuacccuugcgaaauccagcgagaccgccuccagaccaucgggaaauaccgaggccaaacccaaaucaccgacgacaauaacgagaaaaucgaccucucuaacgucuucacaauaggggccuacaggaaagagaucaagaaaguacucgaaacucagaaacucuaccacaaugaacugacggacgaacugugcgaugacuacauacugaucuucaacagaaagcgcaaauacuacgaagggccaggaaacgagaagucaagaaccgacuacggucgcuucacgacacgccuggaccaaaacggaaauuacauagacgaggaaaauaucuucgaaaaacugaucggcaagugcuccguuuacccugacgaauugcggggcgccgccgcaagcuacacagcccaggaguucaaccugcuaaacgaccuaaauaaccugaccaucaacggccgaaagcucgaagaaagcgaaaaacacgccauuguccagagaauaaagacaaguaacaccgugaacaugcgaaaaauaaucgccgacugcaugggggaaaccaucgagaacuucuccggagcccguaucgacaagucagggaaagagcaauuccacaaguucgaaaccuacaacaaaaugcgaaaaucgcugucagaaauaggcaccgacaucgacgaauuuucacgcgacgagcuagauaaaauaggguauaucaugacaaucaacaccgacaaggaagcacuaauggaggccuuuaacgagagcggucuaaacuuagacgacagcgucaaagagugucucauauccuuccgcaaggcgaacucaagcucauucuccaaguggcaaaguuuuucacugaaaauaaugaacgaacugauaccagaaauguauauacaacccaaagagcagaugacucugcuuacggaaaugggcgucgccaaagggagcuccggggacuucgccggacuaaacuacauaccagucgacguaaucuccgacgaaauauacaacccuguggugcgacgcagcguacgcaucagcuucaaaauacugaacgcuguacuuaagaaauacaaaguacuggacaccaucgucaucgaaaugccgcgggacagaaacagugacgaagaacgaaaaagaauaacggacagccaaaaacuaaaugaaaaagaaauggaguucauagaagggaagcuagcccaaaucuacaacauaaaacucucguccagcgacuucagcagccaaaaacaacucucacucaagcucaaacuguggaacgaacaggacggcaucugucuauacucaggacguacaaucgauccagaagauaucauaaagaaccccgacuuguucgaaaucgaccacauaaucccacgauccauuagcuucgacgacucaagauccaacaaaguucuaguauaucgaagcgaaaaccagaagaaagggaaucaaacacccuacuucuacauaacacauagcgacggggccuggacguacgagcaauuuaaagcaaacgugaugaaucugagcaaaaagaaagaguacgcgauaucaaggaaaaagguccaaaaccuacuguacucggaggacauuacaaaacgagacgugcucaagggguuuauaaaccggaacaucaacgacaccggcuacgccucgcgcgucguccugaacaccguucagaacuucuucaaagcaaaagaagccgauacaaaagucaaaguaauuaaaggcuccuacacacaccagaugcgauccaacaugaagcucgacaagaaucgcgacgaaagcuacagccaccacgccguggacgcgaugcucaugggcuucucagaaauggguuacgaagcauaccgccggcugcaaggagaguucauagacuucgaaacaggagaaauacucaaaaaugacauguggaacgaaaagaugagcgacgacguguauguggacuaccuuuacggcagaaaauggagcgccauccgaaacgaaauagucaaagccgaaaaagacguuaaauucuggcacuucauaguaagaaaaagcaaccaaggccuauguaaccaaacuauaaggggaacccgcgaauacgacgggaaaaaguacaaaauuaacaaauucgacaucaggacgaaggaaggagucaagcucuuuaagaaacucgcauucagcgaaaaagaaucggaccgcgaaaaacuacucgucuaccucaacgaccgccaaacauucaacaacuuagucaagaucuucgaagacuauaaagacgccccaaaccccuucguacaguacgaaaaagaaaccggagacgucguucgaaaguacuccaagagacacaacggaccaagaaucgacaaacuuaaauacaaagacggagaggugggcgcgugcaucgacaucucacacaaguacggccuggagaaagacuccagaaaagucauacuagaaucccuagucccauaccgcauggacgucuacuauaaagaaucagacaaaauguacuaccuaguaggcguuaaacagucagacaucaaaucccagaacggugcaaacguaaucgacgaagaccucuacacccgcauccucauaaacgagaaaaugauagaacccggacaaagccgcgacgaccucgaacaacuaggguacgaguuccgcuucuccuucuacaaaaacgauauaaucgaauacgaaaaagaaggaaaggucuucgucgaacgguucgucagcaggaccaugcccaagguccggaacuacauugaaacgaagcccaucaacaaagcaaacuucgaaaagcagaaccccgugggccucggaaaaacaaagucgauaaagaaauaccguaccgacauacucggcaaucgcuaccucugugagaaagaaaaauucacaaaguuuugcuga

SEQ ID NO: 6236 - RNA, 3315 nt, Artificial Sequence
  Cas9 variant
augaaccauuacguccucggacuggacaucggaaucaccucggugggguacggcgucauugacuuagacaacuaucaauucgucgacuacggaguacggcucuuuaaggaaggcacggccgaggacaacgucaaccgacgcaccaaacgaggaucaagacgacugaagcggcgacgucaaacccgacuagacgacaugaaagaacuccuacaaaaagagaaaaucaugagcgaaacuuaccacuccuccuacgaccccuaugacaugcgcauuaaagggcugucacaaaaacuauccaacgacgaacucacaugcgcaauccuccauauaaccaaaugccgaggcaccacacucgaagcccucgauuccgccgacgaagacuccgaaggcaccaaauccauacuaucuaaaaacgaccaagaccuaaagaaauaccacuacgugugccucguccaaaaagagcgccuaaaacaaucagggaaaauucgcgggaccgaaaacaacuucaaaaccgacgacuacaucaaagagcucgacgaaauccucagccaccaagaucucagugaggaccucugcgagaaaauacguacaauaguuucgagacggcgccaauacuacgaaggccccggguccgaaaaaucccccacccccuacggacgauggaucgcccaagggguggccccgaucgaccuaauagagaaaaugcggggaaaauguuccgucuuccccgaccaacuccgcgcagcuaaaaacagcuacacagccgaacuauucaaucuccuaaacgacuugaacaacuuagaaugcgaaggggaaaaacucaccaccucccaaaaacaagacgucaucgacuucguaaacgagaaaggcggaaucaccccaaaacagcucgcgaaacuccuaaacguagacuuaaaccagaucaagggcuuccgaaucgacaaaaaugauaaaccacuacucacugaguucaaaggcuauaaagccuucaagaaaaucuucgacacgaacaacugcgaucuauacaagaaagaccuauccauccucgacgggcuagcugagaucguaacaggaaagaaaggcaucgaggaacgaaaacaggcaauccaacaagcauaccccgaaaucgacgaagcaaucguagaacagugcgcagugaugaaaggaaugacccaauaucacucacuaucgcucaaagcgaugcaccucauaaaucaggaaaugcuacagucuccccgaaaccagaugcaagugcugcacgaaucccacguauucgacaaaaaccgaguaucacacaaaggacaaaaauacauugaagcagacgacgaggccauccuuagcccggugguaaaacgggcacaacgcgaaaccuucaaaguggucaacgcccuccgcgaaaaauacggcgaguuugaaucaaucguagucgaaaccaccagagacagaaacucccaggagcagaagaaacgucuuaacgacagccaaaaauacuacgagcaagaaaaccggaaagucgacgaacuccucucccacgaaggauacgauccaucaaaaaucaacggcaaaacuaaauuaaagguucggcuauaccuccaacaagagggcaaaacagccuacacaaacgcaccaauagaccucaaccuacuaaucaaggacgccacggcauaugaagucgaucacaucaucccccugucgaucagccuagaugacucaaucaacaacaaagcccugauuaaccgcacggaaaaccaaaacaagucaaacaugacacccaucuacgccauccuacgcggcaaacugaacauaagccucgauaccuacaaaaccgucgucaaaaacaaccgcaauuacacgggaaagaagcgcuccuaccuacuauacgacaaagacaucacaaaauuuagcaacaugcaagaguucaucgcacgcaaccuaguagauacuucauaugccugccgagucgugaugaguacccuuagcgacuacuucaaagacaacgagaucagcacccacguacacaccgugagagggagaguaacgaacauguuucgcaaccgcaucaacaugcagaaggaaagggagaaggacuaucugcaccacgccguagacgcccucauagucgcguccauaaagaaacucaaccuacucaacacauaccuccucaaauauaacuucaacgaccuauacaacgaggaaaccggagaggucuucgccgucggcgacgaccaacaggugcuagaccccaaauacaucagauucaucacccaacugaaaaccauuuacgacgaaucgaacauguacuauaacggacuaauagaaagaaacguaaugcaguucccaccaauaaagaucagccacaaaauagacacaaagcccaaccgccaaaucucggacgagacaauauacucaacccguaccgucggaaacgaagaauacguuguuaagaaauauucagacaucuacgacccuaaauucacccagcugaccgacgacauaaucaacgaccgcccccuagaccgaugguuaauguaccgaaacgauaaccaaaccuucaaaauaauccaguccaucauccucgaccauuuucauaucuucaaagacgaugaaaaacacuacuccugcacuaaaaagaaaggacaaauacaguacgcacucaaaggaaagaacccacuauaccuauacaaacaagagcacggcaaaguacgcaaauacgccaagaaaggcaacgggccagaaauaacgaugaugaaauacuucgacggcaagcuaggaaacaauaucgacauauccaaucacuaccacguccacaacaagaaagucguucuccuacaaauaucacccuaccgaaccgauuucuacguaagcccagagggcaaguacaaaaugcucacaguccgauacgccaacguuuucuacaaagaguccaaaaagaaauacgucaucgacgaaaagugguacgccucagagaagaagcguaagaacauaaccgaugacgacaucuuugucugcucacuccaccaugaugagcuaaucgggauacagaaaaaggacggcgccaaauacgucuacgaccucuccacagaagacggcggcaagccacgucuauaccacggggaaauggagauccucaaauucacggccacgaacaacgacuccaaaaauauaaucgaagucaaaccgauauacaccuacugcaagaaacaacuaaugaucuccauuggccccauaacgaaacucgcaaaauacgccaccgacguccucggaaacguguacgaagucaaaaagaacaucaucgaccaccugagucaccucuga

SEQ ID NO: 6237 - RNA, 3318 nt, Artificial Sequence
  Cas9 variant
auggggauaagaaucggccucgacauaggcaucgccagcgucggcugggccgucguagacgaugacuacaacaucaucgaaucuggagcgaacauauucaacgaagcgaaagccgcauccaacguggaccgacgaacguuccgccaaacgaaaagacuacuccgccgccagaagacacgccugcgcgacuucgacauacuauggauaaacgcgggacucgacauacccaaggagaaggucaacaaacagcuacaguucagaguacaggggaugaccauggagcuaagcgaaaacgaacuauaugcagcacucaaaaacaugcucaagcacagagggaucagcuaccuagaagacgcgcucgacgaggaacaaucgggaaaaucaaccuacgaaaagggccuccaagucaaucaaaaagcccugaagugcgacaagaugcccugcgagauccaguacgaaagacugaugaaguacggaagcuacaggggacacaucgaggucaaagacgaguccggagaagagaugaucuugagcaacauauuuacacuagacgcauacuguaaagaagccaagaaaauccucgaaugucaaaaacaauaccacuccuucaucacggaagcauucgaggacgauuauuuagcgcuacugcgcaggaaaaggaaguacuacgaggggcccgguaacgaacaaagcagaaccgacuacggcaaauacaccaccaagcucaaccccgaaacaggagaguacgucaccgaagaaaacauuuucgagaaacuaaucggaaaaugcuccguauaccccaaggaaaugagggccucggcggcgucauauacggcucaaauauacaauaugcuaaaugaccuaaacaaccuuacgauaaacgggcgaaagcucgaguacgaagagaaaaagaguaucguagaagaaguccaaaaagccagcagcguuaacauguuaaagaucaucaagaaggugaucaacgaggacaucaccacuaucgagggagcacgaaaagacaaaaacgacaaagaaaucuuccacaaaauggaaaccuacaacaaaaugaggcacuacuucgagaaaaauggccuagaguucaagaaaauaucuacggacgaccucgacgaaaucggcaacauccuuaccuuaaacaccgaaaaggaggccauacucgaagccuucaacaagucacagcuagaacucagccaagaggaaaaggaagcguucauagagauaaggaagaaaaacggcucacucuucaacaaguggcauuccuucucccugaagauaaugaaagaacucauccccgaacuauaccuacagucaaagaaccagaugcaacuacucaccgacaugggggucuucaagaaaaagacggaaaucuuccaaaacuacgacaaaauccccaccgauguaaucaucgaggacaucuacaacccggucguaaagagaagcaucagaauaacuguaaagaucguaaacgcauuaaucaaaaaguacggcuacccccgagaaguagugauagagaugccccgggacaggaacucagacgaagagaaaaagcgaauccaggacgagcagaaaaagaacgacaccgaacugaagaaaaucaucgaaaaagucgaauccgaauacggcauaaaaaucacggacacacacuuccgcaaccacaaaaaucuccgaaugaagcugagacuauggcacgagcaggacggucgaugccuguacagcggcaaagucauagacaucucagaacuccucaacgacugcuccaaauucgagaucgaccacgucauacccaagagcaucucguuugaugacagccgcagcaacaaaguauuaguguacagcaccgagaaccaaaagaagacaaaccaaacaccauaccaauaccuagagggcaauggaaaagaauggaguuucgacgaauacaugaaccaggucauagaacucaaagaccgcaaacugaucagcaaagcgaagaugaacaaauugcuauuccgcgaagacaucacgaagaucgaaguacuuaaaggcuucauagcaaggaacauaaacgacacaagguacgccagcagagucguacuuaauaguuuccagaaauacuucgaguccaaacaauccgacaccaaagugaaaguaauccgcggcucauucacucaccaaaugaggaagaaacugcaacuauccaaaaacagagacgaaaguuacgcccaccacgcgguagacgccaugcuaaucugcuauagccaaaugggcuacgaagccuacaggcaacuccaagaagaccugaucgaccccgacucggagaaaauaagggacuuagggcucuggaaagaaacaauaaccgaagcaaaguacgacgaaguccuauacacggcgaaguggcucgaaaaccgcggcaagauacaggaagcagaaaagaaaguaaaauucuggcacaaagucgauagcaaagcaaaccgagcccucuguaaccaaaccauucgagguacccgggugaucgacggcucaauacagaaaaucaacaaaauaaacauauacagcguggacggauacaaaaccuucaaaaacaugauccaaaaggggaaggaaaaagacuuccuaauguaucgaaacgaccgcagguccugggacgaccucaugaagguguaccgcgaauacagcgacgccaaaaacgccuucgccgccuaccaagaggagacaggcgacuacguccgaaaauacgccaaaaagcacaacggauccaaaaucacaaaccuaaaauacugcgcaaaagagcuggguucaugcaucgacauaucacacaaauacggccuagaaaaggacagccgcaaggugauccucgagagccuaagccccuauagaagcgacgucuacuacaacgccgggcucaaacaguacuauaucgucgguauaaagaauagcgaccuaugcuuccucaagggagaauacuucaucgacagcaagcguuaccuccaaauccuccgcgaagaaggcguccucacggaacaacacacccugaaugaccuggccgcgaucggaaccgaguuccaauucagccuauacgaaaacgauuaccucgaauacgagaaaaacggcgaaaucaaaacagaacgcuuccucagccgcaccaagccaaaacagaaaaacuacaucgaaacaaaaucaaucgacgcucccaaaaucaaaaacaagaaacagaaccugguaggacuugcaaaaagcaaaagcaucaagaaaauacgcgucgacauacuaggcaaccgauacuacgcaagcaaagaaaaauucagccucaugguggacaaauucuga

SEQ ID NO: 6238 - RNA, 3318 nt, Artificial Sequence
  Cas9 variant
auggacauggcauggagacugggacuugaucuaggaacaaacagccuagggugggcagcacugagcuuagacgccgcaggagcaccggacgccauucuggccgccggcucgcgcauauuuggagacggccgcgacccgcaauccggaaccucacuggcaguugaccggagagccgcaagagcagcacggcgcagacgcgaccgguucaaacagagacaaagagcgcuacugaaacaccucgaagccgacggacuguuccccgcggaucccgaagugcaacaagcgcucgcagcgcuggaccccuacgcacuccgggcacgggcccucgacgaagcacugucguuacaugaaaucggcagggcacuauuccacuuaaaucagagaagaggauuccaaagcaaucggaaagccgacaggggcaaagaugaagacgcuggaaagauugcgaucggaguagaccgacugaaagacgccaucgcggcagccggagcaagaacauucggcgaguuccugagacaacgacgagcaggagcaacgggagaaaaccagaucccaagcguccgaacacgccuacgcgccgaaacaggagaaggcgcaaaaggcucaggguacgauuucuaccccagucgagcacuccucaaagaugaauuugacgcaauauggcacgcacaagccgaacaccacccgaaaguccuuaccgacgaagcauaccacagacuccacgaaauagucuuccgacagagaccacucagagcaccaaaagucggagcgugcacgcugguaccaggcgaagcacgacucccaaaagcccauccgcuguuccagcgccgacgccuacucgaagaacuaaacgcgcuuaugaucguccgcgcaggggccguugcggaaaggcucacgccagagcaaagagaccuccuccuacuuaaacucaaagacaaaggcaaagugacauucaaaagccuacgggaaaaagugcuaaaacuagacggagacgccagguuuaacaaagaaagcgaacauagaacggagcuaaaaggcgacgaaguagcagccgaaaugggaggaaaaacaagauucggcucacuauggccccaccuaucaacagaacaacaauggacggucaucgaaagacaacaggcguuagaaagugacgcugacgaagccgccuuucggacguggcucguagaaacgcacaagcuaacagccgaacaggcaagggcggucgcaggagcacggcuaccagcgggacacggaagauucggacucacagcgaccgccgcucugcuugccgcacugagggacggcagaaccccugagggacgcggaccgaacgccccggcgaccgaagccggaagagugguaguguacucagaggcugcggccauagcgggcuaccaccacagcgaucacagaagcggggaaguguucacagacgcgaaaggacgcccagcacugccauauuacggaguaccccuagaccgccacauaguaccagggacagccgauccagaugaaccggaugaagcggcaaggauugggcgacuaacaaauccuaccguacacaucgcccucaaccaacuaagaaggguaguaaaccgauugauccgcguauacgggccgccagccgaaguagcauuagaacuugcccgcgaacuuaagcuaagcgaggacgagaagaaagaacgaaaccgggaaaacuccagaaaccgacuagacgcugagaaaagaucauccaagcuagccgaacuaggacaaagagacaacggaggaaaccgcgcacuccuaaaauugugggaagaacucaacccagaaaauauccucgacagaagaugcauuuacagcggucgacagaucucaauaggcaugauauuuucgggcgcagccgaggucgaccacauacucccauucgaugccacccuagacgacagcaacgcgaacaagauacugugccuaagagaagcgaaucgagauaaacgaaaaagaagccccuucgaggccuggggaggaaccccacaaugggaagaaauagcagaacgagcuucacggcucccgaggaacaaaagauggcgguucgaaccggacgccauggaacguuucgccgaagaagggggauuccucgcacgccaucucgucgacacacaauaccuaggacgcauagcacaugacuaccugagaugccucuaccccgacaagggcgaugggagcagccacguaugggucuccccaggacgccuaacagaaaugguacgucggaaacuaggguugaacgggcuacuaggcgaucauaaccuaggcgcagaacaaccgaaaaaccgcaaagaccacagacaccaugccauagacgccguaguaacagcaauccucgaccgcuccaugcuacaaaggauacaacgagcaagcggagaaggagcaagcgacgcagaacuucuccgaaucauagugccagaacccuggacuggauuuagggacgaccugcaaagggccgucgaucguaucgugguagcccauagagcggaucacgggacaguagcaaaggcugccacgaggggcagggaccaaacagcagccagacugcacaacgacacagcguacggauucacaggcgaggcagacgccaaaggaacccccauaguaguccaccgagcaccgcucggggcccucaaaaagccagaacacauagaccaaguaagagacccccucuugcgcgcagcacugcacgacuucacagcgggacucaguggaaaaccauucgaagaccgcaucgcagccuucccgcgucucggcccccuggacuaucgaggaauaagacgagucagaguagucgaaccacuccaagugaucccgauaagagacgccgcaggccgggccuacaaagguuauaaaggcgacuccaauuacagauacgacgucugggaacucccagacggaaaaugggagcaaagagugcuccaaauguacuacgcgcaucaaaguggagagccacccagaccccaccccgcagcccgcaaaguauuaagccuacacagagacgacgugcuagccauagaaagaggcgagggcggucgcgagcuaguucgaguaguaaaguucucgacaaaugaguuuacgcucgcaccccuaaacgaagggggagcgcugaagucaagacaugcggacaaaggggaccccuuucgcuauuuauaccccagccccagcacacuaaaagcguggagggcaagggaagugagaguagacgagcugggccgcguccuagacccaggauuccccgccagaaagagaagacgggucacacgaccaggcagagcggacgccgacuga

SEQ ID NO: 6239 - RNA, 3321 nt, Artificial Sequence
  Cas9 variant
augcaguacauaguagcaaucgacauaggcgucgccucggucggcuacgcagugaucgacaagaccucggaaacugucauagaagcaggcagcaacauauuccccgaagcaagcgccacagacaaccaggaaagacgcgggaugcgccaggcgcgcagauuaaaaagacgagagcggaccaggcucgacgacuucaccaagcuaugggaguaucacggacuagcaaucccgcaagucaagaagaacgacaucgugggacucaagguaaaagcccucuacgaaaguaucucccuagacgaaguauaccugauacuguacagcuaccugaagcaccgcggaaucucuuaucuagaagaugucgaagacagcuccguaagcggauccacagcguacgcgaauggacucaaacucaacgcgaaagagcucgagaaaaacuuuccgugcgaaauccagaaauaccggcuugaaaacauaggcaaauacagaggacaaauacaaauagaagacgaccaaggagagaaacuagaccuaagcaauguguucacuaucggagcguacacuaaggaaauacaacagauucuagacacccagaagaaguaccacgcagagauagaggacgaguucugcgaaaaguaucucaagauauucacccgcaagcgcaaguacuacgaaggaccggggaacgagaaaagccgaacagacuacggaaaguacaccacuaggcuaaaggaaaauggagaauacaucacggagaaaaacaucuucgaaaaacuuauuggcaagugcagcgucuacaaagacgaacugagagcggccuccgccucguacacagcacaagaguucaaccuccugaacgaccugaauaaccucaccgugaacggccggaaacucgaagaaaacgaaaaacaccuaauugucgacaagguaaagacaaguaacaccauaaacaugcgaaagauaauagccgacgcuaugggcgaaaagauagaagaguucuacggugccagaauagacaaauccgaaaaggaaaucuuccacaaguucgaaguauacaacaagaugcggaaagcgcucgcggccauacacgucaauauagaagaguucuccagagacgaccuggaugaaaucggcuacauauuaaccaucaacacagacaaagaagcgaugauggaagccuucgacaacaguaggcuagaauuaccaggggaaauaaagaacugucucaucucccugcgaaagacgaauggaacacuauacagcaaauggcacagcuucagcuuaaaaauaaugaacgaacuuauacccgaaauguaccgacaacccaaagaacaaaugacgcuacucacggaaaugggcgucaugaaaggccagaccgaugaguucgaaaagaacaaauacaucccgguggacguagcgagcgaagacaucuucaacccaguagugcggaggagcguacgcaucagcuucaaaaucuuaaacgcacugaugaagaaauacggaacccuggacgaagugguaauagaaaugccccgagacaggaacucagacgaacaaaagaaaugggagaaagaaacacaaaagaaaaacgagaaagagcaagaauacauagaaaacaaacuggccacaguguacgacauacgacuaagcagcgcagacuucagcagccaaaaacaacugaacuuaaaacuaaaacuguggaacgaacaagacggaaaaugccucuacagcggaaagaucauagagcccgaagaccuaauaaaacacagcgaacuguucgaaauagaccacaucauaccgcgauccauuucuuuugacgacucacgcaguaacaagguccuaguauaccggacggaaaaccaaaacaaggggaaccaaaccccauacuauuaccuaacgcacacuaacagcaagugguccuucgaacaauacaaggcucucguaauggaccucagcaaaaagaaagaguacggccugucaaagaagaaagugcgaaaucuccuguacagcgaagauauaacuaaagcagacgugcuucgaggguucaucaacaggaacaucaacgacaccagcuacgccgcgagaguaguucugaacaccgugcagggauauuucagggcgaaagagaugggcaccaaagugaaggugauccgagggagcuacacacaccagaugcgcgucaacaugaagcucgacaaagaccgagagaaguccuacgcccaccacgcagucgaugcuaugcuaauagcguucucccaacuaggcuacgaagcauaccgcaaacuacaaggcgaguucaucgacuucgaaacaggcgaaauacuuaacuccgagaaguggaaagaccaaaugucagacgaaguauacaaacaauaccuauaccgcaagaaauggagcaauauacgcaacgagaucacaagggccgagaaaaacguaaaauacugguacuacguugaccacaaaucgaaccgaggccuaugcaaccagaaaauccgcggcacacgaguauacgacggcaaaauauacaagaucaacaagcucgauauacggaagaaagaaggggcagcccucuucaagaaacucgcguucagcgaaaaagaaagcgaccgugaaaaacuccuagucuacaaaaacgacaagaaaacguaugaggaccuaguccgcaucaugcaagacuacagcgacuccaaaaacccguucguacaguacgagaaagagacaggggacuacgucagaaaauacgcaaagaaacacaacggacccagaaucgacaaacucaaauacaucgacggcgaagugggcagcugcauagacauaagccacaaguaugguuacgaaaagggcucccggaaagugguccuagaaucccucguaccauaccgcauggacguauacuacaagaaagaggaacaaacauacuaucuaguuggcaucaaacagucugacgucaaaugucaaaaaggggaguacgucauagacgaggacgcguacgccaucaaccugguaaaggagaaaaugauacaacaaggccaaaaacgcagcgaccuggaaucccuaggauucgaguuccaacucagcuucuacaaaaacgacaucaucgaauaugaaaaagacggcaagaucguacgggaaagauuucucucgcgcaccaugcccaaaguaaagaauuauaucgagacaaaaccaaucgaccgagcgaaguaugaauggcacgaccgaaaacucgucggacugggcaaaaccaaaagaauccgaaaauaccgaauggacauccugggcaacuauuaccuaugcaacaaagaagaguucagcaaauacugcuga

SEQ ID NO: 6240 - RNA, 3324 nt, Artificial Sequence
  Cas9 variant
augggcuacacagucggccucgacaucggcguggcauccgucgggguagcgguacuagacgaaaacgacaacaucguagaagcagucuccaacauauucgacgaggcagacaccagcaacaacaaaguacgacguacccuacgagaaggacgccggacaaaacggcggcagaaaacccgcaucgaagacuuuaagcaacuaugggagacuuccggcuacaucaucccacacaaacuccaccugaacaucaucgaacuucggaacaagggccuuaccgagcuccuaagccuugacgagcuguacugcguacuacuaagcaugcucaagcauaggggaauaaguuaccuggaagaugccgacgacggcgagaaagggaacgccuacaagaagggccucgccuucaacgaaaagcaacuuaaagagaaaaugccaugcgaaauccaauuggaaagaaugaagaaauacggaaaauaccacggcgaguucauaauagaaauaaacgaugaaaaagaauaccaauccaacgucuucacaaccaaagcguacaagaaagaacucgagaaaauauucgaaacacaacgcugcaauggaaacaagaucaacaccaaauucaucaaaaaguacauggagauauaugaacggaagagggaauacuauauaggccccggcaacgaaaagagccgcacagauuacgggauauacacgacccgcacagacgaagaaggaaacuucaucgacgagaaaaacaucuucggcaagcucaucggcaaaugcuccgucuacccagaagaauaccgagccagcagcgccagcuacaccgcgcaggaguucaaccugcucaacgacuugaacaaccucaagaucaacaacgagaaacugacagaguuccagaagaaggaaauagucgaaaucauaaaagacgccuccagcgucaacaugcgaaagaucaucaagaaggucaucgacgaagacauagaacaauacucgggagcccgaauagacaaaaagggcaaagaaaucuaucacaccuucgagauauacagaaaacucaagaaagagcugaaaaccaucaacgucgacauagacagcuuuacuagagaggaacuagauaaaaccauggacauacuaacccugaauaccgaacgcgaaagcaucgucaaagccuucgacgaacaaaaauucgucuacgaggaaaaccuaaucaagaaacuaaucgaguucagaaagaacaaccagaggcuauucuccggcuggcacagcuucucauacaaagccaugcuccaacucauccccgucauguacaaggaaccuaaggaacaaaugcaacugcucaccgaaaugaacguauucaaaagcaagaaagaaaaauacguaaacuacaaauacauccccgaaaacgaagugguaaaggaaaucuacaacccaguaguggucaagagcauccgcacgaccguaaaaauacugaacgcccucaucaagaaauacggguaccccgagagcgucguaaucgaaaugcccagagacaaaaacuccgaugacgagaaagagaaaaucgauaugaaucagaaaaagaaccaagaagaauacgagaaaauccugaauaaaaucuacgacgaaaaaggcauagaaauuacaaauaaggacuacaaaaagcaaaagaaacucguacucaaacugaaacucuggaacgaacaagaaggacucugucucuacucggguaagaaaaucgcaaucgaagaccuacuuaaccacccagaguucuucgaaaucgaucacaucauaccaaaaucaaucucccuagacgacagcaggucaaacaaaguccuaguguacaaaacagaaaacucgauaaaagaaaaugacacaccguaccacuaccugacucgaaucaaugggaaauggggguucgacgaauacaaagcaaacguacucgaacuccggaggcggggaaaaaucgaugacaagaaaguaaacaaccuccuauguauggaagacauaaccaaaauagauguuguaaaagguuuuauaaaucgaaaucucaacgacacgagauacgccagcagagucguccuuaacgaaaugcaaucguucuucgaaagcagaaaauacugcaacacaaagguaaaagucauacgcggcagccuuaccuaccaaaugcgccaggaucuccaccugaagaaaaauagagaagaaagcuacagccaccacgccgucgacgccaugcucauagcuuucucccagaaaggauacgaagccuaccgcaagauccaaaaggacugcuacgacuucgagaccggcgaaauccuagacaaagaaaaauggaacaaauauauagacgacgaugaguucgacgacauccuguacaaggaacgaaugaacgaaauacggaagaaaauaaucgaagcggaagaaaaagucaaauacaacuacaaaaucgauaagaaaugcaaccgagggcugugcaaccaaaccauuuacgggacacgcgagaaagacggcaaaauacauaagaucucaagcuacaacauauacgaugauaaggaaugcaacagccucaagaagaugaucaacucaggcaaaggcagugaccuccugauguacaacaacgacccuaaaacguacagagacaugcucaagauccuagaaaccuauagcagcgagaaaaaccccuucguggcguacaacaaggagaccggcgacuacuuccgcaaauacuccaaaaaccacaacggacccaagguggaaaaaguaaaauauuauucaggccaaauaaacagcuguaucgacauaagccacaaauacggucacgcgaaaaacagcaagaaagugguacucgucuccuuaaaccccuaucgcacagacguuuacuacgacaaugacaccggcaaauacuaccucguaggagucaaauacaaccauauaaagugcgugggaaacaaauacgucauagacuccgagacguauaacgagcuccuacgcaaagagggcguacugaacagcgacgaaaaccucgaagaccucaacucgaagaacaucacauacaaauucagccuauacaaaaacgacauaauccaauacgaaaaaggaggugaauacuacacagagcgguuccucucccgaaucaaagaacaaaagaaccugauagaaacaaagccaaucaauaagccaaacuuccagagaaagaacaagaagggagaaugggagaacacacggaaccaaaucgcacucgcgaagaccaaguacguggggaagcuagucacugacguacuaggcaacuguuacaucguaaacauggagaaauucucgcuugucguagacaaauga

SEQ ID NO: 6241 - RNA, 3324 nt, Artificial Sequence
  Cas9 variant
augggcuacacgcuaggucucgauaucggcauagcaagcgucggauucggccucauagacaacguggacggaaaaauacuggaauccggcguccgccucuucucauccgcugacccggauaacaaccagacacgccgaagcagucgccaggcccggcggcugaaccgaaggaaaguccaccggcuggagcgugucgcccaccuacucgaggaagccggauucgaaaagggagaaguccucgcccccacacccuaccaucugcggguuaagggacugaccgaaaaacugagcaaacccgaaguguacgccgcacucuacaaccucaugaaacacagaggaauuagcuaccucgaagacguugaacucgacgaagcggauagcuccagcgucucccaaaacguugaacuacucaaggaguacuaccccugcgaaauccaacucgaacgcuaugaggaauacggccaaaucagaggcaucauagagaccuacaacaaggacggggaaaaagaaucccugguaaacaucuuccccaccggcgcguacaagaaagaggcggaggcgauaauacucaaacaaggccaauucuaccccgagcuagacaaaguguuuuuagaaaaguucacagaaauacucacugugaaacgccccuacuacgucggcccuggaaacaagaaaucccgaaccgacuacggcauauaccgcgaaaacggagaaacgcucgagaaccuguucgacauacuaaucggcaaaugcacaaucuacccucaagaagcacgcgcggcgaaauucuccuacaccgcucaguuguucgacuuccuaaacgacaugaacaauaucucgauagcuggcgaaaaauuaacggagguacagaaacgcgaaauauaccaccaaauaaugagcucaaagacuguaaacaugaugaaaauaaucaccaaaguaaccggcugccuuaaagaagaaguaacuggcuaccgggucgacuccaaauauaaagcagaguuccacuccuucgcuuccuaccgccaauuccgaaacaaaaugcucgacuacggcuucgaugugcaaacccugaacgucgaaauguucgacaaacucgccgccaaacucacccugaacacagaauaccaccaaauaaucacccaacucgaaagccugaaccucggccucagcaaggagcuaauugagaaaaucgccgacuuucggaagaaaaaccgaagccucuucuccaaauggcacucacucucccuaaaagcaaugaacgaaguuguagacgagcucugguccacaucgaaaaaccagaugcagauuuucagcgaguuaggaggguucaaaucaaacaucgaaguguucaaagggcucaaguauauuccucuggacgccauggucgacgagauauacaaccccguaguccgcugcuccauccgcgagagcaucaagauaauaaacgcccucuugaagaaauacggggcccuagacaaaguggugaucgagaugccgcgggacucaaacgaaaaagaagaaaaagaccgaauaacaaagcucaacaaagaaaacgacaacaaaaagaaacaagcaaucgaaaaagcgagaaacgaauacggauucggcgaagaagcauacagacaacaaaacgaccuuaauaccaaacugcgccucugguacgagcaaaaacaacgaugccucuacucaggggaaauuaucaaaaucuucgaccuaaucaaaaauccacaccucuucgacauagaccacauaauucccaaaucaauaucguacgacgacagccuuagcaacaagguccucugcuacgcuacagaaaaccgcgagaagggaaacuuaacccccuaucgcuauuucaagcgaaaagccucauuaacuuggaacuacgaagcauacaagucuuacgucauagagcucuacaaagacggcaaaggagaccucucacggacuaaacuugaacuccuccucuucgaggaagauaucaacaaguacgaaguacgacagcgguuuauaaaccgcaaccucgucgacacacgguacgccuccaaagucgucuuaaacacgcuccaagauuucaugaaagagaacuacccuaccacaaccguagagguagucagagguaaguucacugcccaacuaagacgacacugggggauuaggaaaaaccgcgacgagaaucacgcgcaccacgcaaucgaugcacuuauaaucgcgugcgugccccaccuaucacuguggaaagaacaaaagaaagucuucuccaccgacgaguuccgcguagacgaaacaaccggugaaaucauugagcaaucauacaaccaauuaacguaccaagagcccuucucccaguucuucuaccaacuugaaaaaguauccauagauugcagauacuccuacaaaguggacagaaaauucaaccgccaagucgcggacgccacuaucuacucaacacgacagggaaucguaaaacagaccucaggcgacaaaucauucacccuugacucgaacuccaaagaacacuacgucaucgccaagaucaaaaacauauacgaagacguagacgcaaagagguucauggacagauacaagaaagacaaaacacaauuucugauguaccaccacgacccccaaaccuuuucaauauuagaagacguaaugaaaacuuaccccgacaagaaaaaccccuuccaagccuaccgccucgaauacggccccauacgaaaguacucaaagaaaggaaacggcccacaaauacagagcaucaaauacuacgacucgaagcucggccaacacaucgaacuaaaacaagcaaaccaaagcaccaagaaaguaguacuacagagccuaaaccccuggcgaugcgacaucuauuacaacaagaaagacaaacgcuacaucgccgcagggcuaaaguacgccgaccucagcuaccagaaaggcaccggccuguacggcaucucccuccagcgcuaccaacagauccucaacagcgaaaagauagaacuaagcaucgaacaaaucgaacuacuccuagaagggcgucucaacgaaaguaacuuugaguucugcuucagccucuacaaaaacgauuucauccaauggaaugacgaaaacaaccagacguuccaauaccgauuccuagcaaggaaccucuccagccccaaccgaaucgaagucaagcccaucaacaagagcaaguacgacaaacaagccgaaggccuuaagacccucaagaaaggccugaaccgcuucuacaaaaucucggucgacguacuaggguaccaacacuucauaaagaaagaaaaacuuaaacucacauucaaauga

SEQ ID NO: 6242 - RNA, 3330 nt, Artificial Sequence
  Cas9 variant
augagccacuacguccucgggcucgacaucggaauaaccucagucggauacgguaucaucgaccucgacacgaacgacuucauugauuacggcguacgacucuucaaagaaggaaccgccgcgaacaacgaagaccggcgcaacaguaggucccgccgcagacuccucucccgcaaacacacaagacucauggacaugcaaaaaguucuaaaagaagccggcaucaugaccgaaucuuacagcccgcucuccaaugucuaugaaauacgcaaaaaggggcucacaaaggaauuaaccaaugacgaacucaccgccgcaaucuuacacaucaccaaacauagaggcuccguaaucgaaacuguggaagacgacgaggcagcagccaaggaaaccggcgaacucaaaagcacccuccacgagaacgcacuucuccuggcaaacaacaaguucgucugcgaaauccagcuagagcggcucaacaccgagaacaaaauccgaaaccacaagaacaacuucaagacuaaagacuacgucgccgaacucaaagaaauacucaaccaccagaaccuuagcgaggagguaaagaacaaaaucauacaaauaguagaacgacgacgagccuacuacgagggacccggcuccuuuaacucccccacccccuacggucguuucauagaagucaauggucagguacaggaaaucgaccuuaucgaaaagaugcgcggcaaauguuccguauacccggacgaguuccgugcaccgaagaugucaaucagcgcagaccuuuucaacauacucaacgacuuuaacaaccuccugguccagggcgaaaagcuccaagaagaagacaagaagaaccugcuaaaaauaauaaacgacaaaggcucaauaacgcuccgacagauaagcaagaagcucgaagucaacgaagacgagaucaaagguuaccgcauagauaagaaaggcaaagcccucuucaccgaguucaaaggauauaaaauacuaaagaaacucuuccucaacugcggccaaucgauaagccuugaagacuacgaaaugcuugacgaaaucaucgaaaucguaaccaaaaagaaaggaauagaugaaagaaaggacgcgcugaaagagcuaaagugggaccucucggacgacauaauaaacucacucuccgaagugaccggaauaguaggcuaccacagccugagucuaaaagcaauacgcgagcuagacagcgaacucuauaagacgucacuuaaccaaaugcaacuucuccacgagcuaaaaauguucgauaaaaaccggcccuccuauaagggaaagaagaacauagucgcugaccccgaagccauccucucgccaguggccaagcgcgcccaaaaugagacguucaaaguuaucaacgcccuucgaaagaaguacggcgaguucgacagcauugucguagaaaugacgcgcgacaaaaacagccaggaacaaaagaaacguaucaacgacagccaaaaagcccucgagagccuuaacaaagagguagaccaauuacuacagcaaaaaggcuacgauccacaaaagguuaaaggcaagacaaaacagaaaguccgccucuacaugaugcaagaaggcaaauccgccuauacacuccaggagcucgaccuacaccgcguaauuaaagacgacaaauacaccgaaaucgaccacaucauccccaucuccaucucacuugacgacucacaaagcaacaaaguccucgcgcuccacuccgaaaaccaacagaagggcaaccucacccccuucauggcguuccacaccggcagauucgccgacaugggaugcacguggaacaaauuuaaggaaaacguccucuccaacaaaaacuacaaacauaaaaagaaaaacaaccuacucgacgagagggacaucaauaaauuuagcguaauccaagaguucauuaacagaaaccucguagacacuagcuacgcaaaccgcgucguccuaaacacccuaaccgacuacuucaaagacaacgaaauugacacgaaagugcauacagugaauggcaagcugaccgaccucuuccguaaaaggaucaaccuaaagaaagacagaaacgaggauuaccuccaccacgccauugacgcacuaauaguagccagcaucaaaaagcugcgccugcuagauggcuaccucgcgaaauacggauucgagacccuauacgacgagaugaccggagagauaaaagagaucccggaagacaaagcguucuucgacgacaaauauauccgcuacauacucaaccucaaaacaaucuacgaaagcuccaacauguacuaucgagggauacucgagcgcgaggaacugaucuaccaaccgauaaaaaucagccauaagaucgacaccaagccaaaccgcaaaguuucugacgaaacuaucuacuccacacggauuaucgacaaugaagaucaccuaauugagaaauacucagauaucuacgacccaaaauucaaaaaccucacagaggacauccuaaacggcgagaaaaacaaauaccuuauggagaaaaacgacccccaaaccuucaacauacucaaacaaauaaucuucaaccacuacaacacauacaaagacagcaaggaguacuauaaaauagaaaagaagaaagaaaaagagaucaucaaacucgucggcaucaacccucucagcuuguacaaagaggagaacggcccuauaaagaaauacucgaaaaagggaaacggccccgucaucaugucuaugaaguacgauuccgaaaaacucggcaaucacauagacaucacgccggauagcgccaagaacaaaaaggugauccugaaacaaauauccccauacagaaccgacuucuacaagugcagcgaugagaaauuccgauucgucacuguccgcuacaaagacguacacuaccaaaagucaauagacaaauacugcauagauaaagaaugguaucaaaacgagaagaaaaacaagaaaauagacgaaaaagcggaguuccuauucucgaugcaccacgacgagcucauaggcaucaccagaaaagaaagcgagcaguucaucuacgaugaaagcaaagaaaaucacggugacccgcgcuaucacgacgggguaaagcccgaaauccuaaaguucaccgcaaccaacaacgauacaaaagggaucaucgaagucaagccgcuauacaccuacucagcuuacagacucaaacccaccguacuaaacguuaaaaacaucaagaaauacgccacggacguccuaggaaacuuauaugagguuaagcagaacgaacuaaagcucgaguucuga

SEQ ID NO: 6243 - RNA, 3333 nt, Artificial Sequence
  Cas9 variant
auggcagaaggcaagaaaagaauauggcgacugggagccgaccucggagcaaauagucuaggcugggccgcaaucgaacuaagcgccccaguaaacggcaaacccauagcaauccucgcggccggcaguagaauauucagcgacggacgagaccccaaaucaggcgcaucguuggccguggaccgaagggacgcacgugccaugcgccgcaggcgcgaucgcuucaaacagcgacaaaaagcacuaauuaaauaccucauagcagacggacucuucccggcagacgaagccgccaggaacgccauggcggcaaucgaccccuacgccguccgagcccgagcccuagacgaggcacucagcuuacccgaacuagggcgcgcacuguuccaucucaaccagagaaggggauucaaaagcaacagaaaagcagauagaaaagcugaugaugacgcaggaaaaauagccauaggaaucgaccgcacccgugacgcaaucgcggaagaugaggccgaugccggcgcggaaccagguaguuggaccuucggaaaaugguuacacgaacgaagacuaaaagggcaaagcgucagaacccggcuaagacccgagagcggagaggaugccaaaggagacggcuacgacuucuacccagacagagcccucauggaggaagaguucgacgccaucugggcggcacaggcaccccaccacccagacgugcucacaaacgacgugcacgaccgacugcacgaaauaaucuucuaccagcgaccccuaaaagcaccccaaguaggaauguguagccuaaucccgggggaccgaagacugccaaaagcccacccacuuuuccaacgacgaagacuucuggaggagcugaacgcccuaaugauaguccguccaggagaaguagcacaaagacuaacaagagaggaaagagacauacuacuacugaaacugaaagacaaaaacaaaguaaguuucgcuacccuacgcaaagcacuaaaacuagacccggacgcacgauucaacaaagaguccgaggacagaacagaccuaaaaggagacgaagucgccgccgugaugggauccaaaacgcgauucgggaaccuguggguccaccuauccauagaagcccagugggacgugcuagcccggcuagacgcgguagaaucagaugcggaagaugccgcauucugcgcauggcuaguggagacguacgcauuaacacccgagcaagcacgagcagucgcaaacgcaccgcucccucccggauacggcagauucggcgagacagccacacgaaaacuaaucgaggccuuaagagacggcaaaaaggaugaccgagugcuaguauauucagaggcaguaacugaagcaggccucggccaccacuccgacagaaggacaggagaggucuucgaagaugccaaaggcagaccacaacuaccauacuauggggucgcacuagagagacacaucaugccaggaaccggagaccccucagacccagaagaaaugagaguaggccgacucacgaauccgacuguacacauaggccuaaaucaacucagaagaauccuaaacguacugaucagagcauacggaccaccagcagaaauagcaauagaacuagccagagagcuuaaacuaacagacgaagacaagaaacgaauaaaccgagaaaacaaugacaaccgaaucgcagccgagaggagaagcgagaaacuacucgcaauaggccaagcagacagcggagccaaucgagccuuacugaaacugugggaggaacucaacccagccaacguacuggacagaagaugcaucuacaguggccgccaaaucagcauugacaugcuguucuccgccgcuguagaagucgaccacauacucccguucgccgccacgcuagacgacucgaauggaaacaaaaucguaugccugagagaagcaaauagagaaaaacgaaaacggagcccccacgaugccuggggacauucagcaaggugggacgaaaucgcagcacgagcagcucaacucccgcgaaacaaacgauggcgauucgaaccagacgccauggacaaauuccgagacgaaggcggguuucaagcacgacaccuaguugacacacaauaccuagcccgacuuucacgugaauaccuagcgacacuguacccagagaaaggggagggguccggacacaucugggucuccccagggcgccuaacagagauggucagaagaaaacugggacuaaacgaccuacucccagaccauaacuucggaggcggagcugaccaggcgaaaaauagacucgaucaccgccaccacgccaucgacgcugucguagucgcaauaguagacagagggaugcuuaacgcaauagcaagggccagcggucaagaaggagcagaaggccgagaacgcaucauaaucccagaaccgugggacggauuucgggacgcccucagagaaaccguuaaucgaauaaccgugagccaccgaacagaccauggaacggcauccaaagcaggccuuccgaaagguaaggacgccacagcugggcgcuugcacaaugacacagcauacggcuuuacgggagacaccgacgcgaaaggcaacagcaucguagucagacgcgucccacugagcucauuuaagaaacuugcagaucuggaccguauacgcgacgcagaccucaaagccgccuuauaccaacacuuaaacgggcucgaggggaaagcauucgaaaaagcacuagccgaauuucacaaacuggaguggcacaacuucggaggcgucagacgggucagggucacagaaccgcucacaguaauaccaauaaaagaccgaaacggacgcaucuacaaaggcuacaaaggcgacagcaacuaccgauacgauguaugggaacucccugacggcaaauggguaacaaauuggaaaaacgaagcuggugaggcgaugucguccgugaucucgauguucgacgcacaccaaagcuccgaaccgccuagaccacaccccgcagcacgaaaaauucugucccugcaccagaacgaccuacucgcuauagaaagagagggcgaggaucgcaaacuaaugagaguaguaaaauucggccagagcggccaaaucacacuggcagaacaccaacaagcaggagacuuaaagaaaagagacgcagucagcaacgacgacgacccauucaaauauuucgcaccaacaagcggcggauugaagaaagucaaagcacgacagguaagaauagacgaaaucggcagagugcuagacccuggguucccggccagaaccgcaagacggaaaacaaggggauga

SEQ ID NO: 6244 - RNA, 3333 nt, Artificial Sequence
  Cas9 variant
augacagcaagaacccacaagaucuggcgacugggagccgacuuaggagccaacucccuaggaugggcagcuauagaauuaagcgcaccaguagacggaaaaccgauagcaauccugcacgcaggaucaaggauauucagcgacgggcgagaccccaaauccggugccagucuggcggucgaccgacgcgacgcaagggcaaugcggcgacgaagggauagacugcaacagagacaacgagcacugauaaaauaccuaaucgccgacggccuauucccagccgacgaaaacgaaaggaaggcaauggcgaccauagacccauacgcgguccgggcucgagcacuggacgaagccuuaacccuccccgagguagggagagcccuauuccaccugaaccagagaaggggauucaagucgaacaggaaggccgacagaaaggccgacgaagacgcagguaagauagcaaucggaaucgacagaaccagagacgcaauccgacaggccgaggaagaagccggagcagagccagggaguuggacuuacggcaagugguuguacgaacggagagccucagcaacggacgcgaacgcaauccccagcgugaggacacggcuaagaccagaaacagacgaacacgccaagggcgauggguacgacuucuacccaggccgagcgcuaauggaggcagaguucgcagcaauaugggaagcgcaagcggcacaccacccggaugcccuaaccaacgaggugcacgaccggcugcacgagauaaucuucuaccagcgaccgcucaaggcgccacaaauaggcguaugcacacuaauacgcggcgaccagagacugccuaaagcgcacccccuguuucagaaacgaaggcugcuagaggaacucaacgcacucacaauaguccgcccgggcgaaauggcgcaacgucuuacgcgcgaagaacgggacacgcuguuuuuaaagcuaaaagauaaagcgaaagucucuuuugugagccuaagaaagacauuaaagcuagauccagacgcaagauucaacaaggaaagugaaaacagaucagauuugaaaggggacgaggucgcagccgccaugggggcgaagacccgguucggaaaccgauggguacaccucaguauugaagaacaaugggacguaauagcgcggcuagaggaaguagaaucagacgccgaagacgcagcauguagagcauggcuagccgccacauucgaccuaacaccagaacagauaagagccguaacaaacgcgccgcugccgccaggcuacaguagauucgggaagguagcaacccagcgacugaucgacgcauuacgagacggagagaaggacggccggguccuaguauacagcgaagccguggcagccgccggacucggccaccacucggacuugcgcacaggcgaaauauuugaagacgcccaaggaagaccccaacucccuuacuacgggguagcccucgaacgacacauaaugcccggaaccggaaacccugaccacucagacgaaaugagaauaggaagacucaccaacccuacagugcacaucggccucaaccaguuacggagaauaguaaacacauuaauccgugcauacggcccgccagcggaaaucgccauagaacuagcucgagaacuaaaacugacagacgacgacaagaaaagaauaaacaaagagaacaacgagaauaggcucgccgccgagaaaagaagcgaaaaacuacugacgaucgguagaccagacacaggagccaacagagcucuacucaaacucugggaggaacucaacccagcaaacguacuggacagaagauguauauacacgggcacccaaauaucaguagacaugcucuuuagugcggcugucgaaguagaccacauccuaccguucacagcaacacuagacgacucaaacggcaauaaaauaguaugcaugagggaagcgaacaggaccaaacgcaaacaaagucccuacgaagcauggggccacacagaccggugggaggaaauagccgcgagagcagcacaacucccccgcaacaaaagauggcgauucgagccagacgccauggaaaaauuuaaggacgagagcggauuccaagcccgacaccuagucgacacacaauaccuagcgcggcucagcagagaauaccuggaaacgcuauauccaggaagcggcgaagggagcucacacaucuggguaucccccggacgacuaacugaaaugguacgacgcaagcucggccuaaacgaccuacugccggaccacaacuuuggaggaggagcggaucaagcgaaaaacaggcucgaccacaggcaccacgcaaucgacgccgucguuguggcgaucguagacaggaguaugcuaaccgagaucagccgcgucucggggcuggaaggagcggaaggacgagaacgaaucaucauacccccaccaugggacgaguucagaaacgaccugcguacagccgucaacgcaaucaccgugucccauagaacugaucacggaaccauauccaaagccggacugcccaaggggaaagaugcaacagcagggcgacuucacaacgauaccgcguacgguuucacaggggaaaccgacgcuaaaggaaacucgauaguagucaggcgaguaccccucgcuucauucaagaaacuggcagaccucgaccguauccgagacaccgaucuaaaagccgcgcucuaccagcaccuagagggcuuggaaggcaaggcauucgaaaaagcagucauggacuuccccaaccuagaauggcacccguucggaaacgucagacgaguccgcguuaccgaaguccuaucaguaaucccgauaucggaccagaacggccgcaucuacaaaggauauaaaggggacucaaacuaccgguacgacguaugggaauuacccggcggaaaaugggaggcagaaguaguaucaacauucgacgcacaccagccagacugggugagcaagauccggagcagaagcccgaccgcacgaaaggucuuaagccuccagcaaaacgacuuaaucgccguagaacgagcgcacgaaacacgagaacugaugagaguggucaaauuccgacagaacggagaaauaacguucgcgcccccacaagaagcagggagccuaaaacgcagggacgcaacgccuaacgaggacgacccguucaaauacuucgccguagccgccagcucgcuccagaaagcgaaagcgcgucagguucgaauagacgaacuaggacgaguacuagacccgggauuccccgcacgaacggcccggcgaaaaaccaggaaguccaccuga

SEQ ID NO: 6245 - RNA, 3333 nt, Artificial Sequence
  Cas9 variant
augcgcauacugggcuucgacaucggaauaacgucuaucggcugggcguacguagaaggcgaggagcugaaagacugcggcguccgaaucuucaccaaggcagagaacccccaaaacggggacucacuggccgcuccaaggagagaagcgcggggcguacgacgccggcuggcccgucgaaaaguccgccuaaacguaauaaagaggcuccuaugcaaagaguucggccucaaccugagugacuacuucgccaacgacggagaauuaccaaaggcauaugaaacaacaaaagacaccaaaucacccuacgagcuccgcagccuggcucuggaacagaagcucgaaccaaaggagcuagcgcggguaauacuacacauagcaaagcaccgaggcuacggcaacaagcacgcgaagcgcgacuuagaagcagaggagaaggcgaagaaagcagcagaaaaggcgccacaggagaaagaaaguaccacgaccaacggggacaguaagaaagaacaagaaaaaguccugaaagcacucuaccaaaacgaaacccuacuuaagaaauaccagaccaacuaucaaacuaacaacaagaccaacgacgaaacaaacaacaagacgauauuccuggucggcaaauacuuauacaaagaguuccaagacaaggggcaaagaauccggaacacaacaaauaacuaccaacacacaaugcggcaagaaugguuaaaagacgaacuagaguucauauucaagaaacaaaaagacuuuggcgcgacguucucggagaacuucgaaagccaaauccucgagacggcguucuaccaacgggaucugaaaucguucgaagacaaggucggcaaaugcguauucuacgaaaacgaaaaccgcgcgccaaaggacagccuaagcgcgauggaauuuguagcacucaccagaaucauaaacacguugaagaaccuagagaaaaagagcaagaaccuaggaauaggcgaaacauacggaaaagacaagauccaagaaauacuaaaaaucguccuagacaagggcgaaaugagcuacaaggaacugcggaaaauacuaaagcugaacgagaguauccuauucgccaaagacagcaaacucgacuacaccaaaggcaugcaagaggcugagaaggcaaaauucauagagcuaaagaaccuaaaggcuuucaagaaagcuaugggaggcgacuucucaaaauuccccagggaagaacuagacaagaucgccacagauaucgugcucaucaaaagcaaagaaaaccuagcaaagaaacugcaaaacuacagcgcgcugagcaaggaacaaguagaagcacuauccaaccucaacuucgcuaagcacauagaccugagccucaaggcgcucgacaaaauccucccguucaugcgcgaaggacucagcuacgacgaagucgucaagaaagucgggcuccaagaacaccggaaauacaagcaaaaaggggaguuccucauaccccuaaaggaauacgagcccuaccucgcgaaccccgucgucgcgagagcccuguccgaauauaggaaaguacugaacgcacuccucaggaaguacggcaacgugcacaaaauccaccuagaguucacgagggaagccgggaagaacuacgacgaaaggaaaaagauagaaaaggagcagcgagaacacuucgaagcaaaccaaaaagccaucaagcaacgggaaauacugggacugcccauaaacggagcgaauauccucaaaaugaaacuuuggaucgaacaaggcgaaugcugcgucuacuccggggaaaagauaacgagcaagcacuucuucgauagcaacgcacuccaggucgaccacaucuacccauacagucggagcuucgacgauuccuacaugaacaaggugcuggucuucgcgaaagagaaccaaaacaaacugaacaaaacccccuucgaagccuucggcuccgacaaggaaaaaugggaucgaauccuaucauugucggcaaagcuacccaagcagaaacagagacgaaucagcaacaaagacuucaaagacaaagaacuaggcuucaucgcaagaaacaucaacgacaccggauacaucgcucgacuagcuagccaauggacgaacaacugccuaaaauucgaagaccugagagaaaacgaagucacgauagccggagaaaaaggauccaaaaaccaucuagaggugauaagcggacaacuaaccagcaugcugcgccacuacugggggcucggcgacaaagaccgcaacaaccaccuccaccacgccguggaugcggugauaauagccuacacaaaugccaaaacaauuaaagcguucgcggacuucaagaaaaaccaagagcagaacagggccaaauucuacgccaaacaaaucagcgaacaggaauacaaaagacaacgaaacccauucgaacccugcgcgaacuuccgccaacgagucgaagagaagauuaacaaaauauucguaucgaaaccaccacggaaacgagcccgcggcgcccugcacaaggagacguucggcucuauaugccucgacggaaacaacaacugggucgccagguuuaaaaucaaaagcaagaaagaacaagaggacauaacaaaagaaaaagccacaaaagcgaaauacaaggacgaguucaagggcgaagaaaacauaaggaaagcccugaaacuuggcaaaauacgcaggauaaacaauacucagaaagauauagcuaucggagacaaaaucgugaaaaaugagaccaugguacgggucgacauauucaaggacaagaaaggcaaauucuacgccguccccauauauacaauggacuucgcccuaggcauccuucccaacaaagccguagcgacaggggaggacgaggacgggguaauaaaagacuggauugaaauggauaaaacaaaauacgaguucugcuucagccuguucaaagacgaccucauaaaaguaagaaagaagaaaaugaaagaagccgaacuaugcuacuucgucggcuucgacaccgacggaucgcgcauaaucguggccaaacacaauaacgacuaucaaaccaugaccgagaacgaaugcaaacucuucacgcuaaaggagaagaaaaagaaacagaaaacgcuaaacgacgaagaggacaaccaagagcggaucgagaccgaauacaaaaucaucgguggaaggacgggcauccaaaaccuggagaccuucgagaaacaccagguaagcccacugggcgaaguacagaaagcugaauuugaagaccgccaagaaauaaaacugaagucaucaccgaaaggcaaagacuga

SEQ ID NO: 6246 - RNA, 3333 nt, Artificial Sequence
  Cas9 variant
augagcgaaaaauacagacuggggcuagacgucggaacaaacucccuaggaugggcggucaucggccuaaaggaagacguacccucaagcguacuagccacgggcguccgaauauucagugaaggccgggacgccaagacaaaaucaacccucaaggcaucccggacagagaaacguucggcacgcaggcgaagggacagauuccuccaaagacagacauuccuaaucucagagauggucaagagcggacucuucccaaaagacaucgucgaacagaaaaaccuggaacuacucgacccguaugaaauacgcuucaaagcccugaccgagcaagucccccuacaccaccuaggacgagcccucuuccacaucaaccaacgaagaggauucaaaucgucccgcaaagacaaaucagaagaaacuaccuccggcgucguaucaaagucgguccgcgcccuauacgaagaaaugcaauuaauaaauccggcccccguaaucgacgaccccaaagcacuaucaaaagaagaaagacgagaaauccgcguacaggaagcaucgucccgagaagaagcgcuaguaaccuuggcagaacaaaaaggaguaacuuucggggcauuucucuaccggcgacuacaaucaggcaagagcguccgagcccgaaaggacgcagacucgcagcuauacgacguuuaccccacgcgggaacuacuaaaagacgaauauucgaaacucaugcaacaccaagcacaauacuauccgaacgugauaaacgaagcacugauuucccgacuccacgacguaaucuucuuucaacgaaaacucaaagaacaagagcgcggauuuugcaccuacuacccgagcgaacggcggacauucaggugcaugcccucguuccagcaauaccgaaugguccaggaacugaacgcgcucgaguggguagacgccgccggcaagcacugccuccgagacuaccccgaaagccgcgaccucauacuaucagagcucgagaacauauccaccaaagcaggagaguucacauucggcaacaugaagaaaauacugaaaaagauggggguaaucgacggagaaguaucauuuaacuucgaaggcccgaagcgcaaaggcuuccagggcaacguaaccucacgagaaaugcgacacgaagacugcuuuggcacccggugggacgagcuaagucuggacgagaaagacgacauuaucgauaagauaaacgacgaucauuuagacgacgaagacauggagcgauaccucauagacaccuacggccugagcagcuuuucaguaggcaacgccauaaacgcacgacuccuagaaggaacagccaacgugaguagaaaggccgcccgcacccuauacgaaacgaugcuauccgcaaauugccuacaaucagacgcaguaaucgccgugucagaacaggacgacacauucguaaaccccuacagucggacggggcgcggggaacugcucuccgaacugccauacuauggcgaagcauuccaagacggacgccacauaauacccggaaagcgcgagcccaaaguaagccacgaccaauugaaguucuauggcggcguaagcaacccaacagugcacauagcccugaaccaaauucgccugguugucaaugagauaauaaagcgcuacggccugccaucguccaucagcauagaacucgcuagaaaucuucccgaaggccaggacggacggcggaaaauagagaaaaugcagagcgaaaaccagaaaaacaacgaaagauacgaccaaauccuaacagaaaacgggcaaucgcccaaccgggacaaucgucuaagacuagcacuaugggaggaacuaggcgaaggaccgaccgaccggcucugcguauuuaccggcaaacuaaucgaacuagcagaccuguuuaacggcuccguagaaaucgagcacuugaucccguucuccgucagccuggacgacuccaaggccaacaaaacagugugcuggaaagaagcgaaccgauucaaaggaaacaaaacaccauacgaggcauuugcaaauaacucgggagacuauagcugggaggagaucauggagcgaguacgagcucuccccaauagcaagcaauggcgguuccaagaagacgcccucaaaaucuggaacucagaccacagcgacuucaguggcagacaucuaaacgauacaagguauauaagccggcuagcccgagaguaccuggagaacaucugccccuucaacaagauagacguggucacggggcgccuaacggcccuccuaagaggacacuggggccuaaacaacauccugagaggacacaaugagccagaaaccgcaaccccaaagaagaugcgagacgaccaccgccaccacgcaaucgacgccgugguaaucgccaugacgagccuaacgauacugcagaaaguaucaucagcggccggaaaggcggaagaacuagacgugggcaaacucuucgcaaaagacgaaagcggucgcagcgucauagaccccugggacggcuuccgcgacgaggucgccgaaaaaguccgcaacauuauaguuucccacaagacaaaacgcaaaaccaucggcaacucaggcaaaucaacggaccgcgcauuacacaacgagacggcguacggacucaucgacgguccagacgagaaaggucucuacuccgucgucaccacaaaaccaauauccuacuucgacaaccgugacaagauugagaaaauacgagacgagaagcuacgggacgacuuccucacugccugggacggcgaaggagacaacaaagccucacaacuggcaguacuagacaaagccuccgggcuaaacgugaagaaaugccguuacguggaaagaaagaaagucauaccaauaaacggaccggacggacaaccuuacaaagccuacgacggaaauuccaauugggggauggaaauauacgaguucccaaacggacacccaaaagaaaagaaauggaacggaguaguaaucuccaccuacgacgccaacaaaucagaguucaaaccaggcgaaaccuuccggccacauccagcagccaaacucgucaugcggcuacacauaaacgacauaguagaaguccaaaacgacggagaaccaauccucuaucgaguccaacuaauauccgcggguacacuuacgguaagcccacuccacgaagcaaacgucgacucacgcaauagagacaaacacgaugaauuuaaauacaaaucgcuaagcgugacaccgaugcagaaaaugggcgccaaaaagguaaacauaucacccaccggacugaaaaacuacagccgcuga

SEQ ID NO: 6247 - RNA, 3345 nt, Artificial Sequence
  Cas9 variant
augggaaucaucaucggacuagacauaggcaucgccucggucggcaucgccgucguagacaaggacacccuagacaucaagugcgucguuagugaccucuucgacagcgccgacgccaguaaaaacaucgaaagaagaaacaacagacaggcacgccgacucaaucgccgacgaaaaacaaggaucggugacuucaacacccucuggguaucaauguucggcgagcuccccgaagaaguagacagcaacguacuacuccugcgaaacgcaggacuugacgaacaacuaacccucgacgaaauauacuguguccucaaauacaugcuaaagcaccgcggcauauccuaccucgaggacgcccuaaacgaagaaaacgucaccggauccuaccagaagggaaucgcaauaaaccaaagagagagcgaauacaugcuacccugugagauccaacuggagcgcuuucggaaauacggacaauaccgaggagaaugcgaagccgagaacgagaacggcgagaaaauaacuuuaucaaacguauucaugaccaauaguuaccgcaaagaaaucgacaaauuccucaacacgcagggcaaauacggcauucuaaaccaaaaauucaucgacgaguaccugaaaaucuucaaccgaaagcgcaaauacuacgaggguccugggaacgaaaaaucccguaccgacuacgggaaguacaccacaggaaaagaccucgacggcaaguacaucaccgagaaaaacaucuucgaaaagcuaauagggaaaugcuccguauacaaagaggaauugcgagcggccggcgcaucauacacugcacaggaguucaacauccucaacgaccucaacaacauaacgguaaacaacaagaagcugaccacacaacaaaagaaggacgucauagaaaucguccaaaauagcgacagaaucaacauggaaaagauuauuucaucguguaucggggagaaaaucgaaaagaucgaaggcgcacggaucgacaagaacgagaaaaauauauaccacaccuucgaacaauacaacaaaaugaggaagauauuugccgagaaaaacuacgacaucaaggagcuaacaauugaacaacucgacgagauaggccguauacucaccaucaacaccgagcgcgaggggaucaaagacgccauaauggaaucggaacuccugcaccuuaacaacgaacagauaaacuuacuaaucgagcuaagguacaagaacagcucauuguucaccaaguggcaauccuuaagcaucaaggcaaugcgagaaaucauccccgacuuauaugaccgcaacgucaaccaaaugaacauacucgccgaaagaggcgucuucaaagauaaaaucaaccuauucgaaaauucuguguaccuaccgaaagagcccguacucgaagagaucuacaaccccguaguccgacgcuccaucucaaugacgaucgacgcgcuaaacgcgcucauaaagaaauacggauaccccgaggacauagucaucgaaaugccacgagaccgcaacgacgcggagcaaaaagaucgcaucaagaaauuccagaaaacgcgagagaacgaauugaaaaacauaaagaagaaaaucaaagaagaauacgggaucgagauaacagaugaauacuuccgcaaacacaaaggccuggagcuugaauugaaacucugggucgagcaaaacgaaaaaugcccauacuccggaaaguacauuaacguacaagacauacucuaccaccacgaacucuucgagauagaccacaucauaccccuaucaaucucguacgacgacagccgaaacaacaaagugcuuguuuacaaagaagagaaucaagacaagggcaaccgaacgccccuaauguaccucucgaccgucaacagacaauacgaucaacacgaauuuaugaacuacguccucagcaccaaaacacuaccgcgaaagaaacgagaacuccugcucaacuaugaagacaucaccaaaauagacguccuaaaaggcuuuaucaaccguaaccuaaaugauacgcgcuacgcaagcagaagcguccuuaacgcgauccaacuauuuuucggcggcaaggagugcgacacgaaaguacgcgugauccgaggagcagucacgaaccaacuacggaucaaacuuaaccucccaaaggaccgagaaaaaucuuacagucaccacgcaauugacgccgcaaucaugugcuauagucaaaugggucuaaugaacuuccggaacauacaaaacaaauucauagacuucgagaaugaaacguaccucagugacgagcgcgacuccugcuuugacaacaaauacuaugacgaggcacuguucggccaaguccucaaaaugcggaaaaaucuccuaaaagcggagggaaaaccccagagguccguacaaagcaaagguguauucgacgaggaagagaaaaacaacggaauaguccgauaccaccacaaggucgacaagaaacccaaccgcggccuaucgaacgcgucuaucuacgggacccgcaaaauagacgacaaaaucuacaaaaucgucggcuacgacaucagaaauaauaaggacgccgaagccaucauuaacaucauuaagaaaggcaaaucugauaacuuccuaauggccaaacacgaucccgaaaccuucaaaaaccucauggaaauauacgagcaauacaaagaggagaaaaaccccuuccucgccuaugaacaggaaacgggggacuacauccguaaauacgccaaaaaccacaacggaccgaucaucaagaaaaucaaauacguagacagcgaagucggguccugcauagacaucagcgcaaacuacggauacaaaaauggagacaaaagggucaucauggacacgcucacaccguacagggcagacgucuauuauaacuauaaggacggaacauaccggauaaucggugucaaauaugcagacuucaaguauagcaacgcaaaauacguacuggacgaagaagcguacgcacuaauccuaauaaaggaaggacuacuaaaaauaggcgacucccucgagaacaucucgagcagcggcuaugaguaccgccucagcuucuacaaaaacgacaucaucgaauauacgaagaacgacaucguauacaaagaacgcuuccuaucccgcaccaugccgaaagugaagaacuacaucgaaaccaagcccauaucagccgcgcucuacgagaaaagaaacccgaucggacucaccaacgcuacaaacaucuguaaaauuuauaccgacguccugggaaacgaaaccaaaaucuacaaggaaaaauucaagcugaguguagacuga

SEQ ID NO: 6248 - RNA, 3345 nt, Artificial Sequence
  Cas9 variant
augaacuacacagagaaggagaaacuauucaugaaauacauccucgcgcuagacauuggcauagcauccgugggaugggcaauacuagacaaggagucggaaacagucauagaagccgggagcaacauauucccggaagccagugccgcagacaaccaacuccgacgcgauaugcgaggcgcgaagcggaacaacaggcgacucaaaacaagaaucaacgacuucaucaaacucugggaaaacaauaaccuguccaucccucaauucaaauccacggaaauagucggacuuaaaguccgcgccauaacagaggaaauaacgcuggacgaacuguaccugauacuauacucguaccuaaagcacagagggaucuccuaccuggaggacgcccuggaugacacgguaagcggaucgagcgccuaugcaaacggccuaaaacuuaacgcgaaggaacucgagacacacuacccgugcgagauccaacaggagagacugaacacgaucggcaaguaccgaggucaaagucaaaucaucaacgaaaacggagaaguccuagaccuuagcaacgucuucacgaucggagcauaccggaaagaaauccagcgggucuucgaaauacaaaagaaauaccacccagagcuaacggacgaguucugcgauggauacaugcugaucuucaaccgcaagagaaaauacuaugaaggcccaggaaacgagaagucccgcacagauuacggacgauucacgacaaagcucgacgccaacggcaacuacaucacagaagacaacaucuucgaaaaacucaucgggaaaugcuccguauauccggacgaacugcgcgcggccgcggccagcuacacagcgcaggaguacaacguccucaacgaccuaaacaaccuaacaauaaacggucgaaaacuagaagagaacgagaagcaugaaaucgucgaacgcaucaaaagcuccaacaccaucaacaugcgcaaaauaaucagcgacugcaugggagaaaacauagacgauuucgcgggcgcccggauagacaaaagcggaaaggaaauauuucacaaguucgaaguuuacaauaaaaugagaaaagcccucuuagaaauaggcauagacauuagcaauuauucccgcgaagaacuugacgagauaggcuacaucaugacaaucaacaccgacaaagaagcaaugauggaggccuuccagaaguccuggaucgaccucagcgaugauguaaaacaaugccucauaaacaugcggaaaacaaacggagcacuguuuaacaaguggcagagcuuuucccucaagaucaugaacgaacugauacccgaaauguaugcccaaccaaaagagcaaaugacccuacuaacagaaaugggagucacaaagggaacccaagaagaguucgccggauuaaaauacaucccaguggacgucgucuccgaagauauauucaaccccguuguacgcagaagcguacgaauaucauucaagauccuaaacgccguucucaagaaauacaaagcucucgacacgauagugaucgaaaugccccgagaccgcaacucggaggaacaaaagaaacguaucaacgacagccagaaacucaacgaaaaagaaauggaauacaucgaaaagaaacuagccguaaccuacggaaucaaacuaagcccgucugauuucuccagccaaaaacagcugucacuaaaacucaaguuguggaacgagcaggacggaaucugccucuacagcggcaagacgauagaccccaacgacauuauaaacaacccccagcuauucgaaaucgaccacaucaucccucggagcaucuccuucgacgacgcgagauccaacaaagugcugguauaccgaagcgagaaccaaaagaaagggaaccaaacaccauacuacuaccuaacccacucgcacagcgaguggagcuucgagcaguacaaagcaaccgucaugaaccuauccaagaagaaagaauaugccauaucgcgcaagaaaauccaaaaccugcuauacucagaagauaucacgaaaauggacguguuaaaaggcuucauaaaccggaacauaaacgacacgagcuaugcaagccggcuaguccuaaacaccauacaaaacuucuucauggccaacgaagcagacacaaaagucaagguaauaaaaggcuccuacacucaccaaaugcggugcaaccuaaaacucgacaaaaaccgggacgaaagcuauagccaccacgccguagacgcgaugcucaucggcuacucggagcuaggcuacgaagcauaucauaaacugcaaggggaguucaucgacuucgaaaccggcgaaauccuaagaaaagacaugugggaugaaaacaugucagacgaagucuacgccgacuaucucuacggaaagaaaugggccaacauacgaaacgaggucgugaaagccgagaagaacgucaaauacuggcacuacguaaugcgaaaaagcaaucgagggcuaugcaaucaaaccauaaggggaacgcgcgaguacgacggaaaacaauacaagaucaacaaacuagacauacgaaccaaagaaggaaucaaaguuuucgcuaaacucgcguucuccaaaaaggacucggaccgggaacgccuccuuguauaccucaacgaccgccgaaccuucgacgaccuaugcaaaaucuaugaagacuauagugacgcggcaaacccauucguccaauacgaaaaagagacaggcgacauaauccgcaaguacagcaaaaagcacaaugggcccaggauagacaagcugaaguacaaagacggcgaagucggcgccugcauagacaucucacacaaauauggcuucgagaaaggaucgaagaaggugauccuugaaucccuuguaccguaccguauggauguguacuacaaagaggaaaaccacagcuacuaccuggucggagucaaacagagcgacauaaaauucgaaaagggacgcaacgucaucgacgaagaagcguacgcacgcauacuggucaacgagaaaaugauccaaccaggucaaagccgcgcagaccucgaaaaccucggauucaaauucaagcucagcuucuacaaaaaugacauaauagaguacgaaaaagacgggaaaauauacaccgaacggcuaguaagucgcacgaugcccaaacaaagaaacuacaucgagaccaaaccgaucgacaaagcgaaauucgaaaaacaaaaccucguaggccucggaaagaccaaauucaucaagaaauacagguacgacauacugggcaacaaauacuccuguuccgaggaaaaauucacguccuucuguuga

SEQ ID NO: 6249 - RNA, 3348 nt, Artificial Sequence
  Cas9 variant
augucggcaacguauacaaucgggcuggacaucggaaucgccucagugggauggugcgcauucggagaaacacacauacucgaccucggagugcgagcauucgacaaggccgaaacagcaaaagagggagaauccuuaaaccucgccaggaggaacgcacgccuaaugcggaggcgccucuuccgacgaacauggcgacucaaaaagcuggcaaggcaacuuaagucagaaggccuaauagcagacacaaaacuuuuuaaaccugagcuaccuuucagcaaaagccuuuggcagcucagaguagacggauuagacagacgccuaaacgacgaagagugggcacgcgucaucuaccaccuuugcaaacaccgcggguuccacuggauaucacgcgcggaagccaaacaagcagaaggggauagcaaaagcgaaggaggaaaggugaaacaaggcuuagccgggacagcgaaauuaauggacgagaaaggguaucgaagugccgcagaaaugguucuagcagaguucccgcaagcacaacggaacaagcaaggagaauaccaaaaggcccugagccgagaacugcuugcaaaggagcucgcacugcuauucgcacagcaacgagaguacgggaaccugcacacgcccggggcacuagaaacagccauccugggcaacggagacaagaaaucgggucucuucuggcagcaaaaaccagcauuagccgggacagaccuacugaagaugcucgggacaugcacauucgaaaaaggcgaauacagagcccccaaagcgaguuucacggccgagagacauguguggcuaacacgacuaaacaaccuacgcauaguuacagauggcgugacccgacagcucacggaacaagaacgccaacuaugcuuaccacucccauaucgacaagccggagaccugacauacaaacagcuaggcuccgcccuggcaaaggcaggacuacucgaagcaggcggauucaaauucaccggauuagcauacccgacggaggcacaaaaagcagaagguaaggcgaaggaccccgaaagcgcaacgcuagucaaaaucccagcauggcacgaacugaggcaaacacuaacaaaagggggacuaaacgacgaaugggaaaagcuggcaggcgacgcgcuuugcgggcagcccgagauauucgacaagaucgcauggguauugagcguauacaaagacgacgacgagguaagggccgaacuggcgaaacuagcgcuacccaacccacaagcccucacagaagcgcugcuaaacaucagguucgauaaauuccacagcuugucgcucaaagcgcuccgagcaauagucccacacauggaacaaggccucagauaugaugaggccugcguacaggcaggauaccaucacagccaacuccugaagguaggagaaggagaacacaaauaccuacccccacucuacgacgggcgggacggcgacggcaggaugauauucgccgaagacgccgacauaccgagaaacccagucguacuccgaucucuaaaccaggcaaggaaggucguaaacgcaauaauacgcagauacggaagccccuccgcaguccacaucgagauggcacgagaccuaucgcgcccauucgaugagagaaacaaaauaaagaaagaccaagacgaauaccaagcaagaaaccagagagauagggaacaguuuagugaacuguuuggacacccgccgaaaggguuagaguucgaaaaauggagacucuacagagaacaaaacggucaaugcgccuacucccaacggccccuuacugcgagcggcaauguagcagaaaucuuccuagacggcagcacagaaaucgaccacgcacuccccuacucaagaucguucgacgacagcaagaacaacaagguccucgugcuaacacgagaaaacagagacaaggggaaccgcacacccuacgaauacuuaggaggcgccgagaacagcgaguccuggcagcgauucgugucauucguagagagcaacaaagcguaccggcucgccaagaggacgcgacuccuaaggaaggacuucggagccaaggagagcgaagaguucagagaacgaaaccuaaaugauaccagguacguaugcagguucuuuaaaaauuacguagaacaacaccugaaacucgccgaaggaucggaaacaaaaaggugcguagucgucagcggacaauugaccaacuuccugagagcccgcugggggcuacuaaaaguccgaagugacucggauagacaccacgcccucgacgcggcgguuguggcggccugcucgcacucaaugguccaaaggcucucaaacuacagccgaaccagggaacuagaacagguaagagacggauucguggacauagaaacaggcgaaaucgucaacccagcaaugcaccaacaacuacgagaacauuucccggacccauggccguauuuccggcacgaacucgaagcacgacucaagaucgacagucccgaacuccucagagaagaaauggccagacuaggaagcuacucagaagaggaacuaaaaguacuaaaaccgcucuuugugucccgagcaccccagaggcguaacgggggugcggcccauaaagacacuauuuacggccaaccugagaaguuaaagaaaaauggaagcgucacccagaaagucgcccugacaucacucacccucaaagacauagaucuccucgccgacccccaucggaacgcaaaacuauacggcgccauaagagagcgccuagaagcacacgguggaaaaggagacaaagcauucccggcaacuaauccgcuaagaaaaccagacaaagaaggaaacccaaccggccccaucguaagaaccgucacaaaagucauugacaaacugucaggaauacccguacgcgggggcauagcaaagaaugacaccaugcugcggguagacgucuuuacaaagggaggaaaauuccaucuggugccgguguacguacaccaccgagucaccgggcuacccaacagggcgauaauagcauucaaggacgaagaugaauggacgcuuaucgacgacucauucgacuggugcuucagccucuaccccaacgaccuacuaaggauuaagcucaagaaagaaagccacagcggauacuacucaagcugcaaccgcagcacaggggcaguaaaccuaugggcgcacgacagaaacguuaacgucgggaaagacggcuucauagaaagcaucggaguaaaaauggcagucagcaucgagaaacugcacguagacacacuaggcaacauauacccagcacccccagagaaaagacgggggcuagccuga

SEQ ID NO: 6250 - RNA, 3351 nt, Artificial Sequence
  Cas9 variant
augucucaaaaccaaaaccccaacacgcaaucacaccugaacccaacaacccaaucgagcacccaaucaaacccgcaaccaaccacgcaagaaagccugaaaauauuaggguucgacaucggggucgccagcauaggcugggccuucgucgaaggaggggaacucaaggacugcggcgucaggaucuucacaaaggccgagaacccgaaagacggcagcagccuagcacuaccgaggagagaagccaggggaguacgcaggagacuggcaagacggaaaggacgacucaacgcacucaagguauuaaucugcaaggaguucggccucaacagaagcgacuaccuggccacagccggcgaauuacccaaagcguacgccacguccaaagaaacgaaaucgcccuaccaacuaagggccgaaucacuagaacgaaagcucagugccgacgaguucgcccgaguuauccuacacaucgcgaaacacaggggauacggcaacaaacacgccaaagaaagcuccgacgacgacagcggcaaggucaagaaagcgauuucagaaaaccaaaaaguaaugagcgaaaaaggguacaccacggcgggacaauaccucuacggggaguucuaccagaaagcacgaaacuucuccgaagcagaacccaaaucaccgaaaaacgcgcgcgggacccaggaguucaaaaacgucaggaacaagagcgaaaacuacgcaaggugccuggcacagucggaacuacaaaaagaacuagaaaucaucuuugcaaagcaacgggaguucggcuuccaauuuucggauaagaaacacaaaacgauuaaugccaacggaaagcucaaagaacuagacuucgcggacgcaguccuagaaauagccuuccuacaaaggccacucaaauccuucgcagacaaggucgggaagugcacauucuacgaggacaagccacgcgcgccgaaagacucucucagcgcuauagaguucgucgcccuaacacgaauaauuaacacacucgccaacauaacgaaacgcuccggagaggucuacagcgcggacaaaguaagagaaauacuaucgauaguacuugacaagggggaaaucaccuacaaaaaccucagaaaaguaaucgcccucgacgaaagacuccaauucccuaaagacagcaaacucgacuacgcgaaagaagacgccgaaaaagccaaggcgauagaauuuagcaaacucaaagcguuccgaaaggccuuaggcggguccuucgaaggauucauucgcgcagaacuggacucaaucgccaccgacaucgcguugaucaagucaaaagacgaacugaaggccaaacuagccaacuaccaaagccugaacgacgagcaacgcgagaaacuaagcgaacuuucguucgacaaauuuaucgaccucucauucaaggcacuggaagccauacuaccccucaugcgaggcgacaaggacgauaaaauauaccgauacgacgaagcguggcgugaggccggauuggucgaaguagcaaagaagacacagaaaggggauagccuacccccacucaucgaguacgaaaaggacuuagccaacccggucgucgccagagcccuagcagaauaucguaaagucuuaaacgcccuccucaagaaacacgggaaaguucacaaaauacacuuagaguucaccagacaagccggcguaagcucaaaagagagaggcgaaauaaucgccgagcagaacaaaaggcugaaagccaacgaagaagccaggaaacgaugcgaagaauacggguuaaucccgagcggaaagaacauccuaaaacucaaacuauggcaagaacagggcgaguucugcguguacagcggcaagaaaauaacacaaagcgaccuuagggacgaauccacucuccaaaucgaccauaucuacccauacucccgguccuaugacgacucccaaaacaacaaaguacugguauucaccgacgccaaucagaacaaacuaaaucaaacacccuacgaagccuucgggaaagacauuucgaaauggaaccaaauccuaggaagaaucgagaaacuaccgaaggcaaagaagaaccgaauaaccaacaaaaacuucgcaaacaaagaagcggguuucauagcgaggaacauaguagauaccagcuacaucgcccgccuaucggcaagcuacacagacgcauucauagaguucuguccccuagcggaaaacgaagacacaacccuaggcagaggagaaaaaggaagcaagaaacacaucucagucgugaacggcucacucaccgccaccaugaggcauuacuggggguugaacacacugcucgacggcgagaacagcgaaagcaaggacagaagcaaccaccuccaccaugcccuagacgcgaucauuauagcauaugugaacgacagcgugauaaaagccuucagcgacuucaagaaaacgcaagagcaaaacaaggcccgacuaauagcaaaagagauagaaagugccgaauacaaaauaucccggcgauucuucagcccauccggcuucgaaaacaacgaagcguuccggcaagccaucaaacggaaaauauuagggcaaagccuagaaaguagagaaaacgacaugacaauaaacagcgaggcccucggcgaaaaagucgggggaauuuucguaaguaaaccgccccgcaaacgcgcccgcggggcacuacacaaagaaacuuucucaucaauagacgacaaagaccugcucaaaacguacggagggaaagagggaguuaacagagcaaucaaacucgguaaaguacgacaaauaggaagcaaaauugcggacaacggaacaaugguucgcgucgacauauucagacacaaaguaucgggaaaauucuacggaguccccaucuacacgauggauuucgcacugggcauacuuccaaacaaagcgguggucgggggaaaggacaaaagcggcgugaucaaggacuggcuaccaauggacucgaacuacgaguucugcuucucacuuuucaaagacgaccuaauccuaguccagaagaaagaaauguccaaagcagaacucuguuacuucgccggguucgauacuucgggcggacagauuaaagucgaaaagcacgacaaccacuucgcaacacuaaccgauaaccaacgauuacucuucaacauugccacucccaaggaaguagcaggcaaaucaauaggaauccaaaaccucaaaguauuugaaaaauggcaaguaagcccacuaggagaagucuccaaagcggaguucaaagaacgagaaccgaucgcacuaaaaucaacgccaaaacgcuuccuccaaggcuga

SEQ ID NO: 6251 - RNA, 3354 nt, Artificial Sequence
  Cas9 variant
augaaacacauccugggccuagauuuaggcucuaacagcauuggcugggcauucguacaacaagacuucgagaacaaacaaggcaaaauuauagcaaccggcucaagaaucauucccauggaccaaggaauacucggagacuucgaacgaggcaacacagucucccaaacggccgaaagaacaacauaccgcuccaugagaagacuacgggagcgccacuugcucagacgagaaagacuccaccguguccuccaucugcuaggauuucuaccaccccacuacgacgcucaaaucgacuuuaccaaacgauacggcaaauuuaucgauaaugccgaaccaaaaaucgccuacaacaacggcaacuucaucuucaugaacuccuucaacgagauggucgaagacuucaagaaacaccagccacaacuauucuacaaaaaguccaacggugaagagagcagaaucccguacgacuggacaauauauuacuugcgcaaaaaggcgcucucgcagaaaauaacacagcaggaacuggccuggcucauacuccacuucaaucaaaagagaggcuacuaccaacuccggggcgaagaggaaaccgaaaaccccaacaaggaaguagccuuucacagccugaaagucguagaugucgaagcagaagcccccaacaagaagggggagauuugguacaccauacgccuagaaaacggauggaucuaccgccgcacgagcaagaacccccucgacgacuggaaaggcaaaacccgagauuucaucgucacaaccgacuuaaacgacgauggaacuaucaaacucgacaaggagggcaaagagaagaggagcuuucgcgccccagacgaaaacgacuggaaccuacucaaaaagaaaaccgaacacgacauagacuucuccggcaaacccguggggacauacauauacgaccaccuacuacaaaaccccaaccagaaaauuaaagggaagcucguccggaccauagaaaggaaauacuacaaagacgaacuaaaagcaauccucgcgaagcaaaucgcucuacaaccugagcucuuuacagaaacucuccuggccgauugcauucgcgagcucuaucgaaagaacgaaacccaacaacaaaaccuacucucgaaagacuuccuacaccuauucguagaagacaucauauuuuaccaaagaccccucugcagcaagaaauccacuaucgcgaacugcacccuggagaaaaggagcuacauagacaaagaaaccaacgaaagaaaagaugcccccaucaaaguaugcgccaaaucgaacccuuacuaccaggaguuccgcguccuccaguggcuacaaaaccugcgaaucuacgaaauagaaaccgacagagaagucaccgcagaguucaucgaaaccccacaagacuacgaggcacuauucaacuucuuaaugagccaaaaggaaaucgacaacgaggggcuucucaaguacuuccuguucgcuaaaaacccacaaauuaaagacaaagcggcgaagucagaacucaagaaauggcucacaacguaucgguggaacuacguguacgacgccgccgauaacagcucgaagaaauacccgaugaacgaaacgggguacgaacuacaaagauaccuacaaaaagucgagggacuaccagcuaacuucuuaacguuugacaucaccuaccaacucuggcaccuacuguacuccguaaaagacaaaguagaguucgaaaaagcacuaaagaaauucgccaaaaagaaacaacucgacaaaacuuccuucgucgacagcuuuaaaaacuucaaacccuauccuaacgaauacggaucguucagcgaaaaagccauaaagaaacuacucccacucaugcgauucggaaaccacugggauuucaaccguauagaugucagcacacaaaaacgaaucgacgaucucaucaacggcgucgccaacgaagacaucaggaccauaauacgcgaaaaagccgagaaauaccaacucaacucugaaaccugcuuccaagaccuaccccuauggcuagcccaauauguagucuacaaccgccacgccgaggcaacggauauagaaaaauggacaucuguuucagaccucgaggcguaucuagaagauuucaaacaacacucccuacgcaacccgauagucgagcaaguggucacagagacacuccggguuguacgggacauauggcaacaguacagcggaggacaagcaaacuucuucgacgaaauacacaucgaacucggccgcgagcuaaagaagacggccgaagaacgaaaacaacugagcgacaaaaaccaggaaaacgagaacacaaaccucagaaucaagaaacuacucgcagaacucaaagaagacgccuccauccagaacguacgacccuacucacucguccagcaagagcuacucaaaaucuacgaagagggcgucuucuccuccacagacgagaucgaagaggacauucagaaaauccggaagaaagucgaaccaaccccacccgaaauccaaagauacaaacuguggcucgaacaaaaguacaaaucgcccuauaccggcgaagugauaucgcucacaaaacucuuuaccgaggaauacgaaauugaacacaucaucccccaaucccgcuacuaugacgacagccuaagcaacaagguaaucugcgaaagcgcagugaacaaacucaaaaccaaccagcucgguuuagaguucauacaaaaucaccacggcgaaaaaguccggaucaccgcgaacaaagaaguaacuauauucaccgaagaacaauacaaagaguucgucaaaaagcauuacgccaacaacuccgccaaacaacagaaauugcuacucaacgaaauacccgagaaaaugguggcgcgacagcuaaacgacaccagguauaucuccaaaugcaucuccgaaauccucuccaaaauaguucgcucagacgaaaaagacgaaggagucaacuccaaaaacauuaucccaugcacggggaagaucacgacggcacucaagcaggacuggggacucaaugacgucuggaacgaacucauacucccacgcuucgaacgcaugaaccaacuaacgcagacccaacuauucacauccuacaacgaccgccuccaaaagaaccucccaacugucccuauugaguacucacagggcuuccaaaagaaacguaucgaccaccgccaucacgccauggacgcccuaguaaucgcaugcgcaacaagagaacacaucaacuacaugaacaaccaacacgcccucgacaaaucgaaagacaagaaagaaaaacaacaaagccgcaucgaccuccacccccuauga

SEQ ID NO: 6252 - RNA, 3354 nt, Artificial Sequence
  Cas9 variant
augcagaccaaaaaccuacucuacacacucggauuagacauaggaauagcgagcgucgguuggugcgucuuaggggaaaauagaaucaucgaccucgguguccgcugcuucgacaaagccgaaacacccgacagaggagagagccucaacaaagugaggcgagacgcacgacucaugcggcgccgccuccgccgacgagcauggagacugacaaaacuggcacgauuacucaagcacgcggggcuaauagacagcacacgcauaguaagagacagacacgacggagcagucagccccuggcaacugcgaguagaaggccuggacaggaaacuagccccggaagagugggcccgcgucaucuaccacaucguuaaacacagaggauuccacuggauaucacgugcagaagaaagaaaagcagaaagcgacaaaggagagggaggaaaagucaagcaaggcuuaagcgcaaccaagcagcugauggucgaaaagaacuaccgcagcgcagcagaaauggugcucacagaguuccccggcgcgcagcgaaauaaacgaggagaauacacaaaagcacucucucgaauccugcucgcugcagaacugaccacacuguucgaacgccagcaggaacugggaaacccccacgcagggcccgaucuucaaacaaaaauucugggcaauggugaccgcaaaagcgggcuucuguggaugcaaaaaccaccccucuccggcagcgcucuguugaaaaugcuagggaagugcacuuucgaacgggaagaguacagggcccccaaagcaucguucaccgcggaacgccacguauggcuaacaaaacugaacaaccuaagagugcuggucgacggcgucacuaggccccucagcgacccagaaagacgacuggcccucagccucccguaccagcaagcauccgacuucacauacaaacaacugcgggccgcacucuguaaaaacggacuauuaccagacuccuuccaauucucuggccuagccuacccgaccggcgcccagcagccagacggcaaagccaaaaaccccgaaaacgacaggcuaguaaagcucccagcauggcaagaguuccggaaaacccuaagagacgcaggccuagaaacagaaugggaaucaauagcgggaauggccgccgggggccaaccagacuugcucgaucaaauaggcuggguucuuucaguauucaaggauggcgacgaagugcucagagaacuacgcaaaaucccacuucccggcggagagaaaaugguacaagcccuauccggagucagcuucgauacauuccacaaccucucacuaaaagcccuuagaaaaaucguaccucacauggaagcaggacuacgcuacgacgaagcaugccuggccgcuggauaccaccacucagaccuccgaaaagacacugacgaacgaagucuauaccucccuccccucuacagcgggagaacaaccgauggcagaaugguauuccgcgacgacaucgacguaccccgaaacccaguaguacuacgcgcaaucaaccaagcccgaacaguaguaaacagcguaguccgucgguacggaagcccaagcuccaugcacaucgaaauggcccgcgaccuuucgagaccaugggacgagcgaaacaaggucaaacgcgcacaggaggaauacagagacagaaacgagaaacucaagauagacuucgcggcggaguaugguauagaacccaaaucgagagaauuugagaaauuccuacuauaucgcgaacaaggcggaaagugcgcguacucccuaaaaccccuggaucuagaccguguccuaagggaccuaggcuacgcagaagucgaccacgcguuaccauacucaagauccuuugaugacagcaagaacaacaagguacucguacuagcggaagaaaaucgaaacaaagggaaccgcacacccuacgaauaccuggacggcacaagcgagagccccagauggcgcgaguucaaagcguucguagagaccaacaaagcauaucgacuugccaaacgagcuaggcuccuaagaaaagacuuuagcggcaaaggaagcgaagaauuucgagaccgaaaccugaacgacacccgcuauaucucgcgcuucuucaagaacuacgucgagcguuuccugaaauuagccgaagagagcgaggaacggaccugcguaguauuaagcggccagcugacggcguucuuacgggcgcgguggggccuggcaaaaguccgcggagacuccgaccgccaccaugcccucgaugcugcagucauagcagccugcucacgcaguauggucaaacggcuaagcgacuaugcccgaaggcacgaacuagaaaaaguacgcacaggcuuuguggauuucgaaaccggcgaaauagucgacgcaggcaaguaccgccaaaucgaacgcgacuucccaagccccuggcccuacuuccgcgacgaacuacucacccgacuuaacaccgacgacccagccgaacuaagagagcgcaugcaaucacuaggaagcuacccgcccgaagcacuagagacgcuaagacccauguucgugagcagagccccacaacggcggaacggcggagccgcccacaaggacaccaucuaccggcaaacggaacgucucaagaaaguaggguccguuacgcaaaaaguaccgcucgcagcacugaacuuacgagaccucgaaaaccuagucgauccccaucgaaacgagaaacuauaugcggcaauacgagcaagacuagaggcgcacgguggaaaaggagagaaagccuuucccccaaauaauccccuccgcaaacccgacagggacgggaauccaacagguccaauagugcgcaccgucacgcuagugauagacaaaaugaguggcauccccguacguggaggagucgcuaaaaacgacacaaugcuaagaguagacaucuucagauccaagaaagacggcaaauuccaccucgucccgcuguacgugcaccacgcaguugcgaaacaacuaccaacgcgcgcgguaauagcguacaaggacgaaggcgaauggaccccgaucaacaaccacgacuucgacuuccuauucgcccuauacccaaacgaccucgugcgcauaacacuaaagaaagaacgacacuucggauacuacgcgggaugcaaccgggccaccggcgcaguaagcaucugggcccacgaccggaaccaacgaaucggcaaagauggauucauagacggaauaggagugaagacggcacuaucagucgaaaaauuccacguagacacacugggcaacgucuaccccgcaccgcccgaaacgcgccgaggucucgcguga

SEQ ID NO: 6253 - RNA, 3357 nt, Artificial Sequence
  Cas9 variant
augggaacaagauacagcuucgacauaggcacaaacuccauaggaugggcaguguggcgaacaggcagagaccccaaaggaaucuucggcgagaaagacgcaccacucgaguuauuaggcgcgggagucagacucuucaaagacggucgcaaccccaaagacggacaaagccuagccacaaugagacgaauaccaagacaagcgcgcaaaaggagagacagauucguccuacggcgcgaagcguugguagccgcccucauagaagcgggccucaugccugcgucagagaaggagaggaaggcccuagcggaucucgaucccuaucagcuccgggcagcgggacucgauaaggcccuagccccgcacgagcuaggccgcgcaauauuccaccuacaccaacgacgcggauucaaaagcaacagaaaaacugaccgaaaaagcgacgaccgggacaagggcaagauagcaacagccagugcagcacuagcgaaaaaguucgaagacgaaaacgcacggacguucggagaguuccuauggcggaggcacagagauccggacaugaaaagacaagcgguccuaaaggcccaugacccagcgaagggcaaaccagaccuccgggcagcgaaguugcgccagccaacacguauacgccucgaaggacagggggcaacagcguuguacgaguucuaccccacaagagaaaugcucugccacgaguucgaugcacucugggaagcacaggccagacaccaucccauguuacuaacaagagaagcaggcgacaaaauaaggagcauccuauuccgacaacgagaacuaaaacccccacuaauagggcucugcacauucgaauacgccgcaggagaaaaagagagccgccuaccaaaagcucugccaaguguccaagcacgcgagauuuacgaacgacucggccacauacgccuaagcacgggaucaggcacagacaggccacuuaaauccagugagcgcgaugaccuugcaacagcacugcuacacugcgggcugacaaaaauaaaaguuagcaaaaccaagggacucgcauucaaaacagaguucagaaaagcccucagacuagggggcgaagugcgcaucaacuucgaagaaaugggagaagaaggcuuagucgaccuccggacgaacagacugcucguucaagacgaucacuacggaccucgauggcgugcccucagcugguccggaaaagacgccuucgugaagaaauugcuagaagcgacagacgacgacaagcuaguagcaaggcuaaugacagaagacggauugucugccgugcaggcaagaaacgcagccagcauaccacugccggauggcuacucaagacucggaccuaccgcaaacgcagcgauacuacaagcccuaaucgacuccagagacgaaaacggguucgugguuaccuacgacaaggcaguaaggcgagcaggagaaagacucggaaaggacuggcaccacagcgaugaaagagauggagagaucuuagacgcccuccccuacuacggaaaaguacugcaaagacauauucuuccaggcaugauggaccccgcagacagaaaggacgaagcaaaauucuacggccgcauaaugaacccgagcguacauaucggacugaaccaacuacgcagacuggugaaugcccuaaucgaacgguucggaccuccagaccaaaucguggucgagcuagcccgagaucucaagaugagcgcacgcgaaaaagagcaagagcaaagaaggaaccgggacaaucgagaggcuaaugagaaaagaacgaaaaagcucguagaacuaggccaggacaacaacggugaaaaccgggcacgacuaaaacucuacgacgagcaacaaagggcaggaaaugggguagcgcacugccccuucacccuggacccaaucggaaucacgcaauuguucagcccagaaauagaaauagaacacguccuaccgcgcagcaggacgcucgacgacucggcagcaaacaaaguacucugcuuuagaacaauaaacagaaucaaaagaggcaaaacaccaugggaagccuuccacgcggacccaaaauggccagacauagcagcaaaugcagaaaagcucccgccgaacaagagguggcgauuccgggaggacgcgauggacguauuugaagcgagaacaucgggaaaaauggacaaaacaaccuuagaacaaaugggacucacaaccggauuucaggcucgacaccucaaugagacaaaacacaugagcagguuagcaaaagccuaccuaggcaaaaucugcgacccugacgcgguguaugugaccccaggagcccuaacgagccuacuaagaggcaaauggggacuaaacaguauauugucagacgacaaccugaaggacagaacggaucauagacaccacgcaauagacgcgauaaccauaggagcgaugacgcggagucuacuacuggaacucaacacguuagcagggaaagcagaacaguccgacuaugacgacguagugggaaagguccccuggccguuugauaacuuccgagaugcaguaagaucgguagucgaucgagucgugguuagcaacaaaccagagcacggcaaacagggagcacugcacgaggacacagccuauggaauagucggcgacgaagccgaagcagaagaaaucggaaaccucgucagaagaaaacugcuaguggaccucaccccaggagagguagaccgcauaagagacgcaggacucagaaaagcaaugcaagcagccguagcgccaaguagagacgcaagaggaaagguuagcgacgcaaaagguuuugcagccgcccucgacacauucgccaaggcacaaggaaugcggagaauccgagugggaaaagaagacaugucagcaguaacgauacacgaccgacaaaccgauaaagcguauaaggcaguagcgcccggagaaaaccaccacguggacgucguacaaaugcgagacggugccuggaaaggauucgcagucacagucuucgaagccaaucaaaaggauuucaggccccaaugggaaagagaaaaacucggagguaaacuggucaugagacuccauaaaggggacgcgguagagcuagaaucgagcggggugcgccuggucaaauucguucaacagauauggaugaaaagcaaccuaguucuacucaccgagcacaaugaaggaggagaccuacaaaagcggcaucaagacgcggacgauccguuccggugggacuucgccaacauaggcaaacucaaagaacggggcuguguggcggucaaaguggacgaacucggcagagugacaaaaagaauaucaaacaccuga

SEQ ID NO: 6254 - RNA, 3360 nt, Artificial Sequence
  Cas9 variant
augggcuaccgcauagggcucgacgucggaauaacauccacaggcuacgccguacuaaaaaccgacaaaaacggccucccguacaaaauccucacccuagauuccgucaucuauccaagagcugaaaacccucaaacaggcgcgucacuagccgagccucggcgaauuaaacgcggccuucgcagacgaacucgccgcacgaaauucagaaagcaacgcacccaacaacucuuuauccacagugggcuacucucaaaacccgagauagagcaaauucuugcaacaccacaagcaaaauacagcguauacgaacuacgaguggcgggccuagacagacggcugaccaacucagaacucuuccgcguccuguacuucuucauaggacauagaggauucaaguccaacagaaaggccgaacuaaacccagaaaacgaagcagacaagaaacagaugggccagcugcucaacaguaucgaggaaauccggaaggcaaucgcagaaaaaggcuauagaacaguaggggagcuauaccucaaggaccccaaguacaacgaccacaagcgcaacaaaggcuacaucgacggcuacuuaucaaccccaaaccgacagaugcuaguggaugaaaucaaacagauccuggacaaacaacgcgagcuaggcaacgagaaacuaacagacgaguucuaugcaacuuacuuacuaggagacgaaaacagagcaggcaucuuccaggcccagcgggacuucgacgaaggaccgggagcgggaccguacgccggugaccaaaucaaaaagaugguaggaaaggauaucuucgagccaacggaagaccgcgccgccaaagcaaccuacacauuccaauauuucaaccuccuacaaaagaugaccucccugaacuaccaaaauacaaccggcgauacguggcacacgcucaacggccuagaccgccaggcuaucaucgacgcuguauuugccaaagcagaaaaaccaacaaaaacguacaaaccaaccgacuuuggggagcuccgcaaacugcuaaaacuuccagacgaugcccgauuuaaccucguaaacuauggcucccuccaaacccaaaaggaaaucgaaacaguagaaaagaaaacaagauucgucgacuucaaagcguaccaugaucuggucaaaguauuacccgaggaaauguggcagagccgacagcuacucgaccacaucgguacugcacucaccuuauauucaucagacaaacgccgccgccgguacuucgccgaggaacugaaccuccccgccgaacucauagagaagcuccucccccugaacuucagcaaauucggccaccuuuccaucaaguccaugcaaaacauaauccccuaccucgaaauggggcaaguuuacucagaagccacuaccaacacaggcuacgacuuccgaaagaaacaaaucagcaaggacaccaucagggaagagauaaccaaccccgucguacgcagagcagucacaaaaaccaucaagauagucgagcaaauaauacgccgauacggcaaaccagacggcaucaauauagaauuggcucgcgaacucggacgaaacuucaaagaacguggcgacauacaaaaacgacaagacaaaaaccggcaaaccaaugacaaaaucgccgcggagcugaccgaacuuggaaucccggugaacggccaaaacauaauacgcuacaaacuucauaaagagcaaaauggggucgaccccuacacgggggaccaaauaccauucgaacgggcauucagcgaagguuacgaaguagaccacaucauccccuacucuaucagcugggacgacucguacacaaauaaaguacugacaagcgcaaaaugcaauagggaaaagggcaacagaauacccaugguauaccucgcgaacaacgagcaacgacuaaacgcgcucacaaacauagcggacaauauaaucagaaacucaagaaaaagacagaaacuucugaagcaaaaacucucggacgaagaguuaaaagacuggaagcaaagaaacaucaacgacacccgauuuaucacccgcguccucuacaacuacuuucgccaggccaucgaauuuaacccggaacuagaaaagaaacagcgcguccucccacuaaacggagagguaaccucaaaaauucgcucccgguggggguuccuaaaaguaagggaggacggcgaccugcaucacgcaaucgacgcuacugucauugccgcaauaacucccaaguucauccaacagguaaccaaauacagccagcaccaagaaguaaagaacaaccaagcgcuauggcacgaugccgagaucaaggacgccgaguacgcagccgaagcccagagaauggacgcagaccucuucaacaaaauauucaacggcuucccacucccauggccggaguuccucgacgaacuccuagcaagaauuagcgacaaucccgucgaaaugaugaaauccagauccuggaacaccuacacacccauagaaaucgcgaaacugaaaccgguguucgucguccgccuggcaaaccacaaaaucagcggcccggcccaccuugacacaauccgcuccgccaaacucuucgacgaaaaaggaaucguacucucucgggucagcaucaccaaacuuaagauaaacaagaaagggcaagucgccaccggggacggcauauacgaccccgaaaauucuaacaauggggacaagguaguauauagugcuauacgacaagcucucgaagcgcacaacggcuccggagaacuggccuucccggacggcuaccucgaguacgucgaucacggaaccaagaaauuaguacgaaaagugaggguugccaagaaagucagccuaccgguacgccucaagaacaaggccgcagcggauaauggcagcauggucaggauagacgucuucaacaccgggaagaaauucgucuucguuccgaucuacaucaaagacaccguagaacaagucuuaccuaacaaagcaaucgcccgcggcaaaagccucugguaccaaaucaccgaaucagaucaguucugcuucucccucuaucccggcgacaugguccacauagagucgaaaaccggcauuaaacccaaauacuccaacaaagaaaacaacacgagcgucgugccaaucaaaaacuucuacgguuacuucgacggcgccgacauagccaccgccaguauccuaguacgggcacacgacagcucauacaccgcccgcucaauagggauagcaggacuacugaaauucgaaaaauaccaaguagacuacuucggccgguaccacaaaguacacgaaaagaagcgacagcuauucgucaaacgggacgaauga

SEQ ID NO: 6255 - RNA, 3360 nt, Artificial Sequence
  Cas9 variant
augaacgacaagaaaaaccuagggccccugacauucgguuucgacauagggauugcauccgucggcugggcaguccuaagccccacaaggaucguggaccuaggcguacgcugcuucgacaaggcagaaacagcuaaggaaggggaaagccugaaucucgcacgccgaagugcucgcuuaaugcggcgacgccuucggcgcagggcguggcgacuaauaaaacucgcccgccuauuaaaacacgaaggacucaucgcggacacaaaaacauucauacaacccucagcaagccacgccucacccuggcaacuaaggaaagacggauuagaccgugcccucucccccgaggaaugggcgcgcguacuauaucaccuaugcaaacaucgcggauuccacuggguaucccgggcagaagcgcgcaaagcagauggugacacaaagggggaagggggaaaaguaaaacaaggacuggcauccaccaccaaacuuaugaacgacaaaaguuaccgaaccgcagccgaaaugguacuagcagaauuucccucagcccaaagaaacaagagaggcgaauacaccaaagcacuaucccgcgaauuacucgacaacgagcuuaagcaacucuucgaacgacagagagaauacggaaacccgcacgcggacacaaaccuagaggcaaaaauaagggguagcggagaccacaaaucaggauuauucugggaacaaaaaccggcacuaagugggaacgacuuacuaaaaaugcuaggaaaaugcaccuucgaaaaacaagaauaccgcgcaccgaaagcaucguucacagccgaacgccacguauggcuaacgcgacucaacaaucuccguaucauagucgacggaagaaccaggccgcuagcugacgccgaaagaaccauggcacucucccuacccuacgaacaagucggagacuuuaccuacaagcagcucagagcugcgcucguaaaggcagggcucaugcccgacuccuucaaauucgccagccucgccuacccaucagaguuccagaaagcagaaggcaaggcaaaagacccagagagcgcggcacucacaaaacucgccgcauggcaagagcuaagagccacacuaaagaaagccgaccuagaaucagaauggcaacaaauaucaugcgcagcacucgagggccaaccggagacacucgacgaaaucgcaggcguccucagcguauucaaagacgacgacgaaguccucaacgagcuacaaaaacuaggacuaccgggaggcgccaaaacggaaaacgcacuacuggacauaagauucgacaaauuccacgcgcuaucacucaaagcgcugcgcaaaauagucccguauauggagcgcggucuccguuacgaugaggcuugcgaacgcgcggaauaucaucauagccaacuacacaagguaggcgaaggcaaccggaaauaccuacccccacuauacaaaucuagagacaaagacggaagaauggucuuuaacgacgaacuaggagacauacccagaaacccggucguacucaggagccugaaccaggcaagaaaggugcuaaacgcacuaauagcgcgauacggcucgcccagcuccguacacaucgaaauggcacgcgaacuuucgaagcccuucgacgaacgaaugaaaguaggaaaagaacaggaggcuuaccgcgaacgaaacgaaaaggauaagcagaccuucgucgcggaauuuggcauuguaggcgccgcaaaagguggggaguucgaaaaauggaaacuauaccgggaacaacagggaaagugcgcauauaguauccagggcaucgaccuaaaccgccuguuagaacccggcuauguugaaaucgaccaugcccuacccuacagcagauccuucgacgacagcaaguccaacaagguacucguccuagcggcagaaaacagaaacaaaggcaaccgcacaccuuacgaauaccuggacggugaacacaacuccgaaagauggagacaauucgucggguucgucgagaguaauaaacucuaccgccaagccaagagaagccggcugcuaaggaaagacuucggaaaagaacaagccgacgaauuucgcgaacgaaaucugaaugacacccgauacgucugccgcuucuucaagaaccaaguagaacaauuccuaaaacuagcggagggaucggaaagcaaaagaugcguaguauuguccggacagcuaacagccuuccuaagagcaagauggggacuaauuaagguccgagacgagagcgaccgacaccacgcauuagaugcggucguaguggcagccugcacucacggaauggucaaacgcauguccgacuacgcccgcagaaaggagcucgaccaagucgccgaaggcuucguagaugucgagacaggggaaauaauaaacgccgccauguuccaacaacuccaugaacacuuccccgacccguggccacacuuccgagaugagguacaaaugcgccuaaaaaucgacgaccccgcccaacuccgaucggaccuacucagacuaggcaacuacgccgaagaagacgugcacgcaguccgaccccucuucgucucgcgcgcaccgcagagaagaaauaguggcgcagcccacaaagagaccaucuacggccaacccgaacgccuaaaagcacaaggagggguuacagagaagguugcacucacugcacuaacaaugaaagaucuggaccgccuaaucgacccacaucguaacgaaaagcuguacgccgcaauccgaaaacgccucgaagaguucggaggaaaagcagacaaggcauucgcagcaagcaacccgcugcacaagcccgacaaagaagggaacccaacaggucccaucguaagaacagucacccuagaaauagacaagcugucaggagugccuguacgcggcgggaucgcgaaaaacgacacaauguuacgcgucgauguauucaccaaagcaggaaaguuccaccucguacccguauacguccaccacaaagucacaggccuaccgaaucgcgcaaucguggcgagcaaagacgaagacgaauggacagcuauagacgacucuuucgaguuccucuucagccucuaccccaacgaccuggucacgaucacccaaaaaggaaaggcgcccguccgaggauacuacgccucaugccaccgaggaaccggggccuucagccuaugggcacacgaccgggccucguccguagguaaaggagggcaaauagaaggcauaggcauaaagacagcacuugccguccaaaaauacaacguagacgugcugggcacaacguaugccgcgccccuggaacagagacggggccuagccuga

SEQ ID NO: 6256 - RNA, 3363 nt, Artificial Sequence
  Cas9 variant
augaggaaagugacgaucggguucgacauuggcguaucaucugugggauggagcguaguagacaugaacaauggagcaaucgucgaaaccggaguccgacucuucuccgcgucgagcgccgagaacaacgucgaacgccgcaacaaccgacaaacacgccgccucaaccgaaggcgcaaaaaccgacuaaaggacguaaaauaccuucucgaaacgaaucacuucaccuucgaccaggaacaggguacgaaccccuacgaacuccgcguagccggcuugcaccgcaaacugacccgcuccgaacuagcgagagcccucuaccaccuggucaaacgacggggcaucuccuacgaccugaccgauaucgaagaagaggaaaucguaaccacgucggccuacaagacugccuugggcaaaaaccagagccaauuagcagaaaagaccccaggagaaauacaauucgcgcgacucgaaaacuacggaaaagugcggggcagcaucgaaaucaacgaacaggacauacuccucaacauauuucccaccagugcauaccugaacgaggccaagcgcauucuugccacccaacgcaaguucuaccccgaaauuaccgaggcguuuauagagaaauacugcacgauccuaacacgcaaacgagaauacuauguagggccugggacggaaaagaaccgcacagacuacggcaucuaccgaaccaacggagagacccuagacaaccucuucgagauauuaaucggcaaagacaaauucuacccgaacgaggaacgagccgcaggaaacagcuacacagcacagcuguucaacuuuguuaaugaccucaacaacuugaagauacaaacaauagaagaccaaaagcuaaccccaaaacaaaaggaagaaaucaucgaacaggugaaaacugcugaaaagaaggugagccuaauccagcucauauccaaaaucacuaaaaccccgaaggaccaaauaacaggcuaccgcacugacaaaaacggaaaaccagaccuucacucaauggccguauuccgaaaaguucgcaagcaguuccucacaauggagaucgacaucuuacauuggccugacgaacuccugaacgacuuaggccgauuacuaacucucaacacggagaaaggggagauccgaaaacagcuuaccaaggacuucaugaaacgcuaucccauacucaacgaacaacucgucgaccaaauaauagagaaccgccacaucuucgcgguguccggaaaccacaaguggcaccgguucucgcugcgcaccaugaacgaacuacuaccggaaaugcuagccacaaguaaggaacaaaugacacuccucuccgaacgcgguaugauaaagcaacacaaaagagacuaccugaaaaugaacgaacucgacgcccgccucaucagcgaagaaauauacaaccccgucgucgguaaaucgguccgcgaggcgauaaaacucuucaacgaacuaaugaagaaauaccaggaagugcgcuacgugguacucgaaaugccgcgggacgacaacgaagaaaaagcuaaaaaggaacugcaaaaauaucaaaaggaaaacgagaacgagaaagaaaucgcgcucagcgaguuccaacgaaagggcuucuuuagcgacgcacagcucgaacgcgcgcucauaaaagaccgaaaacucaagaccaaaauccgguuuuggcaccagcaagaaggcaaaugccucuauucagggcagauuaucacccccguugaacuucuaacuaacaguuucuccuucgacauagaccacaucaucccccaauccguaucuuucgacgacucacuaaacaauaaaguauuaugcacaaaagaaaugaacgaccaaaaaggcaagcaaacccccuacggauuccuccuaaacggcaacggucaaggcuucgaucgcuuuaaagcaauggugaaugccaacagauuaaugagcaagggcaagaagaaaaaccuauuguucauggaagaccuaaacaacauagaaacgcgaaaaagguucauagcucgcaaccucguagacacacgguacgcaagccgcguagugcucaacgaaauccaacaauaccuaagagcgaaaaacaaggacacccaaguggcagucguucgcggaaaauucacagcaacccuucguaagcacuggaacaucaacaaaucccgagaaacccaucaccaccacgcacucgaugcaagcauaauagcgaucacaccacuccucucaguauggaaaaagaaacagacacucaucccgaagacacucuccgaagaaaaacuggaguucgaauacgacgacaucgucgaagauaccaucuucgagaaagcccucuaccaacuuccgaaggagaacuucaaggaacaacucaacaauucacagccaaacauaaaauucagcuaucaggucgacaagaaaaugaaucguaaaguaagcgacgcuaccauuuacuccgugaaacaggcaaaacucuccagcgauaaacagucagaagaguacguacuggcgaaaaucaaagacaucuacuccguggaaggauacaaaaccuucgccaaaaucuaugaaaaagacaaaucaaaauuccucauggcccaaaacgaucccaaaaccuucgagaagcuagaggaaaucauacagagcuacccaagcacacgcgaaauaaucgugggagaaaaagugaaagucgucgacgucagccccuucgagcuauacagaaaagaauacggcuacaucaccaaauacgccaagaaaaacaacggcccuaucauacggcaacucaaauacuacgaccacaagaucggaaugcaccucgauaucaccaaccaaaagaacaauggcaagggcaagaagguaauccugcagcagcucaaauccuggcgcacagacguguacuauaaccacgaaaaacaagaauacgaaaucaugggacuaaaguacuccgaucuacgcuucaagaaagaccaauacggcauccccaaagaacgauaccaggaagucaaacaaauggagaaaaucgcaccccaaucggaauuuugcuucucccuguaccgaaacgaccgcaucaaaguacucaacaaggaaacagacgaagaagucgaacuccuauucggagcacgcaacuacacaucggcaggauacguggaccucaagccuauagaccgcguagaguucgggaagaaagaauggauccccguguaccaauacgcgaccagcgacgggaaaugcaagaagaaauucgccaaaaagggauacgaaauuuauaaggucaacacuacuauacucggcgaaagcuauuacaucaaaaaggaacgcaugcuccccaaaaacauccuggacuga

SEQ ID NO: 6257 - RNA, 3363 nt, Artificial Sequence
  Cas9 variant
augagugaucuaguacucggccuggacauagggaucggcucggucggagucgggauccuuaacaaggucacgggagaaauaauacacaaaaacucucgaauauucccagccgcgcaagccgagaacaaccucguuagacguacgaauagacagggccgucgccugacccgucgcaagaaacaccgacgagugagguuaaaccgacucuucgaggaaaucggccucaucacagacuucaccaaaauaagcauaaacuugaaccccuaccaacuccgcgucaaaggacucacagacgaauugagcaacgaagaacuauucaucgcacucaaaaacauggucaagcauaggggcauaagcuaccucgacgacgccuccgacgacggaaacagcagcgucggggacuacgcccaaauagugaaggaaaacucaaaacagcucgagacgaagacuccuggacaaauccaacuggaacgguaucaaaccuacggucaacuccgaggagauuuuacagucgaaaaggacggaaagaaacaccgacuaauaaacgucuuccccacuuccgcauaccggagcgaagcgcuacgaauccuucaaacucagcaagaauuuaacccccaaaucacagacgaguucaucaaccguuaucuggaaauacuaacgggcaaacgcaaguacuaccacggccccggaaacgaaaagagccgaaccgacuacggcagauaccgcacuuccggcgaaacccuugacaacauauucgggauccucauagguaaaugcaccuucuacccagacgaguucagagccgccaaagccuccuacaccgcgcaagaguucaaccuacuaaacgaccucaacaaccuaacuguccccacggaaacuaaaaagcuaucaaaagaacagaaaaaccaaaucaucaacuacgucaagaacgagaaagccaugggccccgccaaacuauucaaauauaucgcaaagcuacucucgugcgacgucgcagacaucaaaggauacagaauagacaaaagcggcaaggcagagauccacaccuucgaggcuuaccgcaagaugaagacccuggaaacccuugacaucgaacagauggaccgcgaaacucucgauaaacuagccuacguacucacccugaacacagaacgugaaggcauacaagaagcccuggaacacgaguucgcagacggaucguucucacaaaaacagguggacgagcuaguccaauucaggaaagcaaacagcucaaucuucggcaagggcuggcacaacuucucugucaagcuaaugauggaacucaucccagaacuguacgagaccuccgaggaacaaaugaccauccuuacacgacucggaaagcaaaagaccaccagcaguuccaacaagacaaaguacaucgacgaaaaacugcuaacggaggaaaucuacaaccccgugguggccaaaucgguaagacaagccaucaaaauagucaacgcagcaauuaaagaguacggcgacuucgacaacaucguaaucgagauggcucgugaaacuaaugaggacgacgaaaagaaagccauacagaaaauccaaaaagccaacaaagacgaaaaggacgccgcaauguuaaaagccgccaaccaauacaacggaaaagcagagcuuccccacagcguguuccacggccacaaacaacuagcuaccaaaauacggcuuuggcaccaacagggagaacgcugccuguauacuggcaaaaccauaucgauacacgaccugaucaauaacccaaaccaauucgagguggaccacauucucccccuuuccauaacauucgacgacagucucgcaaacaagguccucguauacgccacagcuaaccaagaaaaagggcaacggacaccauaccaagcccucgacuccauggacgacgccuggucguuccgagaacucaaagcauucguacgggaguccaagacacucagcaacaaaaagaaagaguacuugcuaaccgaggaagacauaucaaaauucgacgugcgcaaaaaguucauagagagaaaucucguagacacccgcuacgcaagccggguaguucucaacgcucuacaggaacacuucagagcccacaagaucgacacaaaagucagcguagugagaggacaauucaccucccaacuccgucggcauuggggcauagagaaaacccgagacaccuaccaccaccacgcagucgacgcacuuaucauugccgcuagcagccaacuaaaccucuggaagaaacagaaaaacacccuggucuccuacuccgaggaucaacugcucgacaucgaaaccggagagcugaucagcgacgacgaauacaaagaaucagucuucaaagcccccuaccaacacuucgucgacacccucaaaucaaaagaguucgaagacuccauucuauucagcuaccaaguagacucgaaauucaaccgcaaaauaucugacgccacgauauacgcaacacgacaagcaaaggucggcaaagacaaagccgacgagaccuacguacuaggaaagaucaaggacaucuauacacaggacgguuacgacgcauucaugaaaaucuacaaaaaggacaagagcaaguucuuaauguaccgacacgacccacagacguucgaaaaggucauagaaccuauccucgaaaauuaccccaacaaacagaugaacgaaaaaggcaaagaaguacccugcaacccauuccucaaauacaaagaagaacacggauacauacgcaaauacucaaagaaagggaacggaccagaaaucaaaucccucaaauacuaugacuccaaacuaggaaaccacauagacaucacacccaaggacucgaacaacaaagucguccuacaaagccucaaaccauggcgaacugacguauacuucaacaagaacaccggcaaauacgagauacucggccucaaauacagcgacaugcaauucgagaagggaaccgggaaguacagcaucagcaaagagcaauacgagaacaucaaaguaagagaaggcgucgacgaaaacuccgaguucaaauucacccuguacaaaaacgaccuccuccuccuaaaggauagcgaaaacggcgaacaaauauuacuacgauucaccagcagaaacgacacguccaagcacuacguagaacucaaacccuacaaccgccaaaaguucgaaggcucagaguaccucaucaagagccuagggacagucgucaaagggggccgcugcauaaaaggacucggaaaguccaacaucucaauauacaaagucaggacggauguucuaggcaaccagcauaucaucaagaacgaaggagacaagccaaaacucgacuucuga

SEQ ID NO: 6258 - RNA, 3363 nt, Artificial Sequence
  Cas9 variant
auggggcucgacauaggcguagccuccgugggcuucucagucuuagauaucgacaaagggaaagucaucgaacucggggccagacuauucucagcuaccgucgcagccggcaaucaagacaggcgcgacaugcgaggagcccgccgccuccucaacaggaacaaacagcgccgccaagacacaggcaaacuauucaaaaaguucgggcucauugacgacuucgacaagggcucguucuaugacaacuucaaccaaaaccuaaacccguaugaacuccgggucaaagggcucaccgaacagcuuacaaaggaagaguuggccgaaucgcucuaccagauugugaagcaucgaggcaucaguuacgcccuaaaagacgccgacgucgacgagggcgguacagacuacuccguaagccuaaaaauaaacagccaagaacucgcagagaaaacaccggcacaaauccaacuacagcgcuugaaugacuacggcaaaguccgcggccaagucguuaucggcgacgaccccgauaaccagaagguacuccuuaacguguucccgacaagcgcuuacgaaaaggaggcaaaacaaaucauagccacacaacagcaguucuaccccgaaagccuaacagauaaauucacagaagaguacugccaaauacugacgaggaaacgggacuacuuuguagguccuggaaacgaaaagucgcgaaccgauuacggaaucuacaaaacagacggaaggacccuagacaaccuuuucgaggaacuaaucggccaugauaagaucuacccagaggagcugagagccucagccgccagcuacacagcccaacuauuuaacguacucaacgaccugaauaaccucagaauccuaaacuacgaagacgguaagcucacgaaagaggacaaggaaaagauaauagcagaaauaaagaacaacaccaccaccaucaacaugcuaaauguaaucaagaaagucgccggguguuccaaagacgacaucaaaggcuuccgagucaacgagaaagacaaaccagaaaucucaagcaugccaguauacaggaaaauccacaaagaccuacucaaagccggugucgacaucuccgacuggccagucgaguucauagacgaauuaucauucauacugacgcucaacacggaaaacggagaaauacgcaaacaacucaacaacagacuggcaccaaaguucgacuuucucaacgccgaccuaauccagcugaucauagacaacaaagacagcuucgaaaucaaaacaaacaacaaguggcauagguucagcguaaaaaccaugaauaaacuaauaccggaaaugauggaacgcccggucgagcagaugacgcugcucaacgaaaugggccuggucaaaaaggacaagaaacgauucgaaaacaacaaauaccucccauacaaagagauagcaaaggacaucuucaaucccguagcaagcaaguccguccgagaagcgcuaaaaaucgucaacgcuguccuaaagaaauacggccacaucgacuaccuagugguggaaaugccgcgagacaaaaaucuaaaagaggaacaggacaacauaaaagaguuccaaaacaaaaacaaaaaggcaaaggacgcagcauucgaagccuuugucaaaucugucgggucggaacaacgcgucaaagaagcgcuaaguaaaaaccgcaaacuccaaaugaaaaugcggcuuugguaccaacaacaagagauagacccauauaacggaaaaacaauagacgccaccgaccugaucaacaacccagacaaauucgaaauagaccacaucauaccgcaaagcauaucguucuaugacucaaucaacaacaagacacuaugcuuugccaguaugaaccaaguaaaaggccagaagaccccauacgaguucaugcucgaaggacacggccaaucauacgacaaauucaaggcgaccgucauggcuaacaagaauuuuggcaaagccaaacgcgccaacuaccucuucgaagaaaacguauccgacauagaaacgcgaaaacgauuccugagcagaaaccugguggacaccagguacagcagcagagucgugcugaacagcuuacaagacuucuucagagaaaaauccgccgacaccaaaguaacaguaauaagagguaaauucaccagcaauaugcgcaagcauuggcauaucgacaaaacacgagaaaccuuccaccaccacgccauagacgcaagcaucauagccgccaccccauuccuacgaauguggaagaaaggcgguaccauauuccccgugaaaguaggcgaagagucaaucgacauagaaaccggggaaauccuugacgacaaaaacuucgacaaggcgauguacgaggaacccuacaguggauucgucuccgagaucaugaacgccgacgacaggaucaaauucucgcaccaagucgacaagaaaaugaaccgaaaaguaucagacgcaaccaucuacucgacgcgcaccggcaaacuagcaaaggacaaaaaggacgccgaauacaucguagccaagguuaaagacauauacucgguagacggcuucaaaaaguucaagaaaguauaugacaaagacaaaaccaaauuccugcucuauaaguacgacccacggaccuucagcaaacuagaaagaaucaucagcgacugccccgacaagguagaaaaaguccaaacaaacggaaaagucaaggcaguugauaucagcccuuucgaaauguaccgacgcgaccauggaaugaucaagaaauauagcaagaaaggcaacggcccagcaaucaaacagcuuaaauaccuugacaagaaacucggaagucacaucgacaucacaccggccaaugccaacggaaaacacgucauccuacagagccuaaaaccauggcgcaccgauguguaucugaaccacgaaacaggcgaauaugaaaucaugggaaucaaauauucagaccucaaguucaacaagaacgagggguacgggaucaagaaagauaaauaccuagaaauaaagaaaguagaggaaguaagcgaaaaauccgaguucauguucagccuauaccgcaaggaccgcguuaaaguacaggacaugaaaaccggggaaagcgucgaacucuuguucuggucccgcaacuucuccaacaaaaaguacgcagagcugaaacccauaucccaggccgaaaaugacaaaaagcucccgguauacgggaaaggacgccucauaaagagacuaaucccuaaaaacugcaaaaucuggaaagugaacaccaccauacugggugacccauacuaucucgaaaaagaaucagacucccccaaagacauacucgacuga

SEQ ID NO: 6259 - RNA, 3366 nt, Artificial Sequence
  Cas9 variant
augucggaccuugugcucggacucgacauaggcauagggagcguggggguuggcauccugaacaaggucaccggugaaauaauccacaaaaacucccgcauuuuccccgcggcacaggcggaaaauaaccuagugcggcgaacuaaccgacaaggccgccgucucaccaggaggaaaaagcacaggcgagugcgcuuaaaccgucuguucgaggaaaguggacucaucacagacuucacaaaaauaaguaucaaccucaaccccuaccaacuacgcgucaaaggccuaacagaugaacucagcaacgaggaacuauucauagcccucaaaaacauggucaagcaccggggcaucuccuaccuggacgacgcaagcgacgacggcaauuccuccauuggcgacuaugcgcaaaucguaaaagagaacucaaagcaacuagaaaccaagacgccagggcagauacagcucgagcgcuaccagaccuacggccaacucagaggggacuucacuguagagaaagacggcaagaaacaccgccugaucaacgucuucccaacguccgcauaccgaucagaggcgcuacgaauccuacaaacacagcaagaguucaacccccagauaaccgacgaguucgucaaccgcuaccucgaaauccucacaggaaaacgcaaguacuaccacgggccaggaaacgagaaaagccgcaccgacuacggccguuaccguaccaacggagagacgcuggauaacauauucgguauacuuauaggcaaaugcaccuucuaccccgacgaauuucgcgccgcaaaggcauccuacacggcccaggaguucaaccuacucaacgaccuaaacaaccucacaguacccaccgaaaccaagaagcuaucaaaggaacagaaaaaccagauaauaaacuacgucaaaaacgaaaaagcaaugggcccagcaaaacuauuuaaauacaucgcgaaacuacugucgugcgacguagccgacauaaaaggcuaucgaauagacaaaagcggcaaagccgagauccacaccuucgaggcauaccgaaaaaugaaaacacucgaaacccucgacauagaacaaauggaccgcgagacacuggacaagcucgccuacgugcuaacccuaaacaccgaacgcgagggcauccaagaagcauuagaacacgaguucgcagacggcuccuucucucagaagcaagucgacgaacucguccaauucagaaaagcaaacagcagcauuuucggcaagggguggcacaacuucuccgugaaacugaugauggaacucaucccugaacucuacgaaaccucagaagaacaaaugaccauccugaccagacucggcaaacagaaaacaaccagcaguucaaacaaaaccaaauauaucgacgaaaaacuucugaccgaagagauauacaacccgguagucgcaaaaagcgucagacaagcaaucaaaauagucaacgccgcaaucaaagaauacggcgacuucgacaacauagucaucgaaauggccagggagaccaacgaagacgacgaaaagaaagcgauccagaaaauacaaaaagcaaacaaagacgaaaaagacgcagccaugcuaaaagcagccaaccaauacaacggaaaggcagagcuuccccacucaguguuccacggucacaagcaacucgcaaccaagauccgacucuggcaccaacaaggcgaacgcugccucuacacaggaaaaaccaucagcauccacgaccuaaucaacaacagcaaccaauucgaagucgaccacauacugccacuguccauaaccuuugaugauucacuagccaauaaaguucuugucuacgcaaccgccaaccaagagaaagggcagagaacaccauaccaggcccuagauagcauggacgacgcauggagcuuccgcgagcucaaggccuucguccgagaaucaaagacguuaagcaacaaaaagaaagaauaccuacugacagaagaggacaucagcaaauucgacgugcgcaagaaauucaucgaacgcaaccuaguagacacaagguacgccagccgcgucgugcucaacgcccugcaggaacauuuucgcgcacacaaaaucgacacuaaaguuuccguaguacgcgggcaguucacaagccagcuccgucgucacuggggcaucgagaaaacccgcgacaccuaccaccaccaugccguagacgcucuaauaauagcagccucaucacaacuaaacuuauggaagaaacagaaaaacacccuagucagcuacagugaagaccaacuacuagacaucgaaaccggagaacucaucucagacgacgaguacaaagaguucguauucaaagcaccauaccaacacuucguugacacuuuaaaaagcaaggaguucgaagacagcauacuuuucucauaccagguagacagcaaguucaacagaaagauaagcgacgcaacaauauacgccacgcgacaagcaaagguggggaaggacaaagcggacgaaaccuacguacuuggaaaaaucaaggacaucuacacacaagacggcuacgacgccuucaugaaaaucuacaagaaagacaaaagcaaauuccuaauguaccggcacgacccucaaaccuucgaaaaaguaaucgagccaaucuuggaaaacuaccccaacaaacagaugaacgaaaaaggcaaagaagucccauguaacccauuucuaaaauauaaagaggagcacggcuacauccgaaaguacagcaagaaagggaacggccccgaaauaaaaucgcugaaguauuacgacucaaagcuaggaaaccacauagauauaacgcccaaagacucgaauaacaaggucguccuacaauccgugagcccuuggcgcgcagacguguacuucaacaacacaacugguaaauacgagauacuuggccuaaaauacgcggaccuccaauucgaaaagggcaccgggacauacaaaaucagccaggaaaaauacaacgauauaaagaagaaagaaggugucgacucagacagcgaguucaaauucacacucuacaaaaacgaccuccuccuugucaaagaaacugaaacgaaagaacagcaacucuuucgguuccucagcagaaccaugccgaaacaaaaacacuacgucgaauuaaaaccauaugacaagcaaaaauucgaaggaggcgaggcacucaucaaaguccucgggaacgucgcaaacggcgggcagugcaucaaaggacuaggcaaaucaaacaucagcauauauaaaguccggacagauguauuaggaaaccaacacauuaucaaaaacgaaggcgacaaaccuaaacuagacuucuga

SEQ ID NO: 6260 - RNA, 3366 nt, Artificial Sequence
  Cas9 variant
augaacgggcuaguacuaggacuggacauaggcaucgcaucuguaggggucggcauacucgagaaaaacucaggcaaaauaauacacgccaacaguaggcucuuucccgccgcaacggccgauaacaacgucgaacgcaggaagaaccgacaagcccgcagacugaaccgacggaagaaacaccggggaguacgguuccaagaccucuuugaagacuacggacuccuuacggacuucucgaaagugagcauaaaccuaaacccauaccgacuaagagucgauggccucaacaaacagcugaccaacgaagaacucuucaucgcccuuaaaaacauagugaagcgcagaggcauuucguaccucgacgacgcuagcgaagacggcgggaccgucucgucagacuacggcaaagccguagaagagaauaggaaacuucucgccgaacaaacccccggccagauccaacucgagagauucgagaaguacggccaacuacgcggagacuucacugucgucgaaaacggugaaaaaugucgacuuaucaacgucuuuucgacaagcgcauauaagaaagaagcggaacgaauccuccgcaaacagcaagaguucaacagcaaaauaacagaugaguucaucgaagacuaccuuaagauacuaacaggaaagcgcaaauacuaccacggaccaggaaacgaaaagucacgcaccgauuacggccgguuccgcaaagacggcacgaccuuagacaauauauucgggauccuaaucgggaaaugcacguucuacccaaaugaauaccgcgccagcaaagcguccuauacagcccaagaguucaaucugcuaaacgaccucaauaaccucuccguccccacagaaacgaagaaauuauccgaagaacagaagaaaacgaucaucgaauacgcaaaaucagccaaaacgcugggagcaagcacgcuacucaaauacauagccaaaaugauagacaccuccguggaccaaauccgcggauaccgcguagacgugaacaacaaacccgaaaugcacacuuucgaaguguaccgcaaaaugcaaucacuagaaaccauauccgugggagaacucucccgcaacguccuagaugagcucgcccacauacuaacauuaaacacugagcgcgaaggcaucgaggaagccaucaacacuaagcuaaaagacagcuucagccaggaccagguacucgaacuuguccaauuccgcaaaaacaacagcucgcuguucucaaaaggcuggcacaacuucucucugaagcucaugauggaacucauccccgaacuauacgagacaagugaggaacaaaugacaauucugacgcgccucggaaagcagaaaagcaaggagacgucaaagcggagcaaguacaucgacgaaaaggaacucacggaggagaucuacaauccgguagucgcgaaaucagugcggcaagcgaucaaaauaaucaaugaagccacuaaaaaguacggaaucuucgacaacauagugaucgaaauggcacgagagaacgacgaagaagaugcaaagaaggacuacaucaaacgccaaaaagccaaccaagacgagaaaaaugccgcuauggaaaaagcugccuuccaauacaacgggaagaaagaacugcccgacaacauauuccacggacacaaagagcucgccaccaaaauccggcuguggcaccaacaaggcgaaaaaugccuauauaccgguaagacuaucccaauaagcgaucugauacacaaccaguacaaguacgaaauagaccacguccucccucucucccucucauucgacgacucacucuccaacaaaguacucguacuugcaaccgcgaaccaagagaaaggccaacgcacccccuuccaagcccucgacuccauggacgacggcuggagcuaccgcgaguucaagagcuauguaaaagagagcaaacuacucggcaacaagaagaaagaguaccuccuaacggaagaagacaucucgaaaauagaggucaaacaaaaauuuauagagcgcaaccuggucgacaacagauacagcucccgcgucguccugaacgcccuccaggauuucuacaaagcacacaaguuugacaccaccauaagcguaguaagaggccaauucaccagccaauugcgccguaaaugggggcucgagaaaagccgagaaacauaccaccaccacgccguugacgcacucauaauagccgcaucgagccagcuccgcuuguggaaaaagcauaacaauccccuaauaucauacaaggaaggccgcuucaucgacagcgaaacuggggaaauaauaucacucucagacgaugaauauaaagagcugguuuucaaggcacccuacgaccacuucgucgacacccuacgcuccaagacauucgaagacagcauucuguucagcuaccaaguagauagcaaauauaaccggaaaaucagcgacgcuacaauauacgcaaccagaaaggcaaaacucgacaaagacaaaagcgaggaaacauacguacuggggaaaauaaaagauaucuauagccaagccggcuacgacgccuucauuaaaaucuacaacaaggacaaaagcaaguuccugauguaccacaaagacccccaaacauucgaaaaagucaucgaggagauccuccguacauaccccagcaaggaacuaaacgacaaaaacaaagagaucccuugcaacccauucgaaaaauaccgccaggaaaacggccccauccgcaaauacagcaaaaagggaaacggaccagaaauaaaauccaugaaauacuacgacaaaaacaucccagagagcuucauaaauauaaccccuaguaacagcaacaacaagguauuguuacggcaacucuacccauggcggacggacguguacuucaacccccagacagacaaauacgaacugcucgggcucaaguacgcagaccuccaauucgaaaaagccacuggcaaauauucaauaacaaucgacaaauacaacgaaauaaaagaaaaagaaggcgucucgaaagaauccgaguucaaguucacacuauacaagaacgacuuacuccugauaaaggacaccaaaaacaacgaagaacagauuuuccguuucuugucucgcacgaugccgaaccaaaaucacuacguagaacuuaaacccuacgacaaagggaacuucgagggaaaggagaaaauuaaagucuucaagaugaccucaaacgggcgcuguauaaaaggccuaggcaagaaauaccuauccaucuacaaagucaaaaccgacauacucggcaacaaacacuucauuaagaaagaaggcgacgaacccaaauuaaaauucuga

SEQ ID NO: 6261 - RNA, 3366 nt, Artificial Sequence
  Cas9 variant
augaacggccuaguccugggacucgacauagggauugcaagcgucggagucggcauccuagagaaaaacucgggaaaaauuauacaugccaacucccgacucuucccagcugccacggcggacaacaacgucgaacggcgcaaaaacagacaagcacgcagacucaaccgucgcaagaaacaccgaggaguucgcuuccaagaccuuuucgaagacuacggccuacuaaccgacuucucaaaaguaagcaucaaccucaaccccuaccgccuccggguugacggacuaaaccagcaacuaaccaacgaagaacuauucauagcacucaagaauaucgucaagcgacgaggaaucuccuaccucgacgacgcaagcgaagacggaggagccgucuccucagacuacggaaaagcaguggaggaaaaucgaaaacucuuggccgagcaaacccccggccagauccaacucgaaagauucgagaaauacggacaaguccgaggagacuuuacagucguagagaacggggagaaacgacgacuaaucaacguauucagcaccuccgccuaccgcaaagaagccgagaaaauucuccgcaaacagcaggaguucaacaaccaaaucaccgacgaguucaucgaagauuaccuuaagauacuuacgggcaaacgcaaauacuaccacgggccgggaaacgaaaaaucccgcacggauuacggccgcuuccgcaccgacggaaccacccucgacaauauauucggaguacucaucggaaaauguaccuucuaccccaacgaauaccgcgcauccaaaagcagcuacacugcacaagaguucaaccuucucaacgaccuaaacaaccucacugugcccacugaaaccaagaaacuaagcgaagaacaaaagaaaguuaucguggaauacgcaaaagaagccaaaacccucggggcaagcacgcuccuaaaauacaucguaaaaaugaucgacgccucuguugaucaaaucuccggauacagggucgacguaaacaacaaaccagaaaugcacaccuucgaagucuacagaaagaugcaaucacuugagaccauaucagucggggagcuaagccggaacguccuggacgaacuggcccacauacucacgcuaaacacugaacgagaaggaaucgaagaagccauaaacuccaaacuuaugggcguauucagccaagaccaagucuuagaacucguccaauuccgaaagaacaacagcagccuauucuccaaaggcuggcacaacuucagccucaaacucaugauggaacucauacccgaguuauacgagacuagcgaagaacagaugaccauacuuacacggcuaggcaagcagaaguccaaagagacaucgaaacgaacuaaauacauagacgaaaaagaacucacagaagaaauauacaacccaguagucgcaaaaucgguccgccaggcaauuaaaauaauaaacgaagccaccaagaaacacgggauauucgacaacaucguaaucgagauggcacgcgaaaacaacgaagaagaugcgaagaaagacuacaucaaaagacaaaaagcaaaccaggaugagaaaaacgccgcaauggaaaaagcagcauuccaauacaacggaaagaaagaauuacccggcaacauauucaacggccauaaagaacuggccacaaaaaucagacucuggcaccagcaaggagagaaaugccuguacacuggaaaaacaauaccaauaagcgaccucauacauaaccaauacaaauacgagaucgaucacauccuaccucuaucacucucguucgacgacagccuaagcaauaaaguccucguccacgcgacagcaaaccaagaaaaaggccagcgaacacccuuccaagcccucgacucuauggacgacgccuggucguaccgugaguucaaaagcuacguaaaggauuuaaaaucccugucaaauaagaaaaaggacuaccuccucaccgaagaagacaucucaaaaauagaaguaaaacaaaaauuuauagagagaaaccugguggacacgcgcuacagcagucgugucguacucaaugcccuacaagacuucuauaagucccaccaguucgacacuacgaucuccguagucaggggccaguucaccagccaacuacgccguaaauggggccucgaaaagagucgagaaaccuaucaccaccacgccguggacgcacuaauaaucgcggcgagcagccagcuuaggcuauggaagaaacaaaacaauccacugauaaccuacaaagaaggacaguuuaucgacucgcaaaccggagaaaucaucagccuaaccgacgacgaauacaaagagcuaguauucaaagcuccguacgaccacuucguugacacccugcacucaaagacguucgaagacggcaucuuauucagcuaccaggucgacagcaaguacaaccggaaaaucucggacgcaacaauauacgcgaccagaaaagcaaaguuagacaaagauaaaucagaagaaacauacguccucggcaagauuaaagacauuuacucucaggccggguacgacgccuucauaaaaauuuacaacaaagacaaacgcaaauuccuaauguaccacaaagacccucaaacauucgaaaaagucaucgaagagauacuccgaaccuacccaagcaaagagcgcaacgacaaaaacaaggaaguaccauguaacccauucgaaaaauaccgacaagaaaacgggccaauacggaaauacuccaagaaaggaaacggcccagaaauaaaaugccugaaauacuacgacaacaaacucggaaacuacaucgacaucagcccagacgguuccgacaaccaaguuguacuacaaucacucaaacccuggcgcaccgacguguacuucaaccaccagaccaagaaguaugagcuaaugggucuuaaguacagcgaccugucauucgaaaaaggcagcgguaaauacagcaucucaaacgaaaaguacaacucaaucaaacgcaucgaaggaguuaacgaacaauccgaauuuaaauucacccuauacaagaaugaccucaucuuaaucaaggacucagagaacaacgaacaaaaacuguuccgauucaacuccagaaacgacacugccaagcauuacgucgaacuuaaaccauacgacaaggcccgcuucgacgggcagcaagagcugaucacaauucuuggaaacgucgcaaaaggugggcagugccucaagggccuaaacaaauccaacauaucaauauucaagguaaagaccgauguccucggaaagaaacauaucaucaagaaagaaggugacgaacccaaacuuaaauucuga

SEQ ID NO: 6262 - RNA, 3366 nt, Artificial Sequence
  Cas9 variant
auguccgaucucguacugggcuuagacaucggcaucggaucgguaggagucggaaucuuaaauaaaguaaccggcgagauaauccacaaaaacagccggaucuuccccgccgcacaagcugaaaacaaccucguccgccgcaccaaccggcaaggacgccgccucacccgccgcaagaaacaccgcaucguacgacucaaucgccucuucgaagagucaggccugaucacagacuucaccaagauuuccauaaaucucaaccccuaccaauuacgggucaaaggccuuacggacgaauuauccaacgaagaacucuucaucgcccugaaaaacauggucaagcaccgcgguaucucguaccuagaugacgccagugacgacgggaauaguagcguaggcgacuacgcgcaaaucgucaaagaaaacagcaagcaacuagaaacgaaaacccccgggcaaauacaguuagaacgcuaccaaacguacggccaacuucgcggggacuucaccguagagaaagacgggaaaaagcaccgacuaaucaacguguucccaaccuccgccuaccgaucagaagccuuacgaauccucaaaacccaacaagaguucaacccccaaaucacagacgaguucaucaaccgguaccucgaaauacucaccggaaaacggaaauacuaccacggcccaggcaaugagaaaagccggacggacuacggacgauaccgcacgaacggcgaaacccucgacaacauauuuggaauccucauaggcaaguguacauucuacccggaagaauuucgagcugcaaaagccaguuacaccgcccaagaguucaaccuucucaacgaccucaacaacuuaacaguaccgacagaaaccaagaaacugagcaaagaacagaaaaaccaaauaauaaauuacgucaagaacgaaaaagcaaugggccccgccaaacuuuucaaauacaucgccaagcugcucagcugcgacguagcggacauaaaaggauacaggaucgauaaaagcggcaaggccgaaauccacaccuucgaggccuaccgcaaaaugaagaccuuggaaacacucgacauagagcaaauggaccgcgaaacucucgacaaacuugcauaugugcuaacacugaacacagaacgagagggcauccaagaagcgcuagaacacgaguucgcugacggcagcuucucucagaaacagguggacgaacugguccaauucagaaaggccaauagcaguauauucggaaaaggcuggcacaacuucagcgucaaacugaugauggaacugaucccagaacucuacgaaacaucagaagaacaaaugacaauccucacacggcuaggaaaacagaaaacaacaagcuccagcaacaaaacuaaauacaucgacgaaaaacugcuaaccgaagaaauauacaauccagucgucgccaaaagugugagacaagccauaaagaucguaaacgcagccaucaaggaauacggcgacuucgauaacauuguaauugaaauggcccgagaaaccaacgaagacgacgaaaagaaagcaauccaaaagauccaaaaagcaaacaaagaugaaaaagacgcagcaaugcuaaaggcagccaaccaauacaacggcaaagccgaguugccccacucagucuuccacggccacaagcaacucgccaccaaaauacgacuguggcaccaacaaggcgaacgcugucuauauaccgguaagacgaucagcauccacgaucucaucaacaacccuaaucaguucgaggucgaccacauccuuccacuaagcauaaccuucgacgauucgcuggccaacaaagugcuggucuacgcgacggccaaucaagagaagggacagcguacgccauaccaagcacucgacucaauggacgacgccugguccuuccgcgagcucaaagccuucgucagagaaagcaaaacccucagcaauaaaaagaaggaguaccuacucaccgaggaggauaucucuaaauucgacgugcaaaagaaauucaucgaacgcaaccuagucgauacccgcuacgcaagcagagugguccuaaaugcccuacaggaacauuuucgagcacacaaaaucgacacgaaaguaagcguaguccgcggccaauucacaucacagcugagacgccacuggggaauagagaaaacaagagacacauaccaccaccacgcagucgacgcacucaucauagcagccagcucccagcuuaaccucuggaagaaacagaaaaacacccuagucagcuacuccgaagaccaacuacucgauauugaaacaggcgaacucaucucagaugacgaauacaaagaaagcguauucaaagcucccuaccaacacuuuguggacacacuaaaguccaaagaguucgaggacucaauacucuucagcuaccaagucgacagcaaguucaaccggaagauaucagacgccaccaucuacgcgaccagacaagcaaaagucgguaaggacaagaaagacgaaaccuacguccuaggaaagaucaaagacauauacacgcaagacggauacgacgcauuuaugaagaucuacaagaaagacaaaagcaaguuccucauguaccgccacgacccccaaacauucgaaaaaguaauagaaccaauccuagagaacuaccccaauaaagaaaugaacgagaaaggaaaagaaguaccauguaacccuuuccuaaaauacaaagaagaacacggcuacauccgcaaauacuccaagaaaggaaacggccccgaaauaaaaucccuaaaauauuacgacucaaagcugggcaaccacaucgacaucacgcccaaaaauucuaauaacaaggucgucuugcaaagugucucccccuggcgggcagacguauacuucaacaaaaccacgggcaaauacgaaauacuuggccuaaaguaugccgacuugcaauucgaaaagggcacaggaaccuacaaaaucucccaagaaaaguacaacgacauaaagaagaaagaaggcgucgacucagacagcgaauuuaaguucacccucuacaaaaacgaccuacuucuagucaaagacaccgaaaccaaggaacaacaacuauuccgguuccuuagccgaacaaugccaaagaagaaacacuacguagaacuuaagccauaugacaaacaaaaauucgaaggaggcgaggcgcucaucaagguccugggaaacgucgcaaacagcggacaaugcaucaaaggccucgcgaaguccaacaucuccauauacaaaguaaggaccgacguacucggcaaccagcacaucaucaagaacgaaggcgacaaacccaaacuagacuuuuga

SEQ ID NO: 6263 - RNA, 3366 nt, Artificial Sequence
  Cas9 variant
augagcgaccugguacuuggccuagacauaggcaucggcagcgucggcgucggcauacuuaauaaagucacgggagaaauaauacacaaaaauucgcgaauauucccagcagcccaagcagaaaacaaccucgugagacgaaccaaccgucaggggcgacgccugacaagacgcaaaaagcacagaagaguccgccuaaaccgccuauuugaagaauccggccucauaacagacuucaccaagaucuccauaaaccucaaccccuaucaacuaagaguaaaaggacuuacagacgaacucuccaacgaggaguuguucaucgcucuuaaaaacauggugaaacaccgaggcaucucauaccucgacgacgccagcgacgacgggaacucaagcauaggagacuacgcgcaaaucgucaaagagaacuccaaacaacucgaaaccaaaacacccggccagauccagcucgaacgcuaccagaccuacggucaacuacgcggagacuucacggucgaaaaagacggcaagaaacaccgacuaaucaacguguuccccaccagcgcguacaggucagaagcccuccgcauccuccaaacccagcaggaauuuaacccccagaucacagacgaguucaucaaccgcuaccuagaaauccuuacagguaaaagaaaauacuaccacggccccgggaacgaaaaaucgcgaaccgacuacggccgauaccggaccucuggugaaacccuggacaacauauucggcauacuaaucggaaaaugcacauucuaccccgacgaguuccgcgccgcaaaagcauccuacacagcacaagaguucaaccuucugaacgaccucaacaaccugaccgugcccacagaaacaaagaaauuaucaaaagaacagaaaaaccagaucaucaacuacguuaaaaacgaaaaagccaugggacccgcaaaacuuuucaaguacaucgcgaaacuucugucaugcgacgucgcagacauaaaaggguauagaauagauaagagcggaaaagcggaaauccacaccuucgaagccuaccgcaaaaugaaaacccuagagacacucgacauagaacagauggaucgagaaacccucgacaaacuugccuacguacucacgcugaacacagagcgggaggggauucaggaagcccucgaacacgaguucgcagacggcagcuucagccaaaagcaggucgaugaacucgugcaauuccgaaaagccaacaguagcaucuucgggaagggcuggcacaacuucagcguaaaacucaugauggaacuaauccccgaacuauacgagaccagcgaagaacaaaugacgauccucacuagacuaggcaagcagaaaaccacuuccaguagcaacaaaacaaaauacaucgacgaaaagcuacucacagaggagauauacaacccggucgucgccaaaaguguccgccaagcgauaaaaauaguaaacgcggcaauuaaagaauacggcgacuuugacaacauugucaucgaaauggcccgagagaccaacgaagaugacgaaaagaaggccauacagaaaauccaaaaagcgaacaaagacgagaaggacgcagccaugcucaaagccgccaaccaauacaacggcaaagcagaacugccgcauuccgucuuccacgggcacaagcaauuagcgaccaaaauaaggcuauggcaccaacaaggagaaagaugccuauacacuggaaagaccauaaguauacacgaccugaucaacaacagcaaccaauucgaagucgaccauauccucccucucagcauaaccuucgacgauagucuagccaauaaaguacucgucuacgccaccgcuaaccaagaaaagggccaacgcacucccuaccaggcccuggacaguauggacgacgccuggagcuuccgggagcuaaaagcauucguccgcgaauccaaaaccuuauccaacaaaaagaaagaguaccugcucaccgaagaggacauauccaaauuugacguacgcaagaaauucaucgaacgaaaccuugucgacaccagguaugcgagccgagucguccugaacgcgcuacaagaacacuuccgcgcacacaaaauagacaccaaaguuucggucguccgaggccaauucacaucccaacuacgccgacacuggggaauugagaaaaccagagacacauaccaccaccacgccgucgaugcccugauaaucgcagccucuagucaacucaaccuguggaagaaacagaaaaacacgcucgucagcuacucagaagaccagcuccucgacauugaaacgggcgaacuaauaucggacgaugaauacaaagaauccguauucaaagccccauaccagcacuucgucgacacacugaaaagcaaggaguucgaagacaguauccuauuuuccuaccagguggacuccaaauucaacagaaaaauuuccgacgccaccaucuaugcgaccagacaagccaaggucggcaaagacaaagccgaugaaaccuacguacuaggcaaaauaaaagacauauacacacaagauggauacgacgcguucaugaaaauauacaagaaagacaaaagcaaauuccucauguacagacacgacccccaaaccuucgaaaaggugaucgaacccauccucgaaaacuacccaaacaaacagaucaaugaaaaaggaaaagaaguacccugcaacccguuccuaaaguacaaggaagaacacggguacauccgcaaauacagcaaaaagggcaacggaccagaaaucaaaucccuaaaguacuaugacagcaaacucggaaaccacauagacaucacacccaaagacaguaauaacaaagucguucugcaauccguaucgccauggcgagcagacguuuauuuuaacaagaccacagguaaguacgagauacuaggacuaaaguacgccgaccuacaauucgaaaagggcacagggacauacaaaaucucccaagaaaaguacaacgacaucaagaagaaagagggcgucgacucagacagcgaguucaaauucacccuguacaagaacgaucuucuccuagugaaggacacagaaaccaaagaacaacaacuauuccgauuucuaucccggacaaugccuaaacaaaagcauuacguagaacuaaaaccuuacgacaagcagaaauucgaaggcggagaagcccuaaucaaaguacucgggaacguagcaaacuccggacaaugcaagaaagggcucggcaaaagcaauauaaguaucuauaaggucagaaccgacguccuaggaaaccaacacaucaucaaaaacgaaggggacaaacccaaacuugacuucuga

SEQ ID NO: 6264 - RNA, 3366 nt, Artificial Sequence
  Cas9 variant
auguccgaccucguacucggccucgacauaggaauugggucgguaggagugggcauccucaacaagguaacgggggaaauaauccacaaaaacagcagaauauuccccgccgcccaggcagaaaacaaucugguacgccgcacaaaccgccaaggccgcagacuuaccagacgcaagaaacaccgcagaguccgccucaacagacucuucgaagaaagcggccucaucacagacuucaccaaaaucucaaucaaccugaauccauaccagcuuagagucaaaggccuaacugacgaauuguccaacgaggaauuauuuauagccuuaaagaacauggucaaacaccggggcauauccuaccuagacgacgcauccgacgacggaaacuccagcgucggagacuacgcccaaauugucaaagaaaacagcaagcagcucgagacaaagaccccagggcagauccaacuggaacguuaccaaaccuacggccagcuccgaggagauuucacagucgaaaaagacggaaagaaacacagacucauuaacgucuuccccacaagcgccuaccgcucggaagccuugagaauccuacaaacacaacaggaguucaacccgcagaucaccgacgaguucgugaaccgcuaccuagaaauacugacgggcaaaagaaaauacuaccacggccccggaaacgaaaagagcagaacagauuacggccguuaccgaacaaacggcgaaacccuagacaacauuuucggaauccucaucggaaaaugcaccuucuaccccgaagaguuccgcgccgccaaagcgucauacaccgcacaagaguucaaccuccuaaacgaccuaaauaaccuaaccguccccacagaaaccaaaaagcucagcaaagaacagaaaaaucaaaucaucaacuacgucaaaaaugaaaaggccaugggcccagccaagcuauucaaguacauagcaaaacuccuaagcugcgacguagcagacaucaagggcuaucgcaucgacaaaucaggcaaagccgaaauccacacauucgaagccuaccgcaagaugaaaacacuagaaacuuuggacaucgaacaaauggaccgagaaacccucgacaagcucgccuacguccugacgcuaaacaccgagcgagaaggcauccaagaggcgcuagagcacgaguucgcagacggaucuuucucucaaaaacagguagacgaacuuguacaauuccgcaaggcgaacagcuccaucuuugggaaaggcuggcacaacuuuuccgucaaacugaugauggaacucauccccgagcuguacgaaacguccgaagaacaaaugaccauacucaaacggcuaggcaaacaaaagacaacaucauccuccaacaaaacgaaguacauagacgagaaacuccucaccgaggaaaucuacaacccaguggucgcgaaaagcaucagacaagcaaucaagaucgucaacgcggcuauaaaggaauacggcgacuucgauaauaucgucauagagauggcccgcgaaaccaacgaagacgacgaaaagaaagcaauccagaaaauacagaaagcgaacaaagacgaaaaagacgccgcaaugcuaaaggccgcaaaucaauacaacggaaaggcagaacucccgcacagcguuuuccacggccauaagcaacuagccacaaaaauucgccuauggcaccaacaaggggaacgcugcuuguacaccggcaagaccaucuccauacacgaccugauaaacaacccuaaccaguucgaaguggaccacauccucccccuaaguauaacauucgacgauuccuuggccaacaagguccuaguauacgcuacggccaaccaagagaaagggcaacguacaccauaccaggcacuggacucaauggacgaugcguggagcuuccgcgagcuaaaagcguucguccgugagucgaaaacucucagcaauaagaagaaagaauaccugcuaacagaagaggacaucaguaaauucgacgucaggaagaaauucaucgaacgaaaccuagucgacacgcgcuacgccagccggguaguacugaacgcacuucaggaacauuuccgcgcacacaaaaucgacacaaaagugagcgucgugagaggacaauucacaucacaacuacgccgacauuggggcaucgagaagacuagagauacauaccaucaccacgccguggacgcauuaaucauagcagccagcucccagcuaaaccucuggaagaaacagaaaaacacccuaguaagcuacagcgaagaccagcuccuggauauagaaacgggcgagcucauuucagacgacgaguacaaagaauccgucuucaaagccccauaccaacacuuugucgacacgcuaaaaucgaaggaguucgaagacagcauccuauuuuccuaucaggucgacucgaaauuuaaccgaaaaauaagugacgcaaccauauacgcaacacgacaagcaaaagucggcaaagacaagaaagacgaaacguacguacuuggcaaaaucaaagauauauacacgcaagacggcuacgacgcguucaugaagaucuauaaaaaggacaaguccaaguuccucauguacaggcacgacccccaaaccuucgagaaaguaauagaaccuauccucgaaaacuauccuaacaaggagaugaacgagaagggcaaagagguccccugcaaccccuuccuaaaauacaaggaagaacacggauacauccgaaaauacucuaagaaagguaaugaccccgagaucaaaucacucaaauacuacgacucaaagcuggggaaccacauagacauaacgcccaaagacuccaauaacaaaguaguccuacaaucagucagcccauggagagccgacgucuacuucaacaaaaccaccggcaaguacgaaauauuaggacuaaaauacgcagaccuccaauucgagaagggcacaggcaccuacaagaucagucaagaaaaguauaacgauaucaaaaagaaagaaggggucgauucagacagcgaguucaaauucacccucuacaaaaacgaccugcuccucgucaaagacacagaaaccaaagaacagcaacucuuccgcuuccucagcagaaccaugcccaaacaaaagcacuacguagaacuaaagcccuacgauaaacaaaaauucgaaggcggcgaagccuugauaaaaguacuaggaaacgucgccaacagcggccagugcaagaaaggguuaggaaaaagcaacauuagcauauacaaaguacgcacagacguccuaggaaaccagcacaucaucaaaaacgaaggagacaaacccaaguuggacuucuga

SEQ ID NO: 6265 - RNA, 3366 nt, Artificial Sequence
  Cas9 variant
augaacggccuaguccugggcuuagauauaggaauagccucagucggagucggcauccuagagaaaaacagcggcaaaauaauacacgcaaacucacgacuauucccagcggcaacagccgacaacaacgucgaacgacggaagaaccgacaagcaaggagacuacaccgccggaagaaacacaggggcguccgcuuccaagaccuauucgaagacuacggccuccuuacagacuucucgaaagucagcauaaaccugaauccauaccggcuccgcguagacgggcucaaccaacaacucacaaaugaggaacuauucauagcccugaaaaacauagucaaacggcgcgggaucaguuaccuggacgacgcaagcgaagacggcggaacaguaagcagugacuacgggaaagcugucgaagagaaccgcaagcuccucgcggaacagacccccggccagauccaacucgagagauucgaaaaguaugggcagguucgaggggauuucaccgucgucgagaacggagaaaagcggcggcuaauaaacguauucucaaccucagccuacagaaaagaggccgaacgcauccuccgaaaacaacaggaguucaacuccaaaaucacggacgaguucauagaagauugccucaaaauccuaacaggcaaaagaaaauacuaccacggaccaggcaacgagaaaagcagaacugacuacggucgauuccgaacagacggaacgacccuagacaacauauucggcauccucauaggaaaaugcacuuucuaucccgacgaauaccgggcaucaaaagccagcuacaccgcccaagaguucaaccuccucaaugaccuaaacaaccugacgguacccaccgaaacaaagaagcuauccgaagaacagaagaaagucauaguggaauacgccaaagaagccaaaacccuaggagcauccacccuacucaaauacaucgccaaaaugaucgaugcaagugucgaccaaauacguggcuaccgugucgacguaaacaauaaaccggaaauacacaccuucgaagcauaccgcaaaaugcaaucacucgaaaccauuucaguaggggaacugucacgcaacguacuggacgaacuggcgcacauucuaacauuaaauaccgaacgcgagggcaucgaggaagccauaaacacaaaacucaaagacucauucagccaggaccaaguccucgaacugguccaguuccgcaaaaauaacucuucccucuucuccaaggguuggcacaauuucucacugaaacucaugauggagcucaucccagagcuauacgagaccucugaggaacagaugacgauccuaacccgucucgggaagcaaaaauccaaagaaaucaguaaacggaccaaauacauagacgaaaaggagcuuacagaagaaaucuacaaccccgucgucgcaaaaagcguccgacaagcaauaaaaauaaucaacgaggcaacgaagaagcauggaauuuuugacaacauuguaauagagauggcccgagagaacaacgaagaagacgccaagaaggacuacaucaagcgacaaaaggcgaaccaggacgagaaaaacgcggccauggaaaaagcagcguuccaguauaacggcaaaaaggaacuaccagacucaaucuuccacgggcaaaaagaacucgcaacaaaaaucaggcucuggcaccaacagggcgagaaaugccucuacacgggcaaaaacauacccauauccgaccuaauccauaaccaauacaaguacgaaaucgaucacauacucccgcucagccuuuccuucgaugacucccucuccaacaaaguccugguccuagccacggcgaaccaggaaaagggacaacgaacccccuuccaggcccuagacucuauggacgacgcguggucauaccgagaauuuaaauccuacguuaaagaauccaaacugcuaggcaacaaaaagaaagaauaccuccuaaccgaagaggacaucucgaaaauagaggucaaacagaaauucaucgagcgcaaccucaucgacacacgcuacucgagccgugucguccuaaacgcccuucaggauuucuacaaagcccacaaauucgacaccacuaucucgguaguccgaggccaauucacgucccaacuucgccgcaaaugggggcucgagaaaagccgcgaaacguaucaccaccacgccgucgacgcacucaucaucgcggccagcucgcaacugcggcuguggaagaaacaaaacaacccacucauugccuacaaagagggccaauucgucgacucggaaacaggcgagaucauaagccugagcgacgacgaguacaaagaacuggucuucaaagcacccuacgaucacuucguagacacacugagcucuaaaaccuucgaggacagcauacuauucuccuaccagguagacagcaaauucaaucgaaaaauaagcgacgccacaauauacgcaacacgcaaagcaaaacuagacaaagagaaaucugaagaaaccuacguccuaggcaaaaucaaagacaucuacucccaggccggguacgacgcauucaucaaaauauacaacaaagacaagucaaaauuccuaauguaccacaaagacccccaaaccuucgagaaggugaucgaggaaauucuacgcaccuacccgaguaaggaacuaaaugacaaaaacaaagaaaucccaugcaauccauucgaaaaauaccgccaagaaaacggacccauucggaaauacucaaagaaaagcaacggaccugaaaucaaaucacucaaauacuacgauaacaaacuaggaaaccacauugacaucacgccagagucuuccgauaaccaaguaguacuccagucgcucaaacccuggaggacagauguauacuucaaccaccagacgaagaaauacgaacuuaugggccuaaaauacuccgaccuaucauuugagaagggcuccggcaaauacuccaucagcaaccagaaauacaauucaaucaagagaauagaggggaucgaugagcaguccgaguucaaauucacccucuacaaaaaugaccucauacuaaucaaggacuccgaaaacaacgaacaaaaacucuucagauucaauuccagaaacgacacagccaaacacuacauagaguuaaaaccauacgauaaagccaaauucgacggagaacaagaacuaauaacuauacucggcaacguagcaaaaggaggacguugcuugaaaggacucaacaagagcaauauaagcaucuucaaggucaaaaccgacguacucggcaagaaacauaucaucaagaaagaaggcgacgaacccaaacuuaaauucuga

SEQ ID NO: 6266 - RNA, 3366 nt, Artificial Sequence
  Cas9 variant
augaacggucucguccucggccucgacaucggcauugcuuccguaggagucggcaucuuaaacaaagacaccggagagauaauccacaccaacagccgcaucuuccccgccgcaacggccgacaacaacgucgaacgccggaacucacggcaagaccgaagacucaaucggcgcaagaaacaccgaggagucagacuucacgaccuguucgaggacuacgaccuccucacagauuuuuccaaagucagcauaaaucuaaacccguaccgacuaagaguacaaggccuggacaacagcuuaaccacagaggaacuauucaucgcccucaaaaacaucgucaaacgucgcggaauuucuuaccuagacgacgccuccgaagacggagguguaguauccuccgacuacggcaaagccgucgaagaaaaccgcaaacuccuagccgagcaaaccccaggccaaauccagcucgaacgcuucaagaaauacggccaaguccgaggcgacuucacagucgucgagaacggcgaaaaacgcagacuuaucaacguauucucgacaucggcauaccgaaaagaggcagagcggauacuacgcaaacagcaagaguucaauaaucagaucacagacaaauucauagaagacuaccucaaaauacucacggaaaaacgcaaauacuaucaugggccaggcaacgagaaaagcaggaccgacuacggacgguuccgcaccgacggcaccacgcuggacaacaucuucggcaucuuaaucggcaaguguaccuucuauccaaacgaauaccgagccucaaaggcgucauacacagcccaagaguucaaccugcucaacgaccugaauaaccucaccguccccacggaaacaaagaagcuauccgaagaacagaagaaaaccauaguagaauacgccaagagcgccaaaacacucggagcgagcacacuccuaaaauacauagccaaaaugaucgacgcaucgguggaccagauccgcggguacagggucgacguaaacaacaaaccagagaugcacacguucgaagucuaccggaagaugcaaucacuagagaccauauccguaugggaacuaucaagaaacaucuuggacgagcuagcacacauccucacccuaaauaccgaacgcgagggcaucgaagaagccaucaacaccaaacucauggacgucuuuucccaggaccagguccucgagcuaguccaauuccguaagaacaacagcucccucuucucaaaaggcuggcacaacuucucccgaaaguuaaugauggaacuaaucccagaacucuacgagaccuccgaggaacaaaugaccauccucacccgauugggcaaacagaaaagcaaagaaaccucaaaacguaccaaguacauagacgaaaaagaagugacugaggaaaucuauaacccaguuguagcaaagucgguccgccaagccaucaaaaucaucaacgaagcaacaaagaaauacgggaucuucgacaauaucgucaucgaaauggcgcgagaaaacaacgaagaagacgccaagaaagauuacaucaaacggcaaaaagccaaccaagacgagaaaaacgucgccauagaaaaagcagcauuccaauauaacgggaagaaagaacugccugacucaauauuucacggacacaaagaacucgccaccaaaauacgacucuggcaccaacagggcgaaaaaugccucuacacggggaaaaacauacccaucucagaccuaauacacaaccaauacaaauaugaaaucgaccacauacucccacuaucccuuagcuucgacgacagccuauccaacaaaguccuaguccucgcgacagcaaaccaggaaaaaggacaacgcacccccuuccaagcgcucgacuccauggacgacgcguggucauaucgcgaguucaaaagcuacgucaaagacagcaaauuacucggaaacaaaaagaaagacuaccuccucaccgaagaagacauaucgaaaauagaaguuaaacaaaaauucaucgagcgcaaccuaguugacacucgcuacucaagccgcgucguccuaaacacccuacaagacuucuacaaagcacacaaguucgacaccaccauuuccgucguccgaggacaauucaccagccaacuccggcgaaaauggggauuggagaaaucacgagaaacauaccaccaccacgcaguggaugcgcucaucaucgccgccuccucccagcugcgacuauggaagaaacaagccaacccccuaauaagcuacaaagaagaucaauucguagacagcgaaacuggagaaauaauaucgcuaacagacgacaaauacaaagaacuuguauucaaggccccauacgcccacuucguggacacgcuguccagcaaaaaguucgaagauucaauccucuucagcuaccaagucgacuccaaauacaaccgaaaaaucucggacgccaccauauaugcaaccagaaaggugaaacucgacaaggacaagucugaagaaacguacguacucggcaaaaucaaagacaucuacagccaagccggcuacgacgccuuuaucaaaauauacaacaaagacaaaagcaaauuccucauguaccacaaagacccacaaaccuuugagaaagucaucgaggagauccuacguaucuacccuaguaaagaguucaacgaaaagaacaaagaagucccgugcaacccguucgaaaaguaucgccaagaaaacggccccauaugcaaauauucaaagaaaggcaacggacccgaaaucaagucacucaaguacuacgacaagaacaucccagagucauucauagauauaaccccaagcaacuccaagaacaaaguaauccugaggcagcucaacccauggaggacagauguauacuucaaccaccaaacagaaaaauacgagcuucuaggccuaaaguacgcggaccuccaauucgaaaagaaaacggagacuuacuccauuacaaucgacaaauacaacgaaaucaaagagaaagagggagucggcgaacacuccgaguucaaauucacccucuauaaaaacgaccuucuucucaucaaggacauggaaaucaaagaagaacagaucuuccgauuccuuagccgcaccaugccaaacaagaaacacuacgucgaacugaaaccguauuacaaaggaaacuucgaaggcaaagaaagaaucaaaguuuucaacacaaccuccaacggaaggugccugaaaggccucggaaagaaaggccucuccaucuacaaaauaaaaacagacguucugggcaacaaacacuucaucaagaaagaaggagagaaacccaaacucaaguucuga

SEQ ID NO: 6267 - RNA, 3366 nt, Artificial Sequence
  Cas9 variant
auggaccggaccgaagucaacauaggcuucgacaucggaaucagcucgguaggcuggucagucguagcaacgaaaucagggcgcauccucgaaucaggggucucgcuauucuccggagcauccgcugccaaaaaugaggaaagaagaaacuucagacaaagccgccggcuacugagacgccgcaaaaacaggaucuccgaccucaagaaguaccuaaaggaacaaaguuucaccuacaacggagaacugcuuaacgagaaccccuacgagauacggguaaaaggacuaacugagaaacucucaaaagaagagauagcccuagcacuccuccacaucgugaagagacgaggagucucguaugacuuaggcgacauagaagaagaaggcacaacaggauccuacaaagaaggggucaagaaaaaucaaaaacuacuaaaggagaaaacgccagcggaaauccaauuucaacggcuaaagaaguuccacaagguccguggccagaucgccauagaugagaacgacguccuccugaacgucuuucccaaccacgcauacgucgacgaagcacagcagauacuuuauacccaacaagaguucuacccugaaaucaacgaaacuuucaucaaccaagucacagacuucauaucccgaaaacgagacuacuucaucggcccggggucggagaaguccagaacagacuacggaaucuaccgaacagacggaacgacacuacaaaaccuguucucgauccuaauaggcaaggacaaaauauuucccgaugaguuccgcgcggcaggcaacuccuacacagcgcaaguauacaaccuccucaacgaccucaacaaccuggcaaucgacgacacagaaaccggcaaacugacaaagcagcaaaaagagaaaaucauaauggaacugaaaacgaccgagaaaagcguaaauaugaugaagcucauagccaaaacggcgggcgucaccguggaacaaaucucccgcuaccgaauaaaucgagacggcaaaagugaaauacacaacauggccgucuaccgaaagauacgcaaagucuuccucgaacuaggcuacgaaaucaacgaauggcccucacagcugcuugaugaacuaggggacgcccuaucccucaacacagaaaacggagaaauuagaaggauccucacagauaaccucgcaaacaaguacaaaauccucgaccagcagcucaucaaccugaucaucgaaaauaagaacgcauucacacuaucgaccaaccaaaaauggcaccgcuuuagcuacaaaaccaugaaaauccuaaucccggaacuccucgaaaccaacaaagaacaaaugaccauccuaacggagaugggucucaugaagaaagaucaacgcaacuacguaggcaaaaauaaaauagacagcgaagcccuccuagaaaaccuauacaacccggucguccgcaagagcacacgccaaacuaugaaacucuucaacacacuacucaaaaaguaccccaacauagcauauguagucauagagaugcccagagaagacgacgaagacaaggcccgccgcgacuacgugaaguuccaaaaagacaacgagaaggagaaagacgcagcacucaaaaacuucaucauggagucaggaaaauccgaagccgaagugauagccaaauaccgacagagcaagaaauucagaucgaaaguacggcucugguaccaacagaugggacgaugccuguauucagguaaagccaugccagccgaacgcguauuccgggacgaccacuucacagacauagaucacguaauaccacucaguguauccuuugacgacgguaugaacaacaagguccugugccucgccgaaaugaaccgacaaaaagacaaacaaacaccguacgcguucuucaacgcaggccauggacagggauuccaagcgaugaacgccaugcucaaaaacaacaaccgaauauccuccgccaaaaagcgaaaccuacuauucaccgagaaccucaacgaccuagagguccgaaagcgauucauagaaagaaaccuaguugacacccgcuacgcaagccgcgucguacuuaacgaacuccaacaauucgucaaagcaaaacagcuagacacgaaaguuaccguaauccgggggaaguucacauccaaacuaagggaaaaauggaacaucaauaaaucccgcgauacacaucaccaccacgccgucgacgccgcggucaucgcggugagccccaugcuaaaccucugggaaaaaggcgccucaaucaucccaaacaaggucggagaaaacgucauugacaucaaaaccggugaaaucauaaccgaucacgacuacgaggccgacguauaugaacugcccuacgcaaaauuccuagagcaaauccccaaagucaagaaggacaucaaguuccgacaccaagucgauaaaaagaagaaccgcaaaguaagcgacgcaaccauauacaccacgcgaaaggcgaaaguaggcaaagacaaagaagagacggacuacgugcuaggcaccaucaaggacaucuacagccuagaaggguacgucagcuucaagaaaaucuacaacaaagacaaagccaaauuccucauggccagaauagaccccaagaccuucgagaaacucgagaagauugucgcagaauaccccgaaucuaucgaagugguccaagacaacggcaaaguggauguacaaaagaucaguccauuugagcucuaccgaaaggacaacggauucguaacaaaauucgccaagaaaaacaacggccccgccguaaaaagucuaaaauacuacgacagcaaacucggauccucgaucgacgucacgcccgacaacgcuaaaaauaagaaaguaauccugcaaagccucaaacccuggcgcaccgacguguacuucaacgaagaaaaccaagaguaugagaucaugggccucaaauauuccgacuuaaaauucggcaagaacgggaaauacggcguaccgaagguacgcuacgaggagauuaagcaagaagaagaaauaagcgaaggaagcaaguuccuguucucccucuaccgcggagacaggauuaaagucacaaacgaacuaggagaaaaccucgaccuacuguucuccucccgaacccuaccagcacaaaaaggauacgucgaacucaagccuaucgacaaaacaaaauucgacggcaaagagaaagucuccuucuacgggacggucacacccaacggucaauucgucaagaaauucgcgaagaaaggguacaaaauucucaaacucaauaccgacgaacugggcaacaccuacaucgagaacggcgagaaagaaccauccgacauacuggacauguga

SEQ ID NO: 6268 - RNA, 3366 nt, Artificial Sequence
  Cas9 variant
augaauggucuagugcucggccuagacauaggcauaggcucagucgguguaggcauacucaacaaggacacgggcgaaauaauccacgccaacuccagaaucuucccagccgcaacagcugacaacaacgucguaagacgcucgagcaggcaaggacgacgccuaaaccaccgcaaaaagcacagaaguguccgccucaaagaccuauucgaauauuacgaccuucugacagacuucaguaaaguuagcaucaaccuaaauccguaccgccuccgcgugaacggccuaaaccaacaacugacgaacgaagaauuauucaucgcccucaaaaacaucguaaaacgccgaggcauauccuaccucgacgacgcaucggaagacggcggagccgucuccagcgacuacggaaaagcggucgaagaaaacaggaagcuacuagccgaacaaacgccaggucagauacagcuagagcgguucgagaaguacggucaagucaggggcgacuucacagucguagaaaacggugaaaagcgucggcuaauaaacguauuuagcacuuccgcguacaagaaagaagccgaaagaauccuccggaaacaacaggaguacaacaaccaaauaauggacgaguucauagccgacuaccuuaccauacucaccggaaaacgaaaauacuaucacggacccggaaacgagaaaagccgaaccgauuacggccgcuuccgaaccgacggcacaacccuagacaauaucuucgguauccucauuggaaagugcacuuucuaccccgaaaaauaccgggcaagcaaggccucauacaccgcccaagaguucaaccuccucaacgaucuaaacaaucugacaguccccaccgaaacaaagaaacuuagcgaggaacaaaagaaaacaauagucgaauacgccaagucggccaagacgcuuggggcguccacgcuucuaaaguacaucgcaaaaaugauagacgccucggucgaccaaaucagaggcuaccgggucgacgucaagaacaaaccagaaaugcacaccuucgaagucuacaggaaaaugcaaucacuagaaacaauaucaguaggcgaguucucacgggagguccucgacgaacuagcacauguccuaacccucaauacggagcgcgagggaaucgaggaagccaucaacaccaaacuccgcgacagcuucagccaagaccagauccucgaacucguacaauuccgcaaaaacaauagcucccuguucagcaaaggcuggcacaacuucucgcugaaacucaugauggaacugaucccggaacuauacgagacguccgaggaacagauggcuauauuaacgcgauugggcaagcagaaguucaaggaaaccagcaaacgaacgaaauacauagacgaacaggaagucacggaggaaaucuacaauccaguaguagcaaagucaguaagacaagcgauaaaaauuaucaacgaggccacaaagaaauacggcauauucgauaacauagugauagaaauggcccgagaaaacaacgaagaagaggccaagaaagacuacaucaaacgccaaaaagccaaucacgaugagaaaaacgcagccauggaaaaagcugccuuucaguacaacggagagaaagagcuacccgacucaauauuccacgggcacaaagaacucgcuaccaagguccgacuguggcaccaacaaggcgagaagugcuuauacacgggcaaaaacaucccuaucagcgaccucauccauaaccaauacaaauaugaaaucgaccacauacuaccccugagccuuuccuucgacgacucgcuaucaaacaaaguacucguacucgccaccgccaaccaagaaaagggccagcgcacccccuuccaggcccucgacucaauggacgacgcgugguccuaucgcgaguucaagucauacgucaaagacucgaagucccuaggcaacaaaaagaaagacuaccuccugaccgaagaggacauaucgaaaauagaagucaagcaaaaauucaucgaacgcaaccuggucgacacccgguacuccucccgagucgugcucaacaccuuacaagacuucuacaaagcacacaaguucgacacgacgaucucggucguccgaggacaauucaccagccaacuacgccgcaaaugggggcucgaaaaauccagagagaccuaccaccaccacgccgucgacgcgcucauaaucgcagcuagcucucaacuaagauuauggaagaagcagaacaacccacuaauuagcuacaaagaggggcaauucguggacucagaaacuggagaaaucaucucacucaccgacgacgaguacaaggaacucgucuucaaagccccguacgaucauuuuguagacacacugcgcucaaagaaguucgaggauagcauccuguucagcuaccaagucgacuccaaauucaaccgaaagaucagcgacgccaccaucuacgccaccagaaaaaccaaacucgacaaagacaagagcgaagagacauacgugcucgggaaaaucaaagacauauacucacaguccggguacgacgcauucauuaaaauuuacaacaaagacaaaucgaaguuccucauguaucacaaagauccucaaacguucgagaaaguaaucgaggaaauccuaagaaccuauccgagcaaagaguucaacgaaaagaacaaagaagucagcugcaauccguucgaaaaguacaagcaagaaaauggcccgauccggaaguacucaaagaaaggcaacgggcccgagaucaagucccuaaaguacuacgacaaaaacauuccagaauccuucaucaacauaacccccagcaacaguaaaaauaaagucauacuccggcaacuaaaccccuggcgcaccgacguguacuucaaccaccaaaccgaaaaauaugaacuccuaggacucaaauaugcagaccuacaauuugaaaagaaaaccggaacauacagcaucacaauugauaaguacaacgaaauaaaagaaaaagaaggcgucagcgaacacucagaguucaaauucacgcuguacaaaaacgaccugcugcucaucaaagacacagaaaucaaggaggagcaaaucuuccgcuuuuugucgagaaccaugccaaaccaaaagcacuacguagaacucaaacccuacuacaagggaaacuucgaaggcaaagaaagaauaaagguauucaacacgaccagcaacggccggugccucaagggacuacgcaaaaagggccugucgauauacaaaaucaaaacugacguccuggggaacaaacacuucauaaagaaggagggagagaaaccaaaacucaaauucuga

SEQ ID NO: 6269 - RNA, 3366 nt, Artificial Sequence
  Cas9 variant
auguccgaccuaguccucggccucgacauaggaaucggaagcguaggcgugggcauccuaaacaaagucaccggggagauaauacacaaaaacucccgcauauuccccgcagcccaagccgaaaacaaccucguuagacguacaaaccgccagggccggcgacuaacccgccgaaagaaacacagaauaguacggcugaaccgccuguucgaggaauccgggcuaaucaccgacuucaccaaaauaucaaucaaccucaaccccuaccaacuccgugucaaaggauuaacagacgagcucuccaacgaggaacucuucauagcuuugaaaaacauggugaaacaccgcggcaucucuuaucucgacgacgccagcgacgacggcaacagcuccguuggcgacuacgcccaaauagucaaagaaaacucgaaacagcucgaaaccaaaacucccggacaaauacagcuugaacgcuaccaaacguacggacaacuccgaggagacuuuacaguagaaaaagacggcaagaaacaccggcugaucaacgucuucccaacguccgccuaccgaucagaggcccucagaauacugcagacacaacaagaguucaauccccaaauuaccgacgaguucaucaaccgcuaccucgaaauacugaccggcaaacgcaaauacuaucacggacccggaaacgagaaaagccgcaccgauuacggcagguacaggacguccggcgaaacacucgacaacaucuucggaaucuuaauagguaaaugcacuuuuuaccccgacgaguuccgcgccgcaaaagccagcuacacggcacaagaguucaaccuccucaacgaccugaacaaccucaccguacccacagaaacaaagaaacuaucuaaagaacagaagaaccagaucaucaacuauguuaagaacgaaaaagcuaugggccccgcgaaacuauucaaauacauugcgaagcuacucucaugcgaugucgcugauaucaaggaauaccgcaucgacaaaucaggcaaagcggaaauacacacguucgaagccuaccgcaaaaugaagacccuagaaacccucgacauugagcaaauggaccgggaaacacucgacaaacucgcguacguccuaacacuaaacacagaacgcgaaggaauacaagaggcccucgaacacgaguucgcggaugggagcuucagccagaaacaggucgacgaacucguccaauuccgcaaagccaacuccagcaucuucgggaaaggcuggcauaacuuuagcguaaagcucaugauggaacucauaccggaacucuacgaaacguccgaggaacagaugacgauacuaacccgacucggcaagcagaaaacgacaucauccucaaacaaaacaaaauacaucgacgagaaacugcucacagaggaaauauacaacccaguagucgcgaaauccgugcggcaagccauaaagaucguaaacgcggccaucaaagaauacggcgacuucgacaacaucguaauagaaauggcucgagagacaaacgaagacgacgagaaaaaggccauccaaaagauacaaaaagcaaacaaagacgaaaaggaugcggccauguuaaaagcagcgaaucaauacaacggaaaagccgaacucccucacucagucuuccacggacacaagcaacucgccaccaagauccgacuguggcaccagcagggagaaaggugccuauacaccgggaaaacaauaagcauccacgaccuaauuaacaacucgaaccaauucgaagucgaccacauccucccccuguccaucacguucgacgacucacucgccaacaaaguccucgucuacgccacagcaaaucaagaaaaaggccagcggacacccuaccaagcacucgacagcauggacgacgccugguccuuccgcgaacucaaggcguucguacgagaaagcaaaacccuaagcaacaagaagaaggaauaccuccuaacagaagaagacaucagcaaauuugacguacgcaagaaauucauagaacgaaaucugguagacacacgguacgcgucacgcgucguucuuaacgcacuacaagagcacuuuagagcgcauaaaauagacacaaaagucuccgugguaaggggacaauucaccagccagcugcgccgacacuggggaauugagaaaacccgggacaccuaccaccaucacgcagucgacgccuuaauaauagcagcgucaauucagcugaaccuguggaagaaacagaaaaacacccucgucucauacagcgaggaccaacuccucgacauugaaaccggcgagcugauuucugacgacgaguacaaggaaagcgucuucaaggcucccuaccaacacuucguagacacucucaaaagcaaagaguucgaagacuccauacuauucagcuaccaaguagacucaaaguucaaccgaaaaauuucagacgccaccaucuacgccaccagacaagccaaggugggaaaagacaaagccgacgaaaccuacguccucgggaagauaaaagacauauauacacaggacggcuacgacgcauucaugaagaucuacaagaaggauaaaagcaaauuucucauguauagacacgacccccagacauucgaaaaagucauagaacccauccuggaaaacuaccccaacaaacaaauaaacgaaaaaggaaaagaaguccccgucaacccguuccucaaauacaaagaggaacacggcuacauccgcaaguauagcaagaaaggaaacggcccagagaucaagucacugaaguacuacgacucgaaacucgggaaccacaucgacauaacacccaaggacuccaacaacaaagugguacuacaaagcgucagcccauggagagccgaugucuacuucaacaaaaccaccggcaaguacgagauccugggacucaaauacgcagaccuacaauuugagaaaggaacaggcacuuacaaaaucagccaagaaaaauacaaugacauaaagaagaaagaaggagucgacucggacuccgaguucaaauucacccuuuacaaaaacgaccuacucuuaguaaaagacaccgaaacgaaagaacaacaauuauuccgcuuucuaagccggacuaugccaaaacagaaacacuacguagagcugaagccauaugacaaacaaaaauucgaaggcggcgaagcacucaucaaaguccuagggaacguagcgaauagcggacagugcaagaaagggcugggcaaaagcaacaucuccaucuacaaaguacggaccgacguucucggcaaccaacacauaaucaaaaacgaaggcgacaaaccaaaacucgacuucuga

SEQ ID NO: 6270 - RNA, 3366 nt, Artificial Sequence
  Cas9 variant
augaacggacugguccugggccuugacauuggcauagcuagcguuggagucgggauacuugagaagaacucagggaagaucauccacgcaaacagcagacucuuccccgcagccaccgcggacaacaacguagaacgacgcaagaacagacaagcccgcaggcugaaccgccgcaagaaacaccgaggggugcgcuuucaagaccucuucgaggacuacggccuacuaacagacuucaguaaaguuucaaucaaccucaaccccuaccgacucaggguagacggccucaaccagcagcuaacuaacgaggagcuauucaucgcgcucaagaacauuguaaaaagaagagggaucuccuaccucgacgacgcaagcgaagacgggggcgcggucucaagcgacuacggaaaagcaguagaagagaacagaaagcuccuagccgagcaaacccccggacagauacaacuggaacgauucgagaaauacggccaaguccgcggggacuucaccguagucgagaacggcgagaaaugucgauuaaucaacguauucagcacaagcgcguaccggaaggaagccgagaaaauccucagaaaacaacaagaguucaacaaccaaaucaccgaugaguucauagaagacuaucugaagauucuuacggguaagagaaaguacuaccacggacccggaaacgaaaaauccaggacagacuacggccgguuucgaaccgacggcacaacgcucgacaacauauucggcguccucaucggcaaaugcaccuucuacccgaacgaguaccgagccagcaagagcuccuacacggcccaagaguucaaucugcugaacgaucugaauaaccugaccguacccacagaaacgaagaaacuaagugaagaacaaaagaaagucauaguagaauacgcgaaagaggccaaaacacucggcgcgagcacgcuccuuaaguacaucgucaaaaugaucgaugcuagcgucgaccaaauaucgggcuaccgggucgacgucaacaacaaaccagaaaugcacaccuucgaagucuaccggaaaaugcaaagccucgagaccaucuccgucggagaacucagcaggaacgucuuggacgagcuagcacacauacucacacugaacacggagagagaaggaauugaagaggcaaucaacuccaaauuaaugggaguguuuucccaggaccaggucuuagagcucguccaguucagaaagaauaacuccagccuauucaguaaaggcuggcacaacuucagccuaaaacucaugauggaacuaauaccagaacuguacgaaacuucggaagaacaaaugaccauacugacccgacuaggcaaacaaaaauccaaagaaaccuccaaacggacuaaauacaucgacgaaaaagaacucaccgaggaaaucuacaaccccgucguagcgaaguccguaaggcaagccauaaaaauuauuaacgaagccacgaagaaacacggcauauuugacaacaucguaauagaaauggcacgagaaaacaaugaagaggacgccaagaaagacuacauaaaaagacagaaagcaaaccaggacgagaaaaacgccgccauggaaaaagccgcguuccaauacaacggcaagaaggagcuaccagggaacauauucaacgggcacaaagagcuggccaccaagauaagacuauggcaccagcagggcgagaaaugccucuacaccggcaaaaccauacccauuagcgaccucauucacaaccaauacaaguacgagaucgaucacauccugccgcuaucgcugagcuucgacgacagccuaagcaacaaaguacucgugcacgcuacugccaaccaggaaaagggccaacgaacaccguuccaagcgcuggacuccauggacgacgccuggucguaucgugaguucaaaucauacgucaaggaccugaaaagucuauccaacaagaagaaagacuaccuccucaccgaggaagauaucagcaaaaucgaagugaaacagaaauucaucgaacgcaaccuaguugauacccgguacagcucaagagucguacucaacgcacuccaagacuucuacaagucccaccaauucgacacaaccaucagugucguacggggccaguuuacgucccaacugagacgaaaauggggauuggagaaaagcagagaaacuuaccaccaucaugcggucgacgcgcuaaucaucgcggccucgucgcagcugcgccuguggaagaaacaaaacaauccccugauaaccuacaaagaaggccaauucguagacucgcagaccggcgaaauaauaagccuaacagacgacgaauacaaagaacucgucuucaaggcgccauacgaccacuucgucgacacccuccacucaaagacguucgaagacgggauccucuucagcuaccaaguggacuccaaguacaacagaaagauaagcgacgccaccaucuacgccacgcgaaaagccaagcuagacaaagacaaaagcgaagagacguacguacuggggaagaucaaggacaucuacagccaagcaggauacgacgccuucaucaaaauauacaacaaagauaagcgaaaauucuuaauguaccacaaggacccccaaacauucgaaaaagucaucgaggaaauccuacguacguacccaaguaaagaacgcaacgacaagaacaaggaaguaccaugcaacccguucgaaaaauaccgccaagagaacgggccaaucaggaaauacagcaagaaaggcaacgggccggagaucaaaugccucaaauacuacgacaacaaacugggaaacuauauagacauaaguccggacggcucugacaaucagguaguccuccaaagccuaaaacccuggagaacagacgucuacuuuaaccaccaaacaaaggaauacgaacucaugggccucaaguacuccgaccuuucuuuugagaaagggaguggaaaauacagcaucagcaacgaaaaauacaacagcaucaaacggaucgaaggaguaaacgaacaaagcgaguucaaguucacccuauacaaaaacgaccugauccucauaaaagauagcgaaaacaacgaacagaaacuguuccgcuucaauagccguaaugacacugcgaagcacuacgucgaauuaaaacccuacgacaaagcacgcuucgacggccaacaggaacucauaacaauacucggcaacgucgccaaagguggccaaugccugaagggacucaacaaauccaauauaagcaucuucaaaguuaaaaccgacguccuaggaaagaaacauauaaucaagaaagaaggagacgaaccaaaacucaaauucuga

SEQ ID NO: 6271 - RNA, 3366 nt, Artificial Sequence
  Cas9 variant
auggcagacaaaacacucggcgcccucacauuugguuucgauauuggcaucgccagcguaggauggugcguacuaggcgagaaccgaauaguggaccuaggggucagagccuucgacaaggccgaaacugcaaaagagggggagucacugaaccuagcaagacgaaccgcgcgacucaugcgcaggcgauuacgcagacgggccuggcgauugacaaaacuagcacggcuacuuaaacgcgaaggacucaucgcagacgccuuccaaaugcaccaaccuucggccacguccccguggaaacucaggguagaagcgcuagaucgaagacucacagacgacgaaugggcccgggucauauaccaucucugcaaacaccgcggcuuccacuggauaagccgagcugaagaaaagaaagcagaaggagacgccaaaggagaaagcggacgcguaaagaaaggacuaagcgacacccagcggcgaaugggagaaaaaggcuaccgcucagcggccgaaaugguccuugcagaguucccggaagcacaaaggaacaaacaaggcgacuacggaaaagcacucucaagaguccuacuaagcgaggaacuggccuuacuauucagacgucaacgggaacugggacacacacacgccagcaaagaacucgaagcagcaauccuuggcaacggggaccgcaaaggcggauuguuuugggcccaaaaaccgccacuagcaggggcggaccuucuaaaaaugcuuggaaagugcaccuucgagaaagacgaguaccgcgccccgaaagcgagcuucacagccgaacgacacguguggcuaaccagauuaaacaaccuacgaguaguagucgacgggacaacgcguccccuaacagaggacgagagacgcguagcccuaccacuaccauacggguacgccgacgcgaagcucaccuacaaacaacuacgagcagcucuaagcaaagcaggccuaucgaacuucuccuucgcaggcauugcagacgauaaggaaaaggacacacuuacaaaacuacccgccugggaaacacucuccaaaacacuaaaagggaagggccuggaaacagagugggaagguauggcgggggcagccacugguggggaccccacccuacucgacgagauaucaagagugcugucaguauacaaagacggcgacgaggucgauguagaacuacggaaauuaccacuaccaggcggcgaaaagaugguagaaacgcucagugaaaucucuuucgacaaauuccacgcacucucauugaaggcucuccgaaaaauaguuccacacauggaaacaggacuacguuacgacgaagcgugcgccgccgccggauaccaccacucccaacuacaugaagccggagcuggagggcaaaaguaccucccaccguucuauacccggagagacaaagacggacgcaugguauucgaugaggagcucgacguaccacgcaaccccguaguauugcgugcacucaaccaagcucggaaaguucucaacgcccuaguaagagcauacggaucaccaucagccguacauaucgaaauggcccgggauuuaagcaaaccccuaguaggccacccgacgcccaacggcggguacauagaaggaagaagagacauagagaagcuacaaaaagaguaccgcgaaaggaacgaaaaagacaaagcagcauucgcggcagaacauggcauagccgcgaagucacgcgaguucgaaaaauuccaacuauauagagaacagcaaggcaagugugcauacagccugaaaccauuagaccuacacagaguccuacacgauauaggauacgcagaaguugaccacgcucuccccuacucgcggucauacgacgauggcaaaaacaacaaaguccuaguacugacagaagaaaaccgcaacaaaggaaauagaacagcguacgaguaucuaugcgccuucccggguggggagaacggcgagcgauggcgaaacuuugucgcuuacgucgaaagcaacaaaucguacaggcucgcaaaaagaacucggcuccugcgaaaggacuucggaggcaaagcugcagaggaguucagggaaaggaaccugaacgauacccgcuacauaugcaaguuuuucaagaacuucgucgaacgauuccuacaacuaaaaguaggggccgacggcaccgcggccaaacgaugcguaguccuaucagggcaaaccacagccuuccugagagccagauggggccuacucaaggucaggggagccagcgaccgacaccacgccuuagacgcggccgucgucgcagccugcagucacggaauggugaaaagacuggccgauuacuccagaacuaaggaacuggcaaaagucagggauggauuccccgauccggaaacgggagagauaguggacccagcaauguuucaacagcuacacgcacacuucccagacccguggccccacuuccggggcgagcuagaagcacgacugcagcucgacgacagcgcagaacugcgagcccaacuagagauguuuggaacauacccugcagaggcacuagaaacacugcggccccuguucguaagcagagccccgcaaagacgcaauggaggagcagcccacaaggaaacaauauacgcacaaccggaacggcucaaagaacaaggaggcguaacacaaaaagucagccuggcaucccucaaaccaaccgacauagacaaacuaauagacccacacaggaacgagaagcuguacgcagcaauacgggcacgacuagaagcccacgggggcaagagugacaaggcauucccagcggacaacccccuacgaaaaccagacagagacggaaaccccaccggcccaauaguaagagccguaacgauggugauagacaaacucuccggaauccagauccgcggaggaauagccaaaaacgauaccaugcucagaguagacguauuccggcacaagaaagacggaaaauuccacuuagugccacuauauguacaccacgccgucgcccaagaacuaccaaauagagcuaucgucgcauucaaagacgaagacgaauggacccucauagacgacaacuuccauuuccuauucuccuuccacccgaacgacuucauccgaauaacgcagaaaaauaaagcccccauacucggauacuacgcgagcugccaucgcggaacgggcaaccuaaaccugugggcgcacgauaggaaccaaaaagucggaaaagacgggcaaauagaaggaauaggcguaaaaacggcggucgcacucgaaaaauuccaugucgacguucuaggaaacauauauccugcaccacccgaacaaagacacggacucgcauga

SEQ ID NO: 6272 - RNA, 3366 nt, Artificial Sequence
  Cas9 variant
augucagaccuaguucucggccuggacaucgggaucgggucaguaggcgucggcauccuaaauaaagucacgggcgaaaucauacacaaaaacuccaggauuuucccagcggcgcaggccgaaaacaaccucguacgccgaacgaacagacagggccggcgccugacucgccgaaagaaacaccgccgaguccgacucaaucgccuauucgaagaauccggacucaucacagacuucaccaaaaucagcaucaaccuaaacccauaucaauugcggguaaaaggcuuaacagacgaacucuccaaugaggaacuauucaucgcacugaaaaacaugguaaaacaccgagggaucagcuaccuugacgacgcgucggacgacggcaauuccuccguaggcgacuacgcacagauaguaaaagagaauagcaagcaacuggaaacgaagaccccgggccagauacaacuggaacgcuaccaaacauacggucaacuaagaggggacuucaccguagaaaaagacggaaagaaacaccgguuaaucaacgucuuccccaccucggccuaccgcagcgaagcucuccgaauacuacagacccagcaagaguucaauccgcaaaucacagacgaauuuauaaaccgguaccuagaaauccuaaccggcaaacggaaauacuaccacggaccuggcaacgagaaaagucgcacugacuauggccgauaccgaacaagcggcgaaacccuagacaacauauucggcauacucaucgggaaaugcaccuucuaccccgacgaguuccgcgccgccaaagccuccuacacagcacaagaguucaaccuacucaaugaccucaacaaccucaccgucccaacagaaaccaaaaagcuaaguaaggaacagaaaaaccaaauaauaaauuacguaaagaacgaaaaagccaugggccccgccaaacucuucaaguacaucgccaaacuacuuuccugcgacgucgccgacaucaaaggguacagaaucgacaaaagcggcaaagcugaaauccacaccuucgaagcauaucggaaaaugaaaacacucgaaacucucgacaucgaacagauggaccgcgaaacacucgacaaguuagcauacguacuuacucuaaacaccgagagagaaggcauccaagaagcccucgaacacgaguucgcagacggcuccuucucccaaaagcaaguggacgaacucguacaauuccguaaggcgaacuccucaaucuucggaaaaggauggcauaacuucagcgucaaacucaugauggaacucaucccagaauuauacgagaccagcgaggaacagaugaccauacuaacccggcuaggaaagcagaaaaccaccagcagcagcaacaaaaccaaauacauagacgaaaaacuauuaaccgaggaaauuuacaauccagucgucgcaaaaagcguccgccaagcaauaaaaauagugaaugccgcaaucaaagaguacggagacuucgacaacaucgucaucgaaauggcgcgcgaaacgaaugaagacgacgaaaagaaagccauacagaaaauccaaaaagcuaacaaagacgagaaggacgcggccaugcuaaaagcggcaaaccaauacaacggcaaagcagaacucccacacucggucuuccacgggcacaaacaacuagcaacgaaaauacggcucuggcaccaacaaggagaacguugccucuacacaggcaagaccaucuccauacacgaccugaucaacaacagcaaucaauucgaaguagaccacauccucccacucagcaucacguucgacgacagccuugcuaacaaaguacucgucuacgccaccgcaaaccaagaaaaggggcaacgaaccccauaccaagcccuagacucgauggacgacgccugguccuuccgcgagcugaaggccuucguacgagagagcaaaacacucucgaacaaaaagaaagaguaucuccucacugaagaagacaucagcaaauucgacgugcggaagaaauuuauagaaagaaaccucguggacacgcgauacgccucaagggucguacuaaacgcucuacaagagcacuuccgagcccacaagauagacacgaaaguuucaguaguacgcggucaguuuaccagccagcuacgacggcacuggggaaucgagaaaacucgugacacuuaccaccaccaugcaguagacgcccugaucaucgccgcaucgagucagcucaaucuauggaagaaacagaaaaacacucugguauccuacuccgaagaucaacuguuagacaucgaaacaggcgaacugaucuccgacgacgaauacaaagaaagcgucuucaaggccccguaccagcacuucgucgacacacugaaauccaaggaguucgaagacagcauacuuuucagcuaucaggucgacagcaaauuuaacagaaagaucuccgacgccacaauuuacgccacacgccaagccaagguaggcaaagacaaggccgacgaaacuuacguacucggcaagauaaaggacaucuacacacaagacggauaugacgcauuuaugaagaucuacaagaaagacaaaagcaaguuucuuauguaccgccacgacccacagaccuucgaaaaagugauagaaccgauacucgaaaacuaccccaacaagcaaaucaacgaaaagggcaaagagguacccugcaacccguuccuaaaauacaaagaggaacauggguacauacgaaaauacagcaagaaagggaacgguccugaaauaaagucccucaaguacuacgacucaaagcuaggcaaccacaucgacaucacaccgaaagacuccaacaacaaagucguccuccagagcgugucccccuggcgagcagaugucuacuucaacaaaacaacuggcaaauacgaaauccuuggccucaaauacgcggaccuacaauucgagaagggaacaggaaccuacaaaauuucccaagagaaauacaaugacaucaaaaagaaagagggcguagacucagauucagaguucaaauuuacccucuacaaaaacgaccuccuccuggucaaagacacagaaaccaaagaacaacagcucuuucgcuuccugucacgcaccaugccaaaacagaaacacuacguggaacuaaaaccauacgauaaacaaaaauucgaaggcggugaagcacucauaaaaguccucggaaacgucgcaaacucaggccaaugcaagaaaggccuagggaaaagcaacaucaguaucuacaaagugaggacggacgugcucggcaaccagcacauaaucaaaaaugagggggacaaacccaaacucgacuucuga

SEQ ID NO: 6273 - RNA, 3366 nt, Artificial Sequence
  Cas9 variant
augaacggacucgugcugggacucgacauuggcaucggaucugucggagugggcauacuaaacaaagacaccggagagaucauccacgcaaacagccggaucuucccggccgcaaccgcggauaacaacgucguacgccggucaagcagacagggacgccgccuaaaccaccgcaagaaacaccgcagcgucagacuaaaagaccucuucgaguauuacgaccuacugacggacuucagcaaagugaguauaaaccucaaccccuaucgccuccgcguagacgggcucaaccaacagcucaccaacgaagaacucuucaucgccuuaaagaacauuguaaaacgccgcggcaucagcuaccuagacgacgccucagaagacggcggugccgucucaagcgacuacggcaaagcagucgaagagaaccgcaaacuccuggcggagcaaacucccggacagauccaacucgagcgauucgagaaauacggccaaguccgaggcgacuucacaguggucgaaaacggcgaaaagaggcgccucaucaaugucuucuccacuagcgcguacaagaaagaggccgaacggauacuuaggaaacagcaggaguacaacaaucaaaucauggacgaguucaucgccgacuacuuaacgauacucaccgggaaaagaaaauacuaccacggcccggguaacgagaaaagucgaaccgacuacggacguuucagaaccgaugggaccacccuugacaacauauucgguauccucaucggaaagugcaccuucuaccccgaagaauaccgcgcauccaaagccagcuacacagcccaagaguucaaccuccuaaaugaccucaacaaccugacaguaccgaccgaaacgaagaaacucagcgaagaacagaagaaaacaaucguagaauacgccaaaagcgcgaaaacccucggggccagcacccuccugaaauacaucgcuaaaaugaucgacgccagcgucgaccaaauccgaggcuacagagucgacgucaacaacaagcccgaaaugcacaccuucgaagucuauagaaaaaugcaacuccuggaaacaauccccgucggcgaguucucccgugaaguacucgacgaacuagcgcacaucuugacgcugaauaccgagcgcgaagggauagaagaagcaaucaacacgaaacuuauggacgucuuuagccaggaccaaauccuggagcuaguccaauuccgaaagaacaacuccucccucuuuucaaaaggcuggcacaacuucagcuuaaaacuaaugaucgaacucauaccagaacucuacgaaacaagcgaagaacaaauggcaauacucacccgacucggaaaacaaaaauucaaagaaacuucaaaacgcacgaaauacauugacgagcaagaagucaccgaagaaaucuacaauccgguaguugcaaaaagcgugcgccaggcgauaaagaucaucaacgaagcaaccaagaaauacggcaucuucgauaacaucguaauagaaauggcucgcgagaacaacgaggaagaggccaagaaagacuacauuaaacggcaaaaagccaaccaugacgagaaaaacgccgccauggagaaagcagcauuccaauacaacggagaaaaagaacucccugacuccauauuccacgggcauaaagaacuagccacaaaaguccggcucuggcaccaacaaggggaaaaaugccuauauaccgguaaaaacauacccaucucagaccucauacacaaucaauauaaguaugagaucgaccacauccucccccucucccucagcuuugacgacagccuaucgaauaagguccuaguccuagccacagcaaaccaggagaaaggacgccgaaccccauuccaagcccuagacagcauggacgacgccuggagcuaccgggaauuuaaauccuacgugaaagacuccaaaucacucgguaacaaaaagaaagacuaccuucugacagaggaagacauaagcaaaaucgaaguaaaacaaaaauucaucgaacggaaucuaguagauacucgauacagcucacggguaguacucaacacacuacaagauuucuacaaagcccacaaauucgacacaaccaucaguguagugagaggucaauucacaucccaacugcgaaggaaauggggacuagaaaagagccgcgagacauaccaccaccacgccgucgacgccuuaauaauagcggcaagcucacaacucagacuuuggaagaaacagaacaacccgcucaucagcuacaaagaaggacaauucguugacagcgaaaccggcgagauaauaagccugacggacgacgaauacaaagagcuaguauucaaagcccccuacgaccacuucguagacacacucagaucgaagaaguucgaagacucaauacucuucagcuaccaagucgacagcaaauucaacagaaaaauaucugacgccacaaucuacgccacacgaaaagcgaaacuggacaaggacaaauccgaggaaaccuacguucuaggaaaaaucaaagauaucuacucccaaucaggauaugacgcauucaucaaaauauacaacaaagacaaaagcaaauuccuaauguaccacaaagacccacaaaccuucgaaaaagucaucgaggaaaucuuacgcacauacccaucuaaagaguucaacgagaaaaacaaagaaguuucuugcaacccauucgaaaaguacaaacaggaaaacggcccaauucgaaaguacagcaagaaaggcaacggacccgaaauaaaaucccucaaauacuacgacaaaaacauccccgagagcuuuaucaacaucacccccagcaacucgaaaaacaaagucauacugaggcagcucaaccccuggcguacggacguguacuucaaccaucaaacggaaaaauacgagcugcuuggacucaaauacgccgaccuccaguuugaaaagaaaaccgggacuuacuccauaacaaucgacaaauacaacgaaaucaaagagaaagaaggcgucucugaacacucagaguucaaauucacacuauauaaaaacgaccuacuacuaaucaaagacacggaaaucaaagaagaacaaaucuucagauuccucucacggaccaugccaaaucagaaacacuacguggaacucaaacccuacuacaaaggaaacuuugaaggcaaagaacguaucaagguauucaauacaacaagcaacggccgcugucucaaaggacucagaaagaaagggcucucgaucuacaaaaucaaaacagacguacucgggaacaaacacuucaucaagaaagaaggcgagaaacccaaacugaaauucuga

SEQ ID NO: 6274 - RNA, 3369 nt, Artificial Sequence
  Cas9 variant
augaacggcaagauccucggacuugacauaggcguagcaucagucggagucgggauccuggacaaaaagacaggagaaauaauccacgccagcucccggaucuucccagcagcgaccgcagauucaaauguggaacgccgcggguucagacaagggcgcagauugggaagaagaaagaaacaucggaagguccgccuagcugaccuguucagcgacacgggacucauaacggacuucagcaagguaagcauaaaccuaaacccuuacgagcuaagaauaaaagggcuuaacgaaaaacugacaaaugaagaacuauucaucgcgcucaagaacauuguaaagcggcgaggaaucagcuaccuugaugacgccaacgaagacggagaauccagcucgagcgaauaugggaaagcagucgaggaaaaccggaaacuacucgcugacaagacgccuggccaaauccagcuggaaagauucgagaaauacggccaaguacgaggagauuucacaauagaggaaaacggcgagaaacaccgccuacuaaacguguucaguacgucggcauacaagaaagaagcagagcgaauccucacgaaacaacaagacuacaaccaggacaucaccgaugaguucauccaagcauaccucaccauccucacgggcaaacgaaaauacuaccacgggccgggcaacgaaaagagccggacagacuacggcagauucagaaccgacggcaccacgcuagacaacaucuucgggauacugauaggaaaaugcacguucuacccagaagaauaccgcgcagcaaaagccucguacaccgcccaagaguucaaccuccuaaacgacuuaaauaaucugacaguccccaccgaaacaaagaaacuauccgaggagcaaaaacggcaaauaaucgaauacgccaaaggagccaaaacacuaggcgccgccacccuccuaaaauauauagccaagcuagucgacggcuccgucgaagacauaaaaggcuaccgaauagacaaaagcgagaaacccgaaaugcacaccuucgacauauaccgaaaaaugcaaaccuuggaaacggucgacgucgagaaguugagccgagaaguccuagaugaacuagcgcacauccucacacucaauacagaacgagagggaauugaagaagcaauaaaagugagcuucauuaagcgagaguucgaacaggaccaaauagccgaacucguaucuuucagaaaaagcaacucaucacuauucggaaagggauggcauaacuucucgaucaagcucaugacggaacuaauaccagaacucuacgagacgagcgaggaacaaaugacuauacugacacgccugggaaagcagaaaacgaaagcacgaagcaagcgaacaaaguacauagacgaaaaggagcuaacagacgaaaucuacaaccccguaguagcgaaguccguccggcaagccauaaaaauaauaaaccuggcgacuaagaaauacggcgucuucgacaacauaguaaucgaaauggcacgagaaaacaacgaagaggaugccaagaaagacuacguaaaacggcagaaagcgaacgaagacgagaaaaacgccgccauggaaaaggcagcccaccaauacaacgguaagaaagagcuacccgacaacguuuuccacggccacaaagaacuggcaaccaaaaucaggcucuggcaccaacagggcgagaaaugccucuauacagggaaaaacaucccgaucuccgaccuaauacacaaccaauacaaauacgaaauugaccacauccucccccugucacuaucguucgaugacagccuugccaauaaaguccuuguccucgcaacagccaaccaggaaaaagggcagcggacccccuuccaggcucucgacagcauggacgacgccuggucuuaccgagaauuuaaagccuacguccgaggggcaagggcccucagcaacaagaagaaagacuaccugcuaaaugaggaggacauuaacaaaaucgaagucaaacaaaaauuuaucgagagaaaccucgucgacacgagguacuccagcagggucguacucaacgcccuccaagacuucuacaaacuaaacgacuucgacaccaaaaucuccgugguccgaggccaauucacgucacaacuacgccgaaaauggagaauagacaagagccgggaaacauaccaccaccacgcugucgacgcgcucaucauagcagccuccagccaacugaggcuauggaagaaacaaggaaacccucugauaaguuauaaagaaaaucaguucguggacagcgaaacaggcgagauaauaagccugaccgacgaugaguacaaagagcuaguauuccgagcgccguacgaccacuucguagacacaguaucaagcaagaaauucgaagaccggauccuauucagcuaccagguagacuccaaauacaacaggaaaaucagugacgcaaccauuuacagcacacgaaaggcaaaacuaggaaaggacaaaucggaggagacauacgucuuaggaaaaaucaaagacaucuacacccagacaggguacgacgcguucauaaagcucuacaaaaaggauaagucaaaauuucucauguaccacaaagaccccauaaccuucgaaaaagucauagaggagauucugaaaacguaccccgauaaagaaauaaaugaaaaggggaaagagguagccugcaaccccuucgagaaauaccggcaagaaaacggcccacugcguaaauacuccaaaaagggcaagggcccggaaaucaaaaguuuaaaguacuacgacaacaaacucggaaaucacaucgacauaacacccgacaacuccgaaaaccaaguuauacugcagagucuaaaacccuggcgaaccgaugucuacuucaaccacaaaacuaaaauauacgagcucaugggccuaaaauacagcgaccuaucguucgaaaagggcuccgggaaauacaggauaucccuagacaaauacaacgugauaaagaagaaagagggcguucacaaagagagcgaguucaaguucacccuguacaaaaaugaccucauccucaucaaagaccucgagaaaagcgaacagcagcuguuccgauacaauagccggaaugauacaucaaaacacuacguagaacucaagccguacgacaaagccaaauucgaaggaaaucaaccacucauggcccuauucggaaacgucgccaaagggggccaaugccugaaaggacucaacaaggcaaacaucagcauauacaaaguacaaaccgacgugcuaggaaauaagcgcuucaucaagaaagaaggggaugcccccaaacucgaauuuuga

SEQ ID NO: 6275 - RNA, 3369 nt, Artificial Sequence
  Cas9 variant
auguccgaccucguacuaggccucgacaucggcaucgguagcgucgggguuggcauucucaacaaaguaacgggagaaauaauccacaaaaacagcagaaucuuccccgcggcccaagcagaaaauaaccuuguucgucgaaccaaccgccaagggagacgacuaacccgcagaaagaaacaucgaauagugcgacuuaauagacucuucgaagaguccggccucaucaccgacuuuaccaaaaucuccaucaacuugaacccauaucaacucagaguaaaaggacucacagacgagcucuccaacgaagaacuauucauagcucuaaagaauaugguaaaacacagaggaaucaguuacuuagacgacgccagcgacgacggaaacucaagugugggagacuacgcucaaaucgucaaagaaaacucgaaacaacuagagacaaaaacccccggccaaauccaacucgaacgauaccaaacauacgggcaacugcgaggggacuucacggucgaaaaggacggcaagaaacaccgucucauaaaugucuuucccacaagugcguacagaagcgaagcacuccgcauccuacaaacccaacaagaguucaacucacaaaucaccgaugaauuuaucaaccgcuaccucgaaauccuaacaggcaaacgaaaauacuaccacggccccggaaacgagaaaagccgcaccgacuacggcagauaccgcaccaacggcgagacacuagacaauauauucggcauccuaauuggaaaaugcacauucuaccccgacgaguuccgugcggcaaaggccucauacacagcucaagaguucaaccugcucaaugaccugaacaaccucaccguacccaccgaaacaaagaaacuaucgaaagaacagaaaaaccaaauuauaaauuauguuaaaaacgaaaaaguaaugggaccggccaaacuguucaaauacaucgcuaagcuccucaguugcgacgucgccgacauuaaaggacaccgcaucgauaaaagcggcaaagccgaaauccacaccuucgaagccuaucggaaaaugaaaacccucgaaacccucgauauagaacagauggaccgcgaaacccuggacaaguuagccuacguacuaaccuugaacacagaaagagaagggauacaagaagcccuugaacacgaauuugcggacggcagcuuuagccaaaaacaagucgacgaacucguucaauuccgcaaagccaacuccuccaucuucggaaaaggguggcacaacuucucagucaaacucaugauggaacuaaucccagagcuauacgaaaccagcgaagaacaaaugacaauccuaacacggcuuggcaagcagaaaacaaccagcagcagcaacaaaaccaaauacaucgacgaaaagcuguuaacagaagaaaucuacaaccccgucguagcaaagagcguacgccaagccaucaaaaucguaaacgcagccaucaaagaauauggugacuuugacaacauagucaucgaaauggcccgugaaaccaacgaggaugaugaaaagaaggcaauacagaaaauacaaaaagccaacaaagacgaaaaggacgccgccaugcuaaaagcggcgaaccaauacaauggcaaagcugagcuaccccacucagucuuccacggacacaaacaacuggccacaaaaauccgccuguggcaccagcaaggggaacgaugccucuacacagggaagacuaucuccauccacgaccuaaucaauaaccccaaccaguucgaaguggaccacauccucccccucuccauaacguucgacgacucacucgccaacaaaguccuggucuacgccacggccaaccaggagaaaggccagcgcacgccauaccaagcccuagacagcauggacgacgcaugguccuuccgcgaacuaaaggccuucgugcgagaaagcaagacccucuccaauaagaagaaagaauacuugcucaccgaagaagacaucagcaaauucgaugugaggaagaaauucauagaacgcaaccuugucgacacccgcuacgcaagccgcguuguucucaacgcacuccaggaacacuuccgggcacacaaaauagacacaaaagucuccguaguccgaggacaauucacaucgcagcuacgccgccacuggggcaucgagaaaacacgggacaccuaccaucaccacgccgucgacgcauuaaucauagcugccucgagccagcucaaccuauggaagaaacagaaaaacacacucguaagcuacuccgaggaacaacuccuggacauagaaacaggagaguuaauaagcgacgaugaguacaaagagagcguauucaaagcaccauaucagcacuucgucgauacuuuaaaauccaaggaguucgaagacuccauauuauuuucauaccaggucgacagcaaauucaaccgaaaaauaucagacgcaacaaucuacgcgacccggcaggccaaagucggcaaagacaagaaagacgagaccuacguacugggcaaaauaaaggacauauacacccaggacggguaugacgcauuuaugaaaauauacaagaaagacaaaucgaaauuucuaauguacagacacgauccgcaaacauucgaaaaaguuauagaaccgauccuggaaaacuacccaaacaaagaaaugaacgaaaaaggcaaggaaguaccaugcaaccccuuccuaaaauauaaagaagaacacggcuacauaagaaaauacucuaagaaaggcaaugggccggaaauaaaaucccugaaauauuacgacucuaaacuccucgggaacccgaucgacaucaccccagagaacagcaaaaacaaaguaguccugcagucacucaagcccuggcgcaccgacguguacuucaacaaaaauacgggaaaguacgaaauacucgguuuaaaauacgccgaccuccaauucgagaagaaaacgggcaccuacaaaaucagccaagagaaauacaacggcauaaugaaagaagaagggguagacuccgacucggaguucaaauucacucucuacaaaaacgaccucuuauugguaaaagacaccgaaaccaaagaacagcaacucuucagauuccuaucccgcaccaugccgaacgucaaguacuacgucgaguugaagccauacaguaaagacaaauucgagaaaaaugaaucgcuaauagaaauccuuggcuccgccgacaagagcggaagauguauuaaaggccugggcaagagcaacauaucaauauacaaggucagaacagacgugcucgggaaccagcacauaaucaaaaacgaaggcgacaaacccaagcucgauuucuga

SEQ ID NO: 6276 - RNA, 3369 nt, Artificial Sequence
  Cas9 variant
augagcaacggcaaaauacuuggacucgacaucggcauagcauccgucggaguaggcguaaucgaugcacagaccggagaaaucauccacgcaagcagccgaaucuucccaucggcgaacgcugcuaacaacgcagaacggagaacguucagaggaucacgcaggcuaauccgacgcaagaaacacagaaucaaacgccucgacgaccuauucaacgacuuccacauaaaccuugacggcgagaugucaaccgauaaccccuacguucugcgcgugaaaggccucagccaaaaauuaacuguagaagaacucuacaucuccaucaaaaacaucaugaaacgcaggggcaucucauaccuagacgacgcagaauccgacaaugaagccggccguagugacuacgcaaaagccauagagcguaaccgacaacuccucacgagcaagaccccaggagagauacaacuugaaaggcucgagaaguauggacagcugaggggcaacuucaccaucaucgaugaagaaggacaaucccaacagauaaucaacguauucucaaccagcgauuacgucaaggaaguggaaaagauccucgacugccagaaaauguaccacaaauucaucagcgacgaauuuugcgacaaauuaauagaacuacugcgagaaaagagaaaauacuacguaggcccagggaacgaaaaaucccguaccgacuacgggaucuaccgaaccgacgggacgacucucgaaaaccuauucggcauccuaauagguaaaugcaccuucuacccggaccaauacagaucgagucgcgcaagcuauaccgcccaagaguucaacuuccucaacgaucucaacaaucuaaccguaccuaccgaaacaaagaaacuaagucaggagcagaaagaguuccucguaaacuacgcaaaagaaacaagcguacuuggcgccggaaaaauccuccaacagaucgccaaacuggccgauugcaaagucgaagacauccgaggauaccggcucgacaacaaagacaaacccgaacuacacaucuucgaaaccuaucgggcaaugaaaggccugguaccgcucgucgacauaggcguacugucccgugagcaacuggacauccucgcagauaucuuaacgcuaaacaccgacuucgaaggcauacgggaagcccucaaaaagcagcucccaaacgucuuugacgaaaagcaaguuaaggguuuggccagcuucagaaagagcaagucccaacuauucgccaaaggguggcacaaccucucgcagaaaaucaugcuagaaguaauaccggagcuguacgccacgucggacgagcagaugaccauacucacucgccucggaaaauucgagaagucaagcgucgccgaguaccccucgagcaucaacguagacgaaauaacagacgaaauauacaacccggucgucgcaaaauccauacgacagaccaucaagaucaucaacgcaucaaucaagaaauggggcgaguucgaccaaauaguaaucgagaugccacgcgaccgaaacgaagacgaagagaagaaaagaauagccgacggccagaaagcaaacgcaaaagaaaaagcagacagcauccuuagagccgcggaacucuacugcgcggguaaaguccucccagacuacguuuacaacggccacaaccagcucgcgaccaagauacgccuaugguaccagcagggagaacgcugcauauacaccggccagccuauaucaauccacgaccucauacacaaccaaaaccaauacgaaaucgaccacauccuccccuuaucgcucaccuucgacgacagccucucaaacaagguccuggugcuagccacggccaaccaagagaaggcccagcgaacacccuacaauuaccucaaauccgcaaccuccgccugguccuaccgcgaguucaaagacuacgucacaaaacggaaggggauaggaaagaagaagugcgaauaccugacuuucgaagaggauaucaacggauuugagguccgauccaaauucauacaacgcaaccuaguagacacccgauacgccagcaaaguaauacucaacgcauuacaagacuacuucaaaauaucgggcauccagaccaagguuagugucgucaggggacaguucaccagccagcugcgccacaaauggggaaucgaaaagacccgagaaaccuaccaucaccacgccguagacgcacuaaucauagcggcaaguagccaauugagacucuggaagaaacaagaaaguccccucgucgucgacuaccaagaaggccgccaaguugaccucgaaaccggcgaaauacuagaacucacagacgaacaguacaaagagcucguguaccaaccacccuaccaaggcuucgugaacacgauaucuagcagugccuucgacaacgaaaucuuguuuagcuaucaagucgacuccaaaguaaaccggaaaaucagcgacgccacgaucuacgccacccgaaacgcacaacucggaaaagauaaaacggagggaauuuacguccuggggaaaauuaaagacaucuauacucaagcaggguacgaagcauuccuuaagcgguacaccaaagacaaaaccagcuuccuaauguaccacaaagaccuagauacgugggaaaaagucauagagauaauacuccgcgacuaccgcgaauacgacgaaaagggcaaagaaaucgggaaccccuucgaaagguaucgccgcgagaacggauacgucaaaaaguacagccgaaaaggaaacggcacugcgauaaagagccucaaauauuacgauaacaagcucggcaaccacauugacaucacccccgagaacucccgaaacgcaguagugcuccagagccugaaacccuggcgcaccgacguauacuucaacaaggaaaccggcaaguaugaguuccugggcauaaaauacucggaccuuagcuucgaaaaagggaccggcgaauacggcaucagccaggaaaaauacgacuccauaaaaaucgcagagggcguagcgaagaaaagcaucuucaaauucacacuauacaaacaggaccuacuauucaucaaggacauagaaaacaacuucgggaaauuauugcgcuucaccagcaagaacgacacguccaaacacuacguagaacuuaaacccuaugacaaaaacaaauucggcaccgaagaaccccugcucccuguacuaggcaacguagcgaaauccggccagugcauaaaaggccucaacaaauccaauaucucgaucuacaaggucagaaccgacauacucggcuaccgacacuuuaucaaacaggaaggagaacacccacaacuaaaauucaagaaguga

SEQ ID NO: 6277 - RNA, 3369 nt, Artificial Sequence
  Cas9 variant
augagcaacggcaaaauccuuggccuagauaucggaaucgccucaguagggguaggcgucauagacgcucaaacuggcgaaaucauccacgcaucaucacggaucuuccccucagccaacgccgccaacaacgcagaacggagaacguucagaggaucucgacgucucaucagacgaaagaaacacaggaucaaacggcuggaugaccuuuucaaugacuuccacaucaaucucgacggcgaaaugaguacugacaaccccuacguacucaggguaaaagggcugucccagaaacucaccgucgaagaauuguacaucuccaucaaaaacauaaugaaacgacgaggcauaucguaccuggacgacgcagagucagacaacgaagccggccgcagugacuacgccaaagcaauagagaggaaccggcaacuccuuaccagcaaaacgcccggugaaauucagcucgagagacuugaaaaauacggucaacuccggggaaacuucacaaucaucgacgaagaaggucaaucccaacaaaucaucaacguauucuccacguccgacuacguuaaagagguugagaaaauccucgacugucagaaaauguaccacaaauucauauccgaugaguucugcgacaaacucauagaguugcugagagaaaaacgaaaauacuacguagggccaggaaacgagaagucaagaacggacuacggcaucuaccgaaccgacggaaccacgcuagaaaaccuauuugggaucuuaaucggcaagugcacguuuuacccagaccaguacagaucuagccgcgcauccuacaccgcucaagaauuuaacuuccucaacgaccucaacaaccugacaguccccaccgagaccaagaagcucucccaagaacaaaaagaguuccucguaaacuacgcaaaagaaaccucagugcugggggccggcaaaauccuacaacagaucgccaagcuagccgacugcaaagucgaggacauccguggauaccgacucgacaacaaggauaaaccagaacuacacaccuuugagacuuaucgagccaugaaaggccuugucccccugguagacaucggaguacuaagccgggagcagcucgacauacuugccgacauccugacucuaaacaccgauuucgaaggcauccgcgaagcccuaaagaaacaauuacccaacguauucgacgaaaaacagguaaaaggacuagcgagcuuccgcaaaagcaagucacaacuauucgcaaagggcuggcacaaucucagccagaaaaucaugcucgaagucauaccagaacuauacgccacaagcgacgaacaaaugacaauccuaacccgacugggcaaguucgagaaaagcuccgucgccgaauaccccagcucaaucaacgucgacgagauaaccgaugaaauauacaaccccguaguagccaaauccauccgccaaacaaucaagaucaucaacgccuccaucaaaaaguggggugaguucgaccaaauuguaaucgaaaugccacgagaccgaaacgaagacgaagagaaaaagcgcaucgccgacggccaaaaagccaacgccaaagaaaaagcugauuccauauuacgcgcugccgaacucuacugcgccggcaaagugcucccagacuacguauacaacggccacaaccaacuagcaacaaagauacgccucugguaccaacaaggagaacgaugcaucuacacgggccaaccgauauccauccacgaucuaauccacaaccagaaccaguacgaaaucgaccacauacucccccuaucacucacguucgacgauucccuaaguaacaaaguccucgucuuagcaaccgcaaaccaagaaaaggcccagcgaaccccuuacaacuaucucaaaagcgccacaagcgccuggagcuaucgcgaguucaaagacuacgucaccaaacgaaaaggaauagggaaaaagaaaugcgaguaccucacauucgaagaagacaucaacggguucgagguacgcagcaaauucauccaacgaaaccucgucgacacccgguaugcuuccaaagucauucucaacgcucuacaggacuacuuuaaaauuuccggaauccaaacaaaggucucagucguacggggacaauucacaagccaacuucggcacaagugggggaucgaaaagacucgagaaacguaccaccaccacgccguugacgcacucaucaucgcggccaguucacaacucaggcucuggaaaaagcaggaaucaccccucgucgucgacuaucaagagggacgccaggucgaccuggagacgggggagauucucgaacucacugacgaacaauacaaggagcuagucuaccaacccccauaccaaggauucguaaacaccaucagcagcagcgcguucgacaacgaaauacuauucucauaucagguagacaguaaagucaaccgcaaaaucucugacgcaacgaucuacgccacacggaacgcccaacuagggaaagacaaaacagaagggaucuacguccucgguaaaaucaaggacaucuacacccaagccggauacgaggccuuccugaaacgguacaccaaagacaaaacuagcuuucuuauguaucacaaagaccucgacacuugggaaaaagugauugaaaucauacugagagacuaccgagaauacgacgagaaaggcaaagagauagggaacccauucgagcgcuaccgccgcgaaaacggauacgucaagaaguacagccgcaagggcaacggcacagccaucaagagcuuaaaauauuaugacaauaaauuggggaaucauaucgacaucacucccgaaaacucccggaacgcugucgucuuacaaucccugaagcccuggcgcaccgacguauauuucaacaaagaaacaggcaaauacgaguuccucggcauuaaauacuccgaccucucauucgaaaaaggcaccggggaauacggaaucucacaggagaaauacgacagcauaaagauagccgaaggugucgccaagaaaucgauauucaaguucacccucuacaaacaagaccuccuguucauaaaagacaucgaaaacaacuucggcaaacuccuucgcuucaccaguaagaacgacacuucaaaacacuacguagaacuuaagccauacgacaagaacaaauucggcacugaggagccgcuacugccggugcucggcaacguggcaaaauccgggcaaugcaucaaaggccucaacaagucgaacaucagcaucuacaaaguucgcacagacauacuaggauaccgccacuucauaaaacaagagggugagcacccccagcucaaguuuaagaaauga

SEQ ID NO: 6278 - RNA, 3372 nt, Artificial Sequence
  Cas9 variant
auggccaagauucuaggacuagaccucggaacgaacucgaucggaugggcacucauagacgacguccagaacaagauccucggcgucggaagccgcaucuuuccaauggguguagaaaaucucggagacggugacggggagaucagcaaaaacgcuucacgaacaggcacacguggcguaaggcggcaauucuuucgcagaagacuccggaagaaagugcuucuaaaagcccuaucagaaaacaacauguguccuaugauaacuagcgacuucgacaacuggaagaaaaccaagcaauucccauccgagaaauuagcaucgugguucgccuuaaauccauacgaacuccggaacaaggcccucagcgaaaaacucacccucgaggaaauaggccgcauauuuuaccaccugauccaacgaaggggauuccugagcaacucucgcaagggaggaacagacgacggcgcuaucuucaaagggaaccccaaagaagggaaaauagggauaaccgacacacaagagagcauccaggacaaaacgcucggcagcuaccucuucgaaauauaccccaaggaaaaccaaccuuuccaaaacggccuagaacgcauacgcaaccgguacacagugcggaagauguauguugacgaguucgaaaugaucugggaaaaacaagcccaauacuacucaaaccucaacgaagaccuaaaaacacucuucgggggacgaaaacuagacggauacaaagaagacggaauacucuuccaccaacgaccccugcgaucacagaaacaucugguuggcaacugugucuuugaaccgaauaaaacgaaaugcccaaucagcgccaucccauucgaacaauucagaguguggcagugggucaacacaguugaauauaacgggaagaaaaucucccaggucgagaaagagaaaaucguggaguuccucuacgcgaacgauaaaaccgacuucaagaaaauacgcaaagcaaucggaaaagaaucaaccgaguucaaguucaacuacaaagacgacgacaaaauaguaggcacguacacuguaucccaccucaguaacaagaaauauuucggaaagaaaugguucgaguucuccgagaaagaacaagaagacaucuggcacauacucuacuuuuucgacaguaaaucgaaccucaaagaguacgcaauuaaaaacuggaacuucaccgaggagcaagcugaaagcaucgcaaaguuuaacgucaaagacggcuacuccagccugagccgaaaagccaucaguaacauacugccauuccugaaacugggauucacguacgacgucgcaguaguucuaggcggcaucaaaaacgucuucggacacgagugggaaaaacugucagacgaaaagcgaaacuuccuuauagacaacgucgaaggcaucguccgaagcaaaacuaaaggcggcuucaucgacgucaucaaagacaucuuacgaaacgacuacaacaucagcgacaaucaacuccggaaacuguaccaucacucagcaaccaucuacgucgccgaauuacucgaaaaacuaccagucgguaaagaggccgacaaagaaauacaauccauuaggaacccgauagugauaacggcccuuuucgaacuacgcaagcuagucaacgaacuaaucgaugauuucggcuccauagacgaaauaaagguagaaauggccagagaccugaagauaagcaagagccagcgaaacaaaauacgccgcgaacagaagcgucuagaaagagaaaacgaccgcguaaaggcccgccuucucgaagaaggccagcggaucacccacgacaacauccuccuauacaaacuaugggaggaguguaagaaaacgugcccguacacgggaaacccgaucccucuauacaaacuguucacuggagaaauacaaaucgaacacauacacccauggucccgaagccucaacgacagcuucgccaacaaaacgcuaugcuacgcugacgaaaaccggaagaagggagacaaaacccccuacgaguucuacggcaacgacgaaagcaacuggagcgccaucaaagaaagggcccuuaaacucuucagcgauacaaaggaauaccccaacgccuaccaaaaguucaagcgcuucguccaacauaaguucgacgacgacuucagcagccgacaacuaaacgauacccgauacauaucaaaagaggccaaaaacuaccucagcaaaaucugcaaaaaggucgcagucagccccggacaggccacgagcaaccucagacaaaaaugggggaugaacaacauacucaacgacgaaaacgagaaaacgcgggaagaccaccgccaccacgcaauagacgcacuggucauggccugcacaaaaauaucguacgugcaggagcucucgaaauggaacagauauaaccgaaacgccgaacugaaaaaguucccgcuaccgugggagaccuucuggucagacgcaaauagagccguugacaaaauccugauaagccacaagaaagucagcaacgacauaacgggcagaacacacauaucagagaaaaacgggaagaaauacaaaaacgucggcgucgcagcccgcggccaacuacacaaagaaacagucuauggcaaacgcaccuucaauggagaagaggcauuucauguaaggaaaacgaucgacagucugacaacagaaaaacaacuagagaaaguaguagacgagagcauaaaacuccucauaaagaaaagaguccaagaacuagggggauucgucaaaggcgcuaucccggccaacacauucuuuguagucgacgaaaacggcaucaaacagccucaaaucuuucucccgaacaaaaacggagcaccgguaccgguccucaaagugcgcaugaaagaaaauauaggcggcgcggaaaaacucaaggaaaaugucaaccaauggguaaacccccgcaauaaccaccauguccuaaucuacaaggacgaaaaaggaaaccugaaagaggaaguagucacuuucuggacaguaguggaacgcaagcgaacaggacaguccgcguaccagcugcccuucgauggaaaagaaaucgugaccacgcuccauaucaacgacauguuccugcuaggccuaaacgaagaagagaucaacugggaaaaccccgacuacgaaguucucaaagagcaccuguacagaguacagaaguucaccucaggcgacuacuacuuccggaucgccaagacguccucaauacaaaaugcaaucgaaaaacaacaaaucaacagcuucggguucggaaagaacggauggaguacccacaaucccaucaaagugaaaaucaguguuucgggcaaaauaucaaaagucuga

SEQ ID NO: 6279 - RNA, 3372 nt, Artificial Sequence
  Cas9 variant
augaacggccugguucugggccuggacaucggaauaggaucugucggggucggaauccugaacaaagacacaggcgaaaucauccauaccaacuccagaauuuuccccgcagcaaccgccgacaacaauguagagagacgaaacagccgccaggccagaagacucaaccgccgaaagaaacaccguggagcucgucuacacgaucucuucgaagacuacgaccuucugauagacuucucgaaaguaaguauaaaccucaacccguacagacuccgaguacaaggacuugacaacccccuaaccacagaagaacuuuucaucgcacucaaaaacauugucaaacggcgcggcaucucauaucuagacgacgccuccgagaacggaggcgccguuuccucggacuacggcaaagccguggaggaaaaccgaaaacuacucgccgaacaaacaccgggucagauccagcuagaacgauucgagaaauacggacaaguacgaggagacuucacugucgaagaaaaaggagacaaacaccggcugauaaauguauucucaaccucagccuaccggaaagaagcagagcgaauccuccgaaaacagcaagaguucaacaaccaaaucacugacaaauucaucgaagacuaccugaaaauccuuacugaaaaacgcaaauacuaccaugggcccgggaacgaaaaaucccgaaccgacuacgggcgguuccgcaccgacggcacaacgcuagacaauauauucggcauucucauaggaaaauguaccuucuauccgaaugaguaccgagcauccaaagcgaguuacacggcacaagaguucaaccuucucaacgaccuaaacaaccuaacaguccccacagaaacuaagaaacuguccgaggaacaaaagaaaaccaucgucgaguacgcaaaaucagccaaaacccucggagccucgacgcuccuaaaauauaucgccaaaaugaucgacgccagcgucgaccagauacgcggcuaccgagucgacgugaacaacaaaccggaaaugcacacguucgagguguacaggaaaaugcaaucccuggaaacaauaccagucggggaguucucaagagaagucuuggacgaacucgcccacauucuaacccugaacaccgagcgagaagggauagaagaggcgaucaacaccaaacucauggacguauucagucaggaccaaauacucgagcuaguccaauuccguaaaaacaacuccucacuauucagcaagggauggcacaacuucagccucaaacuaaugauggaacugauccccgaacuauacgaaaccucugaagaacagauggcaauacugacacgccucggcaaacaaaaauucaaagaaaccuccaaacgcacaaaauacauagacgaaaaagaagucaccgaggaaaucuacaacccggucguagccaaaagcguccgccaggccauaaagauuaucaacgaagcaacuaagaaauacggcaucuucgacaacaucgucauugagauggcgcgcgaaaacaaugaagaggacgcuaagaaagacuacaucaaacggcaaaaagccaaccacgacgagaaaaaugcagcgauggaaaaagcagccuuccaauauaacggaaagaaagaacugccagacuccauauuccauggucacaaagaacucgcaaccaaaauccgacucuggcaccaacagggcgaaaaaugcuuauacacaggcaaaaacauccccauauccgaucucauccacaaccaauacaaauacgaaaucgaccacauacuaccauuaagccucagcuucgacgacagccuuagcaacaaaguccuaguccuggccaccgcgaaccaagagaaaggacaacgaacgcccuuccaagcacuggacuccauggacgacgcguggagcuaccgagaguucaaaagcuacgugaaagacuccaaacuccuaggcaacaagaagaaagacuaccuacucaccgaagaagacauauccaaaaucgaagugaaacaaaaauucauagaacgaaaccugguagacacgagauacucaucccgggucguacucaacacccuucaagacuuuuacaaggcccacaaauucgacaccaccaucucagucguaagaggccaguucaccucccagcuccgacgcaaaugggggcucgagaaaagccgcgaaacguaccaccaccacgccguagacgcacucauuaucgccgcauccucccaacucaggcuauggaagaaacaggcgaacccucugaucuccuacaaggaagaccaauucguggacucagagaccggcgagaucauuagccucacugacgacaaguauaaggaacucgucuucaaagccccguacgcucacuucgucgacacgcucucgagcaaaaaguuugaagacuccauacuauucagcuaccaaguagacuccaaguacaaccgcaagaucagcgacgccaccauauaugcaacgcgaaaggucaaacuugacaaggacaaaagcgaagaaacauauguacuaggaaaaaucaaagacaucuauagccaggcaggauacgacgcauucaucaaaauuuacaacaaagacaaaucgaaauuccucauguaccacaaggacccccaaaccuucgagaagguuaucgaggaaauacuccgcacguaccccucuaaagaguucaacgagaaaaacaaagaagugcccugcaaccccuucgaaaaauaucggcaggaaaacggacccauccgaaaguacuccaaaaagggaaacggcccugaaaucaaaucccuaaaauacuacgacaaaaacauccccgaguccuucauaaacauaacucccuccaacucgaaaaacaaagucauucuccgccaacucaaccccuggagaacugacguguacuucaaccaccagacagagaaauaugagcuucuaggucuuaaauaugcggaccuccaauucgagaaaaagacaggcacauacagcauaaccaucgacaaauacaacgaaaucaaggaaaaggaaggcgucggagaacaauccgaguucaaauucacacuguacaaaaacgauuuguuacuaaucaaggacaccaagaauaacgagaaacagauuuuccgcuuccuuagucgcacgaugcccaacgucaaacacuacgucgaacugaagcccuacgacaaggccaaguucgacgggaaccaaccccuaaucacaaucuucggcaaugucgccaaaggaggccagugccuaaagggacucaacaaaagcaacauuuccauauucaaagucaaaacagacguucuuggaaacaaacacuucaucaccaaagaaggagaaaaacccaaacuaaaauucuga

SEQ ID NO: 6280 - RNA, 3378 nt, Artificial Sequence
  Cas9 variant
augaacggccuaguccuaggauuagacauagguaucgcgucuguuggagucggcauccuaaacaaagaaacgggcgaaaucauccacgucaacaguagaauuuucccagccgccaccgcggacagcaacgucgaacgacguggguuccgacaaggaaggagguuaggccgccggaagaaacaccguagcgcaagacucaacgaccuauucgaagaauuuggauucauaacagacuucucggccguuccccuaaaccucaaucccuacgcacuacgagugaaaggccucucagaagaacuaaccaacgaggaacucuuuauugcgcugaaaaacauaauuaaacgacgcggaaucucauaccuagacgacgcaagugaagacggagaaacagcaaguaaugaguacggcaaagccgucgaggaaaaccgcaaacuccucgcagacaaaacgccaggccaaauacaacuggagcgauucgaaaaauacggccaaguacguggcgacuucacagucguagagaauggagaaaaccaccgccucauaaacgucuucagcaccuccgccuauaagaaagaagcagaacguauacuccggcgacaacaagaguucaacguccgcaucucagacgaguucaucgaagcauaccugaccauccucaccgggaaaagaaaauacuaccacggaccaggcaacgaaaagagccgcacagacuacggacgauuccgcacugacggcaccacccucgauaacauauucgggauucugaucggcaaaugcacauucuacccagacgaauaucgagcagcgaaagccuccuacacagcacaagaguuuaaccuccucaacgaccuaaacaaccucacaguccccaccgagacuaagaaacugcgaccagagcagaaaaggcaaaucguagaauacgcccgcacagccaagacgcucggaacgcccacgcuccuaaaauacaucgccaagcuaguugacggcagcaucgacgacaucaaaggauaccggauagacaaauccgacaaacccgagaugcauaccuucgacgcauacagaaaaaugcgaacgcucgagcuaguagacguagacauccugucgcgagaaacccuagacgaucucgccuacauccuaacauuaaacaccgagucggaggguauccuggaggcccugaacagcaaaaugcccggaaccuucaccaaagaacaaaucgacgagcugauccaauuccgcaagaaaaauucagccguguucgggaaaggauggcacaauuucagccuaaaauuaaugaacgaacuaauccccgagcuguacgaaaccagcgaggaacaaaugacgauacuaacccgccucgggaaacaacgaagccgcgagaucagcaagcgcacgaaguacaucgacgaaaaggaacugacagacgaaaucuacaauccaguagucgcgaagucagucagacaagccaucaagauaaucaaucuggccaccaagaaauacgggaucuuugacaacaucguuauugaaauggcccgcgagaguaacgaagacgacgagaaaaaggcaauccaaaacguccagaaagcuaacgaagacgagaaaaaggcagccauggaaaaagcagccgaccucuacaacggaaagaaagaauugccugacuccaucuuccacggacacaaagaacucgccaccaaaauacgacuauggcaccaacaaggagagcgcugccucuacacaggaaagaacauuagcauacacgaccucauccacaacccccaccaguacgaaauagaccacauccuaccgcucagccucagcuucgacgauggccuagcuaauaaaguccuaguacucgccaccgccaaccaagagaagggccaacggacaccauuccaggcacucgacagcauggacgacgcauggagcuacaucgaguucaagcaauacguccgcaacagcaagucgcucucgaauaaaaagaaagacuaccuccucacagaagaagacaucuccaaaauagaaguaaaacaaaaauucauagaacgcaaccuaguagacacgagguacagcucgcgagucguacuaaauacacuccaagaguucuacaaaacaaacgacuucgacacuaaaauaucagucguacgaggucaguucaccagccagcugcggagaaaauggaaaaucgagaaaagccgcgacaccuaccaccaccacgccguagacgcccuaaucaucgcugccagcagccagcuacgccuuuggaaaaagcaaaacaacccccuaauaucauaccgugaaggccaacugguagaccccgaaaccggagaaauccucagccucaccgacgaugaauacaaagaacuggugcuucgcccgcccuacgacuacuucguugacacccugaaauccaaaucuuucgaggacuccauccucuucagcuaccaagucgauucaaaauacaaccgaaaaauaucggaugcgacgauauacggcacccggaaagcacaacuaggaaaggacaaacaggaagagaccuacguacucggaaagaucaaagacauauacucacaaaaaggcuacgaggauuucaucaagcgauacaagaaagacacgacacaauucuuaauguaccacaaagacccacagacauucgccaaaguaauagaggagauacucaaaaccuacccggacaaagagcuaaacgagaaaggcaaagaaauacccugcaaccccuucgaaaaauaccgccaagaaaauggaccgauccgcaaguacucaaagaaggggaaaggccccgaaauaaaaagucuaaaauacuacgacaacaagcugggaaaccauauugacauaacacccguaaacucccagaaccagguaguccuacaaagccucaaaccguggcgcaccgacguguacuucaauccgcaaacgagcaaauacgaacuuaugggccucaaguacuccgaccucagauucgaaaagggaagcggaagcuacggaauaucccccgaaaaauacaacaaggucaaagccaaggaaggcguggacgaagacagcgaguucaaauuuacacuuuacaaaaacgaccugauacucauaaaagacacagaaacaggcgaacagcaacucuucagauacggcucccgaaacgauaccaguaaacacuacguagaacucaagcccuacgaaaaagcaaaauucgagggcaaccaacagcuaaugaaccuccuaggaacgguagcaaaagggggacagugccucaaaggcauaaacaaaccgaaccucagcauauacaaggucaaaaccgaugugcuggguaauaaauacuucauuaagaaggaaggagaucagccgcaacuaaauuucaaaaagaaaaucuga

SEQ ID NO: 6281 - RNA, 3378 nt, Artificial Sequence
  Cas9 variant
augacaucaaagcaagaaaaccucggagcccucacauucggccuagacauaggcaucgcaagcguaggcugggcaguacugggcgaaaaccggauaauagaccuaggcguaagaugcuucgacaaagcagaaacagccaaggaaggagaaucgcuaaaccucgcccgccgaauggccagacuacuacgccggagacugagaagacgagccuggaggcuaacaaaacuagcccgccuacucaagcgagaagggcuaauugccgacgccaaucucuucaaaaacaaaaucgagaagaacacacccguacccaaaagcagcuggcaacuuagaguagacgcucuggaccgaaaauuaaacgccgaggaaugggcacgcgucaucuaccaccucugcaaacacagaggcuuccacuggauaucucgagcugaggaaaaagccgccgagucagacucaaaaggagagucuggaaaggugaaacaagggcucgccggcacgaagaaacuaaugcaagagaaaaacuacagaacagccgccgaaaugguccuagcggaguucccggaagcccaaagaaacaaacaaggagacuauucaaaagcacugagcagaauccugcuuggggacgaacucaagacccuguucgaacaccagcggaaacuagacucaccauuugcaaccgaaaaacuagaagcugccauacuagggaacggcgaccggaaaagcggacucuuuugggcgcaaaaccccgcucuagccgggagugaccuccuaaaaaugcucggcuauugcaccuuugaaaagaccgaauaccgagcccccaaagccagcuucaccgcagaaaggcacguguggcucacaagacugaacaaccuccguaucguaguagacggcaccacccgcccccuaaacgaagcagaaagaaggauagcccuacucaugccauaccaacaagcaggggacuucaccuauaaacaauugcgcacugcucucaccaaagcgggcuuccuaccugagagcuuccguuacacaggacuaagcuacgccuccggacaaaaagcgggggagaaaaccaaagaccccgaaucagcagcacuugugaaauucccggccuggcaagaacuacgaaagacccuugagaaaaaggaacuagccucagaauggcagaaaaucucuaccgacgcacuagacggaaagccccaguuauuggaccaaauagcaugggugcugagcguauacaaagacgaugacgaaguaaaagcagaacuaagcaaacugaaccucccaaacgcagagaaaaugaucgacgcccuacucgacaucagauucgacaaauucucaaaccuuagccucaaagcccuuugcaaaaucgucccccuaauggaacaaggccaacgauacgaugaagcgaucgcaaacaucccagaauauggccaccacagccagcuacacaagguaggcgcgggagaacacaaauaccucccgcccuucuacaaagaacgagacaagaccggcagaaugguauucaacgacgauauggacaucccccguaacccagugguccuacgagcccuaaaccaagcacggaaaguuguaaaugcacuaauaaagaaauacgacagcccccacgaaguccauauagaaauggccagagacuuauccaggccgcuggacgaacggagagaaguugaaaaacuacaaaaagaguuccgugacaauaacgagaaaggaaaagcacaguucgcgcaggacuucaauaucguaggggccguuaaagggaaagaguucgaaaaauaccagcucuaucgagagcagcagggcaaaugugcguacuccaucgaacccauggacauacaccgucuauucgaacagggauacgucgagauagaccacgcacugcccuacucccgaucauucgacgacagcaaaaacaaccguguacuggucuuagccaaagaaaaccgagacaaaggaaaccggacgccauucgaauaccuaggcgggaaagacaacagcgaaccguggcgccaauuugucgccuucguggaagggaacaaagcguacagauuggcuaagagauccaggcuacucaggaaagacuuuggugacaaagaagcaaaagaguuccgugaacggaaccuaaacgauacccguuacauuugcaaauucuuuaaaaacuacguggagcaguaccuacaacuccacgaggauucagaagccaaaaggugugucguacuaagcggacaaaugacuagcuuccugagagcccgcuggggacucgucaaaguacgcggcgacagcgacaggcaccacgcacuggacgccgcggucguagccgcaugcagccacggcauggugaagcgccuuagcgacuacagcagacgcaaagaacuagagcaaguaagagaaggcuuuguagacguagacacaggcgaaaucgucaacccagcuauguuccaacagguacaagagcauuucccaaacccauggccccacuucagggacgaagucaaacuaaggcuauccauggacgacccggcacuacugcgaucugaaauggagaaauucgggacauacaccccagaggcacuccaggcccuccaccccuuguucgugagcagagccccgcagagacgaaauagcggcgcugcacacaaggacaccauauacgcacagccaaaacgacucgucgcccagggcggagucacacagaaaguagcccuaaccucccuaacccuaaaggaccucgacaaacuaauagacccccacagaaacgacaagcuguacaccgcaauucgcgcccgccuagagcagcacgggggcaagggagauaaagccuucccgucgucaaacccacuccgaaaaccagacucggaaggcaacccaacaggaccaauaguucgaggcgugaccauggucaucgacaaacugucaggcaucccaauccgaggcggcauugccaaaaacgacuccauggucagagucgacgucuucacaaaagcaaacaaguuccaccugguccccgucuauguacaccacacaguagccaaagcccuucccaaccgggcagucgucgcauucaaagacgaagaugaauggacacugaucgacgacucauucgacuucugcuuuucccuacaucccaacgaccugguccaaguccaacaaaaagggaaagcgggaaugauaggauacuauucguccugccaccgcggaaccggaaacauaaaccucugggcacacgauaggaaucuacaaguaggaaaagacggcaugauagaaggaaucggagucaaaacggcccucagccucgaaaaauucaacguagacguacucggcaacagauacccagcgcccccagagaaaagacgcgaccuagcguga

SEQ ID NO: 6282 - RNA, 3378 nt, Artificial Sequence
  Cas9 variant
augaccgaccggaucucacuaggucuagacaucggggucgcaagcguaggguucagcguucuagacaucgacaaaggcaagguaaucgaacuaggcgcacgacuguucaacgcaacagucgcagcaggcaaccaagaccgcagagacaugcgcggaagccgacgccuccucaaucggaacaaacaacgacguaaggacgugucgaaacucuuccaggaauacgggcuccuagacaauuucgacagagacaacuuccacacugccuucaauaacaacuggaaccccuaugagcuacgcgucaaaggacuaacaaaacaacucaacaaagaagaacucgccgacagccucuaccaaaucauaaaacgccgcggcaucucauacgcgcuaaaagacgccgacgcaaacgaagacggcaccgacuacuccucaucacucaaaaucaacagccaagaacucaucgaaaagaccccggcacaaauccagcuacaacgccucaacgauuacggcaaaguccggggaaaagucauugucggcgacgacaucgacgaccagaaaguucuccugaaugucuuccccaccaacgccuacgaaaaagaagcccgucaaaucauagccacccagcaacaauuuuaccccgaaaucuugacgggcgaguucgucaaagaauacugccaaauccugacgcgcaaacgcgacuacuucgucggccccggcaacgaaaaaucccgaacggacuacggcauauacaaaaccgacggacgcacccuagacaaucucuuugaggaacucaucggucaugacaaaaucuacccggacgaacucagagccucagcggccuccuacacagcccaacuauucaacguacuaaacgaccucaacaaccuccgaauccuaucuuacgaagacggaaagcugacgcaaaucgacaaagaaaagaucauagcagaaauaaagaauaacacaacggucguaaauaugcuuaacgucaucaaaaaggucaccggcugccagaaagacgacauaaagggauucaggcuaaaugagaaggacaagcccgaaaucagcuccaugcccaucuaccgaaaagcacauaaagauuuccuaaaggucgggauagacauaacagacuggcccaucgacuucauagaccggcuuucguucauccucacgcuaaacacagagaauggagagaucagaaagcaaauuaacaagcgccucgucccagacuucgacuuccucaacgacgacuuaguccaacucauuaucgacaacaaagacagcuucgacaucaagacaaacaacaaauggcauagauucucccuaaaaacaaugaacaaacucauaccaaccaugaucgaacgcccggucgaacagaugacauuacuaaccgaaaugggccuaauuaagaaagauaccaaacgcuuugaagggaacaaauaccuccccuacaaggaaauagccaacgacauauucaauccagucgcgucaaaaaguguccgcgaagcguugaagaucgucaaugccguacugaagaaauacggccacauagaauauaucgucauagaaaugcccagggacaaaaaccuagaugaggaaagaaagcagaucgcugacuuccaaaagaaaaacaagaaaauaaaggaugccgccuucaacgccuucgucaaagcagugggcucgaagaagaacguaaaaaucgcacuauccaaaaaccgcaaacugcaaaugggcauccgacuauggcaccagcaacaagggauagaccccuacaacggagaggaaauaaacgcuaacgaccugaucagcaacccagauaaauucgagaucgaccacaucaucccgcaaagcaucagcuucgacgauggcauaaacaacaaaacgcuauguuucgcgucaaugaaccaagucaaaggccaaaagaccccauacgaguuccucaacgaaggccacgggcagggguacgcaaaauucaaagcaauaguauccaagaacaagaacuucucaaaagcaaaacgagacaacuaccucuucgaggaaaacgugagcaacaucgaaacgcgcaaacgauuucuuucccgcaaccucguagacaccagauacuccagccgggucguacucaacagccugcaggaguucuuccacgaaaaaucagacgacaccaaaguaacagugauccgcggcaaauucacaagcaacaugcgaaaacacuggcacaucgacaaaacaagagacacuuuucaccaccacgccauagaugccagcaucauugccgccacgccguuccuccgcauguggaaaaaggggucgacaauauuccccaccaaaaucaacgaaacaaguauugacauugaaaccggugaaauccucgacgacaaaaacuucgacaaggucauguacgaagaaccguacucaggauucaucagcgaaauaaugaacgccgacgacagaauuaaguucucccaccaaguagacaagaaaaugaaccgcaaaguaagcgacgcaaccauauacucaaccagaaucggcaagcucagcaaggacaagaaagacgccgaguacgucguggcaaaagugaaagacauauacucaguagacggauacgaaaauuucaagaaaguguacaagaaagauaaaaccaaguuccuccuauacaaauaugauccaagaaccuuuuccgagcucgagaaaaucgucaucgacuacccagacaagaucgaaaaaguccaaacgaacggcaagauaaaggcaguggacaucucacccuucgaacuguaccgccgugacaauggcaugguccgaaaauacagcaagaaaaccgggccagcaaucaaacaacuaaaauacuuagacaagaaacucgggagccacauagacaucaccccgaaaaaugcaaacaacaaacacgugguauugcaaagccuaaaaccauggagaaccgacgucuaucuaaaccacgagacgggcgaauaugaaaucaugggaaucaaauauuccgaccugaaauucaauaagaaugaaggcuacggcauaaagaaggacaaauaccucaaaaucaaaaacaucgagggagucuccgagaacucagaguucauguucagccucuacaggaaagaccgcauaaaaguucaggacauggaaaccaacgagagcguagaacuccuauucuggucgcgaaauuucagcaacaaaaaguacgcggagcuaaagcccauaagccaaauagacaacgacaagguguugccgaucuacgguaggggccgccucaucaagcgacuaauaccuaaaaacugcaagaucuggaaggucaacacaagcauccuaggcgauaccuauuaccucgaaaaagagucaaacuauccacagaaaauccuugacuga

SEQ ID NO: 6283 - RNA, 3381 nt, Artificial Sequence
  Cas9 variant
augaacggccucgugcucggccucgacauaggaaucgcaagcgucgggguagggauacucaacaaagaaacgggagaaaucauucaugccaacagccgcauuuucccugccgcaacggcugacuccaacgucgaacgccgaggauucaggcaagggcggcgccucggacgcaggaagaaacaccgaagcgcccgacugaacaaccuguucgaggaguucggauucaucacagacuucucggccauaccccuaaaccucaaccccuacgcccuccgagucaaaggccugagcgaagaacucaccaacgaagaacuauuuauagcccugaaaaacauaauaaaaagaagaggcaucucuuaccucgacgacgcaucagaagacggagaaaccgccagcaacgaauacggaaaggcgguggaagaaaaccgcaaacuacuagccgacaaaacgccgggacaaauacaacucgagcgguucgagaaguacggacagguacgcggcgacuucaccgucgucgaaaauggggaaaaccaccgccuaaucaacguauucucaacaagcgccuacaagaaagaagcagagcguauacucagaagacaacaggaguuuaacgugcgaaucucagacgaguucauagaagccuaccugaccauccucacgggcaagaggaaauacuaccacggccccggcaacgaaaagucgcgcaccgacuauggacguuuccggacagacgggaccacacuggauaacauauucggcauccugaucggcaaaugcacauucuaccccgaugaauacagggcagccaaggccagcuauaccgcccaagaguucaaccuacugaacgaucucaacaacuugacaguacccacagaaacgaaaaagcucucgccagaacagaaaagacaaaucguagaauacgcccgcacagcaaaaacccucggcacacccacucuacugaaauacauagccaaacucgucgacggauccauagacgacaucaaaggauaccgaauugacaagagcgacaaacccgaaaugaugcacaccuucgacgcuuacagaaaaaugcgcacccuugaucucgucaacaucgacgcccucucccgcgaaacccuagacgaccuagcccacauucucacccucaacacagaaagcgaaggaauccuagaagcccugaacuccaaaaugccaagcacauucaccaaagaacagauagaugaacucauccaguuccgcaagaaaaacucugccguauucggcaaaggguggcacaacuucagcuuaaaacuaaugaacgagcuaaucagcgaacuuuacgagaccagcgaggaacaaaugaccauccuaacacgccucggaaaacaacgcucccgugagauuagcaagcgcacaaaguacauagacgaaaaggagcuaacugaggagauauacaacccuguagucgccaaauccguaaggcaagccaucaagaucauaaacgaagccacaaagcgcuacgggauauucgacaacaucgucaucgaaauggcaagagaaaacaacgaagaggacgccaagaaagacuacaucaaacggcagaaagcaaaccaagacgagaaaaacgccuccauggaaaaagccgcauuccaauacaacgggaagaaagaacucccagacagcaucuuccacggccacaaagaacuagcgaccaagauccgacuauggcaccagcaaggcgaacguugucucuauacgggcaaaaacaucaguaucagagaccugauacacaacccacaucaauacgaaaucgaccacauccugccacuuucccugagcuucgacgacggacuagccaacaaaguccuagugcucgcaacagcuaaccaggaaaaaggucaacggacacccuuucaagccaucgacagcauggacgacgccuggagcuaccgagaguuuaaacaguacguacguaacucaaaaagccuuucaaacaagaaaaaggacuaccuccucacugaggaggacauaucaaagauagaagugaaacaaaaguuuauugaaagaaaccucguggauacacgauacagcagccggguaguccucaacacgcuccaagaguucuacaaaacaaacgacuucgacaccaagaucuccguaguccgcggacaauucaccucccaacuucguagaaaauggaagauagaaaagagccgcgacaccuaccaccaccacgccguggacgcccuaaucauagcagcgagcucgcaacucagacuauggaagaaacagaacaacccccuaaucucauacaaagaaggccaguucgucgaucccgaaacaggggagauccucagccucacugacgacgaguacaaagaauuaguauuccgaccacccuacgacuacuuugucgauacccugaaaucaaaaucuuucgaagacagcaucuuauucagcuaccagguugacucaaaauacaauagaaaaauuuccgacgcaacgaucuacggcacacggaaagcgcagcucggaaaagauaaacaggaggaaaccuauguccucgggaaaauaaaagacaucuacagccaaaaaggguacgaagacuucauaaaacgauacaacaaagacgaaacucaauucuuaaucuaccacaaagacccacaaacauucgaaaaaguaaucgaagaaauacucaagacguaccccgacaaggaacugaacgaaaaaggcaaggaaauaccguguaacccauucgaaaaauaccgacaggagaacggcccaaucagaaaauacagcaagaaagggaaaggccccgaaaucaaaauucucaaauacuacgacaacaaacuaggaaaccacauagacauuacaccuguuaacucccagaaccaagucguucuacagucacugaaacccuggcgaacagacgucuacuucaauccccgaacuagcaaguacgaacucaugggacucaaauacuccgaccuacguuucgaaaaaggcagugguuccuacggcauauccccagaaaaauauaacaaaguaaaggccaaagaaggcgugaacgaagauuccgaguucaaguucacccucuauaaaaacgaucucauacuuaucaaagacaccgaaacaggagaacaacaacucuuccgguacggaucgcgcaacgacacaucaaaacacuacgucgagcucaaaccauacgagaaagccaaguucgaaggcaaccaacagcugaugaaccuacuagguaccgucgcuaaaggcgggcaaugccucaaaggaauaaacaaacccaaccucagcaucuauaaagugaagacagacguccucggcaacaaauacuucaucaagaaggaaggagaccagccccaacuaaacuucaaaaagaaauucuga

SEQ ID NO: 6284 - RNA, 3381 nt, Artificial Sequence
  Cas9 variant
auggcgagcaagcacgaaaaccuaggagcccucacauucggacuagacauagguaucgcgagugucggaugggcaguccucggcgagaaccgcauaauagaccucggagucagaugcuucgacaaagcggagacagcgaaagagggagagucucuaaacuuggcgagacggaccgcucggcuucuacgccgucgucuccggcgacgagccuggcgacuaaccaaacuagcaaggcuacucaaacgagaaggacugauugcagacacgaacguauuccagaaaccauucaaccuaaaggaugcgaacgaaaagggccuaaguuucuggcagcuccgcguagacgcccuagacagaaagcuauccgcggaagaaugggcccgaguaauauaccaccucugcaaacaccgaggauuucacuggaucagccgcgccgaagagaaggcggccgaaggugacucaaaauccgagggcggaaaaguaaaacagggacuagccggcaccaagaaacugaugcaagagaaaaauuacaggacagccgcugaaauggugcucaccgaauuucccgaagcacaacgaaauaaacagggagacuacagcaaggcccucagccgcauccuacuaggggaugaaaugacccaacucuucaaacaccagcgagaguuaggaaacccgcacgcgacggaaaagcuagaagccgcaauccugggcaauggggaccacaaauccggccuauucugggcacaaaaccccgcccucgccggaaaugaucuauuaaaaauguuaggacacugcacauucgaaaaggcagaauaccguguacccaaagccucuuuuacagcagagagacacgucugguuaacccgucucaacaaccuaagaauaguaguagacggaacaacucgcccacugaacgaagcagagcgacaucuagcacuacucaugccauaccaacaggcgggcgaccucacguauaaacaacuccggaccgcgcucacgaaagcaggauaccugcccgaaucauucagauacaccgggcuugccuacgccucaggucaaaaagcagaugagaaagcuaaagacccggagagcgccccacuggucaaacucccggcguggcacgaauugcggaaaacacuagaaaagaaagagcucgccucggaguggcagaaaauaagcagcgacgcgcuugacggaaaaccccaacugcuagaccaaaucgccuggguccuguccguauacaaagacgacaccgaaguugaagccgagcucugcaaauuaaaucuaccgaacgccgaaaagaugauagacgcacuacuagacauaagguucgacaaauuuagcaaucucucacucaaagcccuucgacaaauaguaccccucauggagcaaggccaaagauacgacgaagccgucgccaacauaccagaauacggacaccacucacaacugcacgaagugggagcuggcgagcacaaauaccucccacccuucuacaaagaacgcgacaagaccggccgaauggucuucaacgacgacauggacaucccaagaaaccccguaguccuccgcgcucucaaccaagcgcgcaaagucguaaacgcccugaucaaagaguacggcucaccccacgagguccauauagagauggcccgcgaccucagcagaccacuggacgaacgccgcgacguagaaaagcuccaaaaagaauuucgagaccgcaacgaaaaagacaaagcccucuucgcgcaagacuucaacaucgugggagcggugaaagggaaagaguucgaaaaauaccaacucuaccgagaacaacaaggaaaaugcgcauacagcaucgaacccauggauauccaccgacucuucgaacaaggcuacgucgagaucgaccacgcccucccuuauagccgaucauucgacgacagcaagaacaaccgaguacucguacucgccaaagaaaacagagacaaggggaaccggacaccguucgaauaucugggcggaaaagacaacagcgagcguuggcgccaauucguugccuucguagaaggaaauaaauccuaccggcuagcaaaacgcucacgccuccugcgcaaagacuucgggaaggacgaagcaaagggcuucagagaacgcaaccuaaacgacacaagguacaucugccgguucuucaaaaacuacgucgaacaauaccuacaacuacacgaagacuccgacgcaaaacgcugcgucguacucucgggucaaaugaccucauuccugcgcgcacgauggggacucguaaaagucagaggcgacucggacagacaccacgcucucgacggagcaauagucgccgccugcagccacucaaugguuaaacgccucucugacuacagccguagaaaagaacuugaacaaguacgcgcgggcuucguagaugucgauacaggcgaaauagucaacccagcaauguuccagcaaguacaagagcacuucccgaacccuuggccacacuuccgcgacgaaguaaagcuacgacuuaaugucgacgaucccgcccuacuucacagcgagaugaaccgcuucggcacauacagcccugaagcccuaaaagcgcuacgaccucucuucauuucacgcgcaccccagagaaggaacuccggcgcggcccauaaagacacgaucuacgcacaacccgaacgacugguugcccaggguggagucacccaaaaagucccacugaccucccuaacgcucaaggaccuagacaagcugaucgacccccaccgaaacgaaaagcuauacuccgcaauaaggauacggcuggaacagcaugggggaaagggcgacaaagcauuccccgccucgaauccgcugcgaaagcccgacagcgaaggaaacccgaccggacccauaguacggggaguaacgauggugauagacaaacucagcgggaucccaauacggggcgguauagcuaaaaacgacucaauggugcgcguugauguauucaccaaagccgggaaauuucaccuaguaccagucuacguacaccacgcggucgcuaagguccuacccaaccgcgcagucguggccuacaaagacgaaacggaguggacgcucaucgacgauggcuucgacuucugcuucagcauguaccccaacgaccuccuaaggauaaaacugcgaaacgcgagccaccucggauacuacgcuuccugcaacagauccacaggcgccaucaaccuauggagccaugaucgaaaccaacaaguaggcaaagacggcaugaucgaaagcauaggcgucaagacggcccucaaugucgagaaacuaaacauagauguccuaggcaaucgauacccggccccaccggagaaacgccgggaccuagccuga

SEQ ID NO: 6285 - RNA, 3384 nt, Artificial Sequence
  Cas9 variant
augagcgaccuaguacucggccucgacaucggcauagggagcgucgggguaggaauacucaacaaggucacaggagagauaauccacaaaaacucccgaaucuuuccggcugcccaagccgagaauaacgucgagcgccgcauaaaccgacaaggccgccggcucacccggcggaagaaacaucgacgcguuagacugaaccaccucuucgaagaguccggacuaauuacugacuucaccaacgucaguaucaaucuaaaccccuaccagcugagaguaaagggacuaacggacgaacugagcaacgaagaacuauucauagcacucaaaaacauggugaagcaccgcgggaucaguuaccuagacgacgcuucagaugacgguaacucaucagucggagacuacgcccagaucgugaaagaaaacagcaaacagcucgaaacaaaaacgccaggacaaauacaacuggaaagguaccaaaaauacggacaguuacgcggagacuucaccgucgaagaagacggcaagaaacaccgacuaaucaacguauuccccaccagcgcguacagggcggaagcguugagaauccuacaaacccagcaagaguucaacccacagauaaccgacgaguucauaaacucauaccuacaaauccuaaccggcaaacgaaaauacuaccacgggcccggcaacgagaaaagccggaccgacuacgggcgguacacgaccaagaaagacagcgaagacgaauacaucacccuggacaacauauucggaauacuuaucggaaagugcaccuucuacccggaagaauaccgcgcagccaaagccuccuacaccgcccaagaguucaaccuacucaacgaccuaaauaaccucacaguacccaccgaaaccaagaaacuaagcgaagaacagaaaaaccaaauaauaacaaacgucaaaaacgaaaaagccaugggcccugcaaaacuauucaaauauauagccaaacuacucucaugcgacguugccgauaucaaaggcuaccgcaucgacaaauccgauaaggccgaaauacacaccuuugaagccuacagaaagaugaagacgcuugcgaccaucgacauagaacaaauggaacgggaaaaucuggauaaacucgccuacguccucacccugaauacggaaaaggaggggauccaggaagcacuagagcacgaguucgccgacgguacauucucccaggaacagauagacgagcuaguacaauucaggaaagccaacaguucaaucuucggcaaaggcuggcacagcuuuuccguaaaauuaaugauggaacucauacccgaacuuuaugccacauccgaggaacaaaugaccauccucacucggcucggcaaacagaagacaacgagcagcucaaacaagaccaaauacaucgacgaaaaacagcuaacugaagaaaucuacaaccccgucgcggccaaauccguacgccaagcaauaaaaauaguaaacgcggccaucaaagaauauggagacuucgacaacaucgucaucgaaauggcacgcgaaaccaacgaagacgacgaaaagaaagcuauccagaaaauacaaaaggccaacaaagacgaaaaagacgccgccaugcuaaaagcagccaaccaguacaacgguaaagccgaacucccacacagcguauuccacggucacaagcaacuagcaacaaaaauccgccuauggcaccaacaaggggagcgcugcuuauauaccggcaaaaccaucagcauccacgacuuaaucaacaacagcaaccaguucgagaucgaccacauauuaccgcucuccauaaccuucgacgacagccuugcaaacaaagugcugguauacgccacugcaaaccaggaaaaaggccaacggaccccauaccaggcucucgacuccauggacgacgccuggucuuuccgugaacuaaaggcuuucguccgagacuccaaagcccucuccaacaaaaagaaggaguaccuccugaccgaggaggacaucucgaaguucgacguccggaagaaguucauugagcgaaacuuaguagacacacgguacgccagcagggugguccucaacgcguugcaagagcacuuucggguccacaaaacagauaccaaagucagcgucgugcgaggccaauucaccucgcaacuacgacgccacuggggaauugaaaagacgcgagauaccuaccaccaccaugccguggacgcucucauaaucgccgccuccucccaacucaaccuauggaagaaacagaaaaacacucucguuucguacucggaagaccaacuucuggacaucgaaacgggggagcucaucagugacgacgaauacaaagaaagcgucuucaaagcaccauaccaacauuuuguugacacacuuaaaucgaaagaguucgaagacuccauccuuuucagcuaccaaguugacuccaaauucaauagaaaaaucagcgacgcgacaauauacgccacgcgacaagcaaaaguuggaaaggacaagaaagacgaaacauacguccucggcaaaaucaaagacaucuacucgcaaaccggcuaugacgcuuucaucaaaauauacaagaaagacaaaucaaaauuccucauguaccgacacgacccgcagacauucgaaaaaguaauagaacccauauuggaaaauuaccccaacaaagaacuuaacgaaaaagggaaggaaguccccugcaaccccuuccuaaaauauaaggaagaccacggcuauauucgaaaauacuccaaaaagggcaaugguccggaaauaaagagccucaaauacuacgacuccaaacugggcaaccacauugacaucaccccgaagaacuccaacaacaaagucguacuacaaagcguauccccauggcgggccgacguguacuuuaauaaaacgacaggaaaauacgaaauccuuggacuaaaauaugcagaucuaaaauuugaaaaaggcaccggaacguacaaaaucagugaagaaaaguacaaugauaucaagaucaaggaaggaguugacuccgauagcgaguucaaauucacacuuuauaaaaacgaccuccuacucauaaaagacaccgaaaccaaagaacagcaacucuucagauuccucagccgcacgaugcccaacguaaaacacuacguagaacucaaaccauacgacaagcagaaauuugacgacaaugaggaacuuauaaaaauccugggaauaguagcgaaaggcggacaaugcaagaaaggagucagcaaaccaaacauaagcaucuacaaaauacgcaccgacguccuagggaaccagcacaucaucaagaacgagggcgacaagcccaaacucgacuucuga

SEQ ID NO: 6286 - RNA, 3384 nt, Artificial Sequence
  Cas9 variant
augaacggacugguccuaggccuagauaucggaauagccuccgucggaguaggcauacucgagaaagacucgggaaaaaucauacacgcuaacucacguaucuuuccagcagcuacagcugacaauaacgucgagcgacgaacaagucgacaagcgcggcgacucaaccgacgcaaaaagcaccgaagcguccgccuacacgaccucuucgaagaauacggacugcucaccgacuucuccaaagucuccauaaaucuuaacccauaccagauccggguucaaggacucgacaagcgcuuaaccaacgaagaacuauucaucgcccucaagaacaucgucaagcggcgugguauaagcuaccuagacgacgccucggaagacggaggcgccguaaguuccgacuacgggaaagccgucgaagagaaccgcaaguuacuagcucagcaaacuccaggacaaauacaacucgaccgcuuugaaaaguauggccagguccgcggagacuucacagucguagagaauggcgaaaagagacgccuuaucaaugucuucuccaccagcgcauacagaaaagaggcggaacggauucuccgcaaacagcaggaguucaacaauaagaucaccgaaggcuuuauagaggacuaccucaccauccucacuggcaaacggaaguacuaccacggacccgggaacgagaaaagccgcaccgacuacggccgcuacaccaccaagaaagacucgcaaggagaguacaucacacucgacaauaucuucggcauccucaucggcaaauguaccuucuacccagaugaauaccgcgccagcaaagcauccuacaccgcccaagaguucaacuuacucaacgaccuaaacaaccucacagucccaacagaaaccaaaaagcucagcgucgaacagaagaaaacaauaguagaguacgccaaaacggccaaaacccugggagccuccacccuccuaaaauauauagccaaacuaaucggggucagcgucgaccaaauccacggguauagaaucgacccuaacgaaaaacccgaaaugcacaccuucgaaguguaucgcaagaugcaaucccuggaaaccauccgcguagaagaacuaccacguaaagucauagacgaacuggcccacaucuuaacgcucaauaccgaacgagagggcauugaggaggcaaucaacgccaaguuaaaagauauauucucucaagaccaaguacuugaacucgugcaauuccguaaaaacaauuccucacucuucucaaaaggauggcacaacuucucacugaaauuaaugauggaacuaauuccggagcuguacgagacaucggaagaacaaaugaccauacucacgaggcugggcaaacaaaagagcaaggagacuagcaaaagaacaaaauacaucgacgagaaagaacuaaccgaggaaauauacaaccccguagucgccaaauccguacgccaagccauuaaaaucaucaacgaagccaccaaacgguacggaaucuucgacaacauaguaaucgaaauggcccgcgaaaacaacgaagaagacgcgaaaaaggaauacaucaaacgccaaaaggcaaaccuggacgagaaaaaugccgcuauggaaaaagccgccuuccaguacaacggcaaaaaggaauuaccagacaacguauuccacggccauaaagaacucgccacgaagauacgucucuggcaccagcagggagaaaagugccucuacacaggcaaaaacauccccauaagcgaccucauccaaaacagauacaaguacgagauagaucacauccucccccucagccucuccuucgacgacucccucagcaacaaaguccuaguacuugccacagccaaccaggaaaaaggacaacgaacacccuuccaagcccucgacuccauggauuacgcuuggucauacagggaguucaaauccuacgugaaggacaguaagcuacucuccaacaaaaagaaggacuaccuucucacugaagaagacaucucaaaaaucgaaguaaaacaaaaauucauagaacggaaccuggucgacacacgguacucuucacgcguagucuugaacgcccuacaggacuucuacaaagaacaccaauuugacacaaccaucagcguaguccgaggacaauucaccucgcagcuccgacgcaaauggggaaucgagaagucaagggagacauaccaccaccacgcagucgacgcccugauaauagcugcaagcucccagcuacgacuguggaaaaagcauaacaacccccucaucuccuacaaagaggaacaauucguagacuccgagaccggagagauaaucucaaugagcgacgacgaauacaaagagcucguauucaaggcgccauaugaccacuucguagacacccuaaaaucgaagaaauucgaggacucaauccuguucucguaccaaguagacucaaaauacaaucgcaagauaagugacgcaacgauauacgcgacgcggaaagccaaacuugacaaagacaaguccgaggagacguacguccuaggcaaaaucaaggacaucuacucacaagccgguuacgacaccuucaucaaaauauacaacaaagacaaaucaagauuucucauguaucacaaagacccacagaccuucgaaaaggucaucgaagaaauccuucgcaccuaccccagcaaagaacucaacgagaaaaacaaggaggucccgugcaacccguucgaaaaguaccgccaggaaaacggcccgauacgcaaauacagccgaaaaggcaacggacccgaaaucaaaucccucaaauacuacgacaauaaacuuggcaaccauaucgacauaacacccaacgaguccaugaaccaggugguacuacaaagccuuaaacccuggcgcaccgacgucuucuucaaccaccaaaccgaaaaguacgaacucaugggccugaaauacagugaccugaacuucgagaagggaagcggaaaguacaguaucucucucgaaaaauacaacucgaucaaaaugaacgaagggguaucagaagagagcgaguucaaauucacacucuacaaaaacgaccucauacuaaucaaggacgcacuaaccaaagaggcgcaaauauucagauacggaucccgaaacgacaccagcaagcacuacguagagcuaaagccguacgacaugagcaaguuugaaggcgaugaacgccuaaucaaaguccuaggcacggucgccaaaggcggccgaugcauaaaggggcuaaacaagaaagacaucucaaucuuuaaagucaaaacagacgugcucggaaacaaacacuucauaaagaaagagggggaagaacccaagcuaaaauucuga

SEQ ID NO: 6287 - RNA, 3387 nt, Artificial Sequence
  Cas9 variant
augaccaaacuaggaaaaccauacggaaucggggucgacauaggcuccaauuccauuggguucgcagcagucgacgaaaauucgcaccucauccgccuaaaaggaaagaccguaaucggagcccgccuauucgaagaaggcaaggccgccgccaagcgacgagccggacgcaccacccgacgacgucuuucgcgaaaccgcuggcgacucagcuuccuacgcgacuucuucgagagucacaucacccccaccgacccaaacuucuucaugaggcaaaaguacagcgagauaucacccaaagacaaagcuagauauaaguacgagaaacgccuauuuaacgaccgcacagacgccgaguucuaccaacaauacagcaccauguaccaccuacgaaaccgccugaugacagacccgaguagagcggacguccgggaaaucuacuucgccauacaccacauacuuaagucccgcggacacuuccuaacccccggggaugccaaagacuuuaacacuaacgacgucgcucuugaugaaaucuuccccgcacuccaagaugcguacgcacagguguaccccgacuuaggaauaacuuucgacgaagacaaggccaacgaguucaaaaccauacuucucaaugaaaucgccaccucaauugauacucaacgcgcccuagucaaacugcuccuggcggaagaagacgacaaagacauacuaaaacaacaaaagcaaguccucacagaguucgcaaaagcagucguaggucuaaaaaccaagcuaaaucucgcccuaggcacagaagucgacuccagcgaagcaaccgccuggaauuuuucccucggccagcucgacgauaaaugggccggcaucgaauccgccaugacagacgagggcacggaaauacuagaccaaauccgcgaccuguacagagccagacucuuaaacggcaucguacccacuggcaaaacgcucucccaggcaaaaguggacgacuacacacagcaccacgaagaccuccaacuauucaaggcguaccuaaaacagcucgaagacgacggcaccgccaaagccauccgacaacuuuacgaucgauacauagacggcgacgacgcagccccuuuccuccgcgagaacuucguaaaagcccuaaccaaagacgugaccgcccacccgaacacaaaaucacccgaacuacucgaacgauuagcacaaccagacuucaugcuaaagcagagaaacaaagccaacggcgcuauacccguccaaaugcaacaacgagaacucgaucaaauaaucaaaaaccaggccgucuacuacgacuggcuagccgcccccaacccaguugaaaaacaccgaaagucgaugccauaccaacuagaugaacuacucaacuuccgcauaccguacuacguagggccacucguaaccgcuaaagaacagaaggcggcgcaaggcggugucuucgccuggauggugagaaaagacccugaaggcaauauaaccccauacaauuuugacgaaaaagucgaccgcgaggccuccgcaaacaccuucauccaacggaugaaaaccacugacaccuaccucauuggcgaagacguacuaccaaaacaaucacuacuauaccagcgauacgaaguacuaaacgaacuaaacaacgugcgugucaauaaugaaaaauuaucaaucgaacaaaaacaacaaguaauccgagaacucuuugagcgccacaacuccguaaccaucaaacaauucgcagaaaaccuaagagcacacggcgauuacgcccacauccccgaaauccgcggccuagcagacgaaaaacgcuuccuuagcucgcucucaacauaccgacaacucaaaucacuucuccccgaagcgauagacgaccccgcuaagcaagcggacauugaaaacaucauagccuggagcaccgucuucgaagaugccgccauauuuaaaacgaaacucaaagaaauuuccuggcuaggauccgaggccauaaccaaacuaagcaacauucgauaucgcgggugggggcaauucagccgaaaauucuugaacggccuuacacugggcaacgggcauaccaucauucaagagcugcuccucucaacaaacaacuugaugcaaauacugaccgacgaaacccuccaaaagaaaaugacugaacucaacgccgacaaacuaaaaaccgcaaauaucaacgacgcaauagauaacgccuacaccagcccuucaaacaagaaagcccuacgccaaguacuccgagucgucgaugauauaaaaagagccgcugauggccaagaccccagcuggcuauacguggagacagcagacggcggcgguacccccggcaaacgaacaagagcacgucaacaccagcuacaggaaauauacgcaaacgcagcccacgaacucaucgacaccgccguacgaggcgaacucgaagacaaaaucagugacaaggcagacuucaacgaccgucuaguccucuacuucaugcagggaggccgugacaucuauacaggcgcaccccucaacaucgaccaacucagcucauacgacaucgaccacauucucccccagucccucauuaaagacaacucacuggacaaccgcguccucguacacgccauaaucaaccgggagaaaaacgccaccuucgccagcaccaucuacgcccagaaaaugaacgccaccuggcgacaguggcacgaagcaggacucauaucgggaagaaaacuuagaaaucuccaaaugcgcccugaccagaucgauaaguacgccuccggcuucgucgccagacagcuaguggaaacacgucaaaucaucaagcucacugaacaaauaguagccgcacaguacccagacaccaaaaucauagccguaaaagccggguuaucgcaccaacuucgagaggaacuggaguuccccaaaaaucgcgacgucaaccacuaccaccaugccuucgacgcauuccuugcagcccgcaucggaaccuaccuccucaaaagguuccccaaccuccaagccuucuucaccuacggcaaauuuaccaaggccgacgucaaaaagcuccgaggcuucaacuucauaagagacaucacacacgcggaagacaaaaucguagcgaaagacacuggcgaaguaguaugggacaaacaaagggauguagacgaacuugacagaaucuacaauuucaagcgcaugcucaucacccacgaaguccgcuucgaaacagcagaccucuucaagcaaaccguauacggggcccgagacucaaaagaggcaggaggcuccaaacaacuuauccccaagaaaaaggacauccaacuaaucuucaugggcgcgaucuccgaaagaacacgacccauccuaccacuauga

SEQ ID NO: 6288 - RNA, 3387 nt, Artificial Sequence
  Cas9 variant
auggacgagaaaauggacuaccgcauaggacuggacauuggaauagcaagcguaggcugggccguccuccagaacaacagcgacgacgaaccagucagaauaguagaccugggagugagaaucuucgacacggcagaaauuccaaagacuggagaaagucucgccggacccaggagggcagcgagaacaacaaggagacgccuaagacgacgaaaacacagauuagaucgaaucaaauggcuauucgaaaaccaaggcuuaauaaacaucgacgacuuccucaagagauauaacauggcuggccuaccagacgucuaucaacuccgauacgaagcauuagacagaaagcuaacugacgaggaacuagcccagguacugcuacacaucgcaaaacacagaggauuccgcagcacccgaaaagcagagacagccgcgaaagagaacggagcgguccuuaaagccaccgacgaaaaccaaaagcgaaugcaggaaaaaggcuaccggaccguaggcgaaaugaucuaccuagacgaagcauuccgcauagggugcagcugguccgaaaaaggauacauucuaaccccaaggaacaaggccgagaacuaccagcacacaaugcugcgagcaaugcucguggaagaagucaaagaaaucuucagcagccaaaggaggcuggggaauaaaaaggcgaccgaggaacuggaggagaaauaucuggaaaucaugacuagccaacgauccuuugaccugggcccgggaaugcaacccgacggaaaacccagucccuacgccauggagggcuucagcgauaggguaggcaaaugcaccuuucugggggaccaaggcgaauuaagaggcgcaaaaggaacauacacggccgaauacuuugucgcgcuccagaaaaucaaccacacgaagcucgucaaccaagauggcgagacacgaaacuucacagaagaagaacgaagggcccuaacacuccuccucuucacgcaaaaagaagucaaauaugcggccguacgaaagaaacucggacugccagaggacauccuauucuacaaccucaauuacaagaaagccgcgaccaaagaggaacaacaaaaggaaaaccagaauacggaaaaagcuaaguucauaggcaugccauacuaccacgacuacaaaaagugccucgaagaaagagucaaauaccuaacagaaaacgagguacgcgaccucuucgacgaaauaggcaugauccuaaccugcuacaagaacgacgacuccagaacggaacgccucgcgaagcuagggcuggucccgaucgaaauggaaggccuccucgcauacacacccaccaaauuccaacaccugagcaugaaagccaugcggaacaucauccccuuccuugagaaaggaaugacauacgacaaagcaugcgaggaagccggauacgauuuuaaggccgacucaaaggggaccaagcaaaaacuacuaacgggagagaauguaaaccaaaccaucaacgagaucacgaacccgguagugaaacgcagcgucucacaaaccgucaagguaauaaacgcaauuauaagaacauacgggaguccacaagcaaucaacaucgaacucgcaagggaaauguccaaaacauucgaagaaagaagaaaaauaaaaggagacauggagaagcggcagaaaaacaacgaagaugucaagaaacaaauccaagagcucgguaaacugagcccgaccgggcaggacauacuaaaauacagacuauggcaagagcaacaagggaucugcauguacucggggaaaaccauacccuuagaggaacuauucaagcccggauacgacaucgaccacauccucccauacuccaucaccuucgacgacagcuuccgaaacaagguacugguaaccagccaagaaaacagacaaaaaggcaaucguacacccuacgaauacaugggaaacgacgaacaacgcuggaacgaguucgaaacccgagucaagacaacgauacgggacuacaaaaagcaacagaaacuacucaaaaagcauuucucagaagaagaacgcagcgaguucaaagaaagaaaucucacagacaccaaauacaucaccacagucauuuacaacaugauacgccaaaaccuagaaauggccccgcucaacagaccagaaaagaaaaagcagguaagagcaguaaacggggccauaaccgccuaccuccgaaaaagauggggacucccacaaaagaacagagaaacagacacacaccacgccauggacgcgguagucauagcauguugcacagacgguaugauccagaaaauaagucgguacacgaagguacgagaacgauguuacuccaaaggaacagaguucguggacgccgaaaccggggaaaucuucagaccagaagacuacagcagagcggaaugggacgagaucuuuggggugcacauccccaaacccugggagacauuccgcgcggaacucgacguacggaugggagacgaccccaaaggcuuucuagacacccacucggacguagcccuagaacuagauuacccagaauacaucuacgaaaaccuacgacccauauucguaagccgcaugccaaaucacaagguaacaggagccgcacacgcggacaccaucagaagcccaaggcacuucaaagaugaaggaauaguauuaacaaaaaccgcccucaccgaccuaaaacuggauaaagacggugaaauagacggauacuacaacccacagucugaccugcuccuguacgaagcauuaaagaaacaacugcuauuauaugguaacgacgcuaagaaagccuucgcccaagacuuccacaaaccaaaagccgacggaaccgaaggaccggugguccggaaaguaaagauccaaaagaaacaaacaaugggaguguucgucgacagcggaaacggaaucgcagaaaacggcgguauggugcgaaucgacgucuuccgagucaacgggaaauauuacuucgugccuguauacacagccgacguagucaagaaaguacuaccaaaccgcgcgagcaccgccaauaaaccguacagugaguggcggacgauggaagacaaggacuuccuuuucagccuguacucacgggaccuagugcacauaaaaagcaagaaaggaauaccgaucaaaaacgucgacggcagccucggcgaauccaaagaaguauacgcauacuacauaggcgcggacauaaguggggccaaaauagaagggaaagcccacgacagcagauacaccuuccgagggauaggcgugcaaaaauuagaguugaucgaaaaaugccaagucgacauacucggccacauauccacagucaaaaacgaaaagaggaugggguuuucauga

SEQ ID NO: 6289 - RNA, 3387 nt, Artificial Sequence
  Cas9 variant
augaacgacaaaaaccaaaaauaccgacuagggcucgaccucggcacaaauagcauaggauggugcauauacagccuggacgucaacaacaaaccagaaacgcugaucgacauggguguaagaaucuucuccgacggccgggacccaaaaaccaaagaaccacucgcuguggaacggcgaaccgcacggggacuucgccggauacuacaccgcaggaagcugcgcagaagacagauguuccggcuacuacaagagcagggccucaugccaaacgacgcuagcgaggcagcagcacucaagucccucaauccauacgaacuuaggguaaaagcacuugacacgaaacuggaaccguacgaacucggacgcgcuuuauucaaccuaaguguacgcagaggauucaaaagcaaccgcaaggaagccguucaagaaaaggagaaagauagccaaaacgacgccaaaucacagaacgagaaaugcgaacaccucgcaaaggccaucaaagacagcgguuguaggacccucggagaguuccuguggaagcacaagaauaccgaaacacaacaaacagaaaaugaugcccgcaacauaggaaugcguuucguccccggccgcucaaacuacuaccccacccgccggauguacguagaagaguucgaugcaauacguaaagcacaagaacccuacuacucgggcguaaacugggacgcacuacacgaaaaacuauucuaccaacggccccuccgcgcccaggaacgcggcaagugucgcuacaugccagacaaagaaagaacauucaaagccaugcccugcagccagaagauaaggauccuccaagaaguguacaacauggacuacauagacgaauacggcaaaacaauaccacucgaagaagcgcagaccgacagccuaaucagccuacuagacaaacgcgaaaaacucagcuucaaagcaaugaaaaaggaacuaggcaucgacgaaucgugcaccuuuaaccucgagcgcggcgggcgggaauaccuacaagguaacgcagcggcagugaaacuccgcaacaagaaacgguucggagaacugugggacucacuaagccucgccaaacaagacgcaauagucgaaaaauuaauaacagccgacgaggaugccgaaaucaucaguaugcucgcccaauacaaucuaacagacgaacaaaagaagaacaucgccgugaccguacuaccuucgggcacagcaaugcuuugcaaagaggugacagaaaugcucguacaaaagauggaacagaacaaaauaccucuaaccguagcgguacagaugcucgguuacaccuacgcugaccagagcguacgcgaagaagacacacuacccuauuacggcgccauccuaacaggcagcacaaugggcgcacacccagaagccgacgaguccgaacccgagcucaaauacggcaaaauaaguaacccgacaguacacguagcacucaaccagacccgaaccgucguaaacgcccucaucaaagcguacggcaaaccccagcagaucguuguggaacucucccgagaccucaaggcaucccgcgaagcaaaagcacgcauacagaaaacaaucacaaugaaccaaaaacgcaaugaacgagacaacaaaaacaucaccgacaucaccaaaauuccguaccccaaccggaacgaccgacugaaguaucgccugugggaagaacugggaucgggaagcaacuccuucucccguaagugccucuacugcggaaagccuauaagcggcuccgaaauauucaccgaaaacauagaaaucgagcacauccucccguucggacgaacccucuucgacggcgaaaccaacaaaaccguggcccacaccgauugcaaccgagacaaaggagacaggagcccauucgaggccuucggguccucaccaaacggauacaacuggcacgaaauaugugcccgagccaacagccuuaaaaaccccgccaaaagaacacuauucgcagaaaacgcaauggaaaaauucgagaaggacaacucauucauccaaaggcaacucacggacaaugccuaucuaucacgcagugcccuucgcuaucugcgcugcaucugcaaagacgucuggucaaucaacggcgggaugacaaaacucuuacgagacaaguggaauauugacuccauacucaagcgaaaaauagacgacccagaaaucgcccacuucgaacucaaaaacgaucaaauagggcaauacaagaaaaaccgguacgaccacaggcaccacgcccuagacgccagcguaaucgcccuaaucgacagggccaugguacaagaaauaagccaacucaacaaaauccgccugaaaaaccgaauagaggcaccccaaaugccaguccuaagaagcgagcuaaucgagaaagugaaacacauaacaguaucauucaaaccggaucacggcagacaagggaagcuaucaaaggaaacccugcugggcaaaauuaaaaagauagaaaaggucgacaucgacucuauccaaaccgacgacaucgcaagcauaaaagaugacgcgauacgaacgagauucgagaccaagcggcgagaacucggcgauaucacaaaggcgaaggcagcccucaaaaccgaguucccuaaacucgacguuuucaaaaccuauuacgucagccgcacgccgaucgugagccuaacggagaaaaacaucaacagcaucgucgacgagaaaaucaaagaaaagcuaaaaaccuucauuaaggaacacgcagaccugucauucgccgagcaacuacaaaaauucucagaaacagaguggauaggaaaaccaucagccgccgggaaaccgggcaagaaauaucgaaucgaaaaaguacgauguauaaacuggggccaaaccccgauaacaaucaccuccagcgcgguaccccgauaccucugcccagaggacuaucuggccgcaguagucuggcagauucccagcaagaagaaagacaccgaacccgaauauaaagccaccuuccuccgaagagacgaguucgacguaaacaacaaaccaaagaaacucgaaaaaccacaugacgcagcccaauacaucugcaugcuguacaaggacgacuaccuggaguucacggaaucaggugcgacacaccucugcaggaucgcaggacuaccagcaucccaaaacaacaaaaucgacaucagaccaaucuacgcggucuccgauugcaaagacuggaucaucgcaaccaacgaaaacaugcuagagccauguuggaagccccaaaaagaagagaaaagaaucagcguaaacguucucuucggcaaacacaaagcgcgaucggucaccguaaacccgaucggcagagucuuuaggaaauga

SEQ ID NO: 6290 - RNA, 3387 nt, Artificial Sequence
  Cas9 variant
augagcgaccuagugcucggacuagacaucggaauuggcucagucggcguuggaauccucaacaaaguaacgggcgaaaucauacauaaaaacagccgaaucuuccccgccgcccaggcugaaaacaacgucgaacgacgaaccaaccgacaaggacgcagacuaacacgcagaaagaaacaucgccggguacgacuaaaccaucuauucgaggaaagcggacugauaaccgauuucaccaaagucagcaucaaccucaacccauaccaacuccggguuaagggacucauagacgaacucagcaacgaagaacuuuucauagcccugaaaaacaugguuaagcaccgcgggauaucauaucuagacgacgcgagcgacgacggcaauuccucugucggcgacuaugcccaaaucgugaaagaaaacuccaaacaacuugagacaaaaaccccgggacaaauccaacuugaacgguaccaaaaauacggccagcugagaggagacuucacuguggaggaagacgggaaaaagcaccgccuaaucaacguauucccaacaagcgccuaccgcagcgaagcccuccgcauauuacaaacacaaaaagaauuuaacccccaaauaacagacgaguucaucaaccgcuaucuggaaauucuaacaggcaagcggaaauacuaccauggcccaggcaacgagaaaagcagaacggauuacgggcgcuacaccacaaagaaagacagcgaaaacgaauacauuacacuugacaacaucuucggcauccucauaggaaaaugcaccuucuacccagaggaauacagagccgccaaagccagcuacacagcccaggaguucaaccuccuaaacgaccucaacaaccuaacgguacccacugaaaccaagaaacuuagugaggaacagaaaaaucaaaucaucaacuacgucaaaaacgaaaaagccauggguccggcaaaacucuucaaauacauagccaaacuucucucaugcgacgucgccgacauaaaaggauaccgcaucgauaaauccgacaaagccgaaauacauaccuucgaagccuaccguaaaaugaaaaccuuagaaacaaucgauuucgagaaaaugucccgagaucaauuagacaaauuagccuacguccucacacugaacacggagcgugaagggauccaagaggcccuagaccacgaguucgcggacggaaacuucagccaagaacaaaucgacgagcugguccaauuccggaaagcgaacucaagcauauucggaaaaggauggcacaacuucucagucaaacucaugauggaacucaucccagaauuguacgccaccagugaggagcaaaugacaauacucacccggcucggcaagcagaaaacaacaagcucuagcaacaagaccaaauauauagaugaaaagcuacugacagaagagaucuauaaccccgucguggcaaaaucgguacgucaagccaucaaaaucgucaaugcagcaauaaaggaauacggcgacuucgacaacauugucauagaaauggcaagggaaaccaacgaggacgacgagaagaaagccauacagaaaauccaaaaagcuaacaaagacgagaaagacgccgcaaugcuaaaagcggccaaccaauacaauggcagagcagagcuaccccacucggucuuccauggacacaagcaacucgcaacgaaaauucgccuguggcaccaacaaggagaacgcugucucuauaccggcaaaaccaucucgauacacgaccugaucaacaacccaaaccaguucgaaauagaccacauccuaccgcucucgaucaccuuugacgacucccuagccaacaaaguccuagucuacgccacggccaaccaggaaaaagggcaacggacacccuaucaggcccuagacagcauggacgacgccugguccuuccgggagcucaaagcauucguacgagagucaaagucccucucaaacaaaaagaaggaauaccuacuaacugaagaagacauaagucguuucgauguacgcaagaaauucauagagcgcaaccuaguagacacccgcuaugccucccgggucguacuuaacgcgcuacaagagcacuuccgcgcacacaaaaccgauacaaaaguguccgugguacggggccaauucacuagccagcuccgccgccacuggggaauagaaaagaccagggacacguaccaccaccacgccguagacgcccuaauaauagccgcaagcagccaacucaaccuauggaagaaacagaaaaacacccucgucaacuacucagaaaaccaacuacucgacaucgaaacaggcgaacucaucagcgacgacgaauacaaagaaaguguauucaaagcccccuaccaacacuucgucgacacacuaaaauccaaagaguucgaggacagcauccucuucaguuaccaagucgauucgaaauuuaaccgaaaaauaucagacgccaccaucuacgccacgcgccaagccaaagucggcaaagacaagaaggacgaaaccuacguccucggcaagauaaaagacaucuacucccaaacgggauaugacgcauucaucaaaauuuaccagaaagacaagagcaaauuucucauguaccgucacgacccccaaacauucgagaaaguaaucgaacccauccuggaaaacuacccgaacaaagagaugaacgaaaaaggcaaagagguacccugcaacccguuccuaaaguacaaagaggaacacggcgauuacauccgaaaauacucaaagaaaggcaacggcccagaaaucaaaucgcuuaaguacuaugacucaaagcuaggcaaccacaucgacauaaccccaaaagacuccaacaacaaagucguacuccaaagcguauccccauggagagcggacgucuacuucaacaaaaccaccggaaaauacgagauacucggccugaaauacgccgaccugcaauucgaaaaaggcaccggaaccuacaaaaucagccaggaaaaauauaacgucaucaaaaagaaagagggagucgacuccgacucugaguuuaaauuuacacucuacaaaaacgacuuacuacuaauaaaagacacugaaaccaaggaacaacaacucuucagauuccuaucccgaacaaaacccaacguaaaacacuacgucgaacucaaaccguacgacaagcaaaaguucgagggcaacgagucgcugaucaacgucuugggcgccguagcaaaagguggacaaugucagaaaggcaucaacaagcccaacauaagcauauacaaggugagaacagacguccucggcaaccaacauaucaucaaaaacgaaggcgauaaaccaaaacuagauuucuga

SEQ ID NO: 6291 - RNA, 3387 nt, Artificial Sequence
  Cas9 variant
auggacgagaagauggacuaccgaauagggcuagacaucgggaucgccuccguaggcugggccguacuacagaacaacagcgacgacgaacccguacgaauaguagaccuaggaguacgaauuuucgacacagcagaaauacccaaaacuggcgaaagccuagccggacccagacgcgcggcaaggacaacacgccgccgccucaggcggcgcaaacaccgacuagaccgaaucaaguggcuuuucgagaaccaaggccucaucaacauagacgacuuccuaaaaagguacaauauggccggccuccccgacguauaucagcuucgauacgaagcgcuggacagaaagcucacagacgaggaacuagcacaaguccuguuacacaucgccaagcaccgagguuuuagauccacacgaaaggcugagaccgccgcaaaggaaaauggggccguccuaaaagccacggacgaaaaccaaaagagaaugcaggaaaagggauaccggaccgucggagaaaugaucuaccucgacgaggcuuuccggacgggauguuccuggagcgaaaaaggguacauacuuacaccccggaacaaagcagaaaacuaccagcacaccaugcuccgugccaugcucguagaagaagucaaggaaauauucagcagccagaggcgccuaggcaacgagaaagcgacagaagaacuggaggaaaaauaccuagaaauaaugacgagccaacgaucauucgaccuagggccaggcaugcaaccagauggaaaaccgagcccguacgccauggagggcuucuccgauagaguuggaaagugcacuuucuugggcgaccaaggagaacucagaggggcaaaaggaacauacacagcagaguacuucgucgcgcugcaaaagauaaaccacacgaaacucgucaaccaggacggugaaacgcggaacuucacagaagaggagcgccgcgcacugacccuacuucuuuucacgcaaaaggaaguaaaauacgcugcaguaagaaagaaacuaggccucccagaagacauacucuucuacaaccugaauuacaagaaggcagcgaccaaagaggaacagcaaaaggaaaaucaaaacacagaaaaggcuaaauucaucggaaugcccuacuaccacgacuacaagaaaugccucgaagaacgggucaaauaccugacggaaaaugaggugagagacuuauucgaugaaaucggcacgauccuaaccugcuacaagaacgacgacucgcgaacagaacggcucgccaagcucggccuaguaccgauagaaauggaaggccuccuggccuauaccccaacgaaauuccaacacuuauccaugaaggcgaugagaaacauaauacccuuccucgagaaaggcaugacauacgacaaagccugcgaagaagccggauacgacuucaaagccgacuccaagggaaucaagcagaaacuucugaccggcgaaaaaguaaaccagacgaucaacgagaucacgaaccccgugguaaaaaggagcguaucgcagacugugaaaguuaucaacgcgaucauucgaacguacggcucuccgcaagccaucaacaucgaacucgcacgagaaaugagcaaaacauucgaagaacgccgcaaaauaaaaggagacauggagaagaggcagaagaacaacgaagaugucaagaaacaaauacaggaacuggggaaacucucgccaacugggcaagacauccuaaaauacagacucuggcaagaacaacaagguauaugcauguacucgggcaagacgaucccccuagaggagcuauucaagccgggauacgacauagaccacauccuaccauacagcauaaccuucgacgacuccuuccguaacaaagucuuagucaccucacaggaaaacaggcagaaaggcaaccgcaccccauaugaguacaugggcaacgacgaacagcgcuggaacgaguucgaaacaagagucaagaccaccauacgagacuacaaaaagcagcaaaaacuucucaagaaacacuucucagaagaagagagaagcgaguucaaagaaagaaaccugacugauacaaaauacauaacgacggucauauacaacaugauccgacagaaccuagagauggcaccacuaaaccgaccagaaaagaagaaacaagucagggcagugaacggcgccaucacggccuaccuacggaaacgcuggggauuaccgcagaaaaaccgcgaaacagacacccaccacgccauggacgcagucguaauagcaugcugcaccgacggcaugauccagaaaauaucacgcuacaccaaaguccgggagagaugcuacaguaaaggaaccgaguucgucgaugccgaaacgggggagaucuuccggccagaagacuacucacgggcagaaugggacgaaaucuucggaguacacauccccaaacccugggaaaccuucagagccgagcuagacguccgcaugggcgacgacccuaaagguuuccuggacacacacagcgacguagcgcuagaacucgacuacccagaauacauauacgaaaaccuaaggcccaucuucgugagccgaaugcccaaccauaaggucacaggagcagcccacgcggacacaauacgcucaccgcgacauuucaaggacgaaggaauaguacuaaccaaaacagcacuaaccgaccugaagcuggacaaagacggcgaaaucgauggguacuauaacccgcaaagcgaccugcuacuguacgaagcacucaaaaagcaacuccuccuguacggaaacgacgcaaagaaagccuucgcgcaggacuuccacaaacccaaagcggacggcaccgagggaccaguaguacgaaaaguuaaaauccagaagaaacagaccaugggagucuucgucgacagugggaacggaaucgcggaaaacggaggcauggugcgaauagacgucuuucacguaaacgggaaguacuacuucgugccaguauacacagcggacgucguaaagaaagugcuacccaaccgcgcagcgacagcccacaaaccauacggcgaguggaaaguaauggaagacaaggacuuucuguucagccuauacucccgggaccugauacacauaaaauccaagaaagacauccccaucaaaaugguaaauggcggaauggagggcaucaaagaaaccuacgccuauuauauaggcgccgacaucagcgcggccaacauacaagggauagcgcacgacagcagguacaaguucagaggacuaggcauccaaucucuagacguccuagagaaaugccagaucgacguccugggacacgucagcgugguacgaucagaaaaacgaaugggguucagcuga

SEQ ID NO: 6292 - RNA, 3387 nt, Artificial Sequence
  Cas9 variant
augucugaccugguccucggccuggacaucggcauaggcuccgucggcguagguauacucaacaaagugaccggcgaaaucguccacaagaacgcccgcauauucccugccgcccaagccgaaaacaacgucgaacgccgcaccaaccgccaaggacgaagacucacccgucgcaagaaacaccgacgcguccgacucaaccacauauucgaagaauccggcuuaauaacggacuucacaaaagucucgauaaaccugaaccccuaucagcuccgggucaaaggcuuaacggacgaacuuagcaacgaagaacucuucauugcccucaaaaacauggucaaacacagagggauaucauacuuagacgacgccuccgacgacggcaauuccucagucggcgacuacgcacaaaucgucaaggagaacucaaaacaauuagaaacaaaaaccccggggcaaauccaauuagaacgauaccaaaaauacggccaacugcgcggcgacuucaccaucgaggaggacggcaaaaagcaccgccuaauaaauguauucccaacaagugccuacagggccgaggcccucagaauacuccagacacaacaagaauuuaacccacagaucaccgacgaguucauaaauuccuaccuacaaauccuaaccgggaaacgcaaauacuaccacggucccggcaacgaaaaaucccgcaccgacuacggacgauacaccacaaagaaagacucugaagaugaauacaucacucuagauaacaucuucggcauccucaucggcaaaugcaccuucuauccagaagaauaccgggccgccaaagcaucauacacagcccaagaguucaaccuccucaacgaccucaacaaccucaccgucccaaccgagacgaagaaacuaucagaggaacagaaaaaucagaucauaacauacgucaaaaaugaaaaagccaugggucccgcaaaacucuucaaauacauagcaaaacuccucgccugcgacgucgcagacauaaaaggcuacaggaucgacaagucggacaagcccgaaauacacacauucgaagccuaccgcaaaaugaaaacccucgaaaccaucgacguagaacagauggaaagagaaaaacuagacaagcucgccuacguucucacacuaaacacagaaagggaaggcauacaggaagcuaucgaacacgaguuuucugacggcacguucucccaagaacaaguggaugagcucguacaguuccggaagucaaacucuuccaucuuuggcaagggauggcauaacuucagcgucaagcugaugauggaacucauuccagagcuauacgcaaccagugaggaacagaugaccauacugacacgccuuggcaagcaaaaacgcacgagcagcagcaacaaaaccaaauauauagaugagaaaaggcucacagaagaaaucuacaauccaguaguggccaaguccgugcgccaggcuauuaagaucgucaacgcagccaucaaggaauacggggacuucgacaacauaguaauugagauggcccgcgaaaugaacgaggacgacgaaaagaaagcgaucaaaaagauacaagaggccaacaaaucagaaaaagacgccgcuaugcguaaagccgcaaaucaauacaacggcaaagcagaacucccccacagcgucuuccacgggcauaaacaacucgccaccaagauccgcuuauggcaccaacagggggaacgaugccuauacacaggcaagacgaucuccauacaugaccugaucaacaaccccaaccaguucgagaucgaucacauccucccgcuauccaucacguucgacgacucccuagccaacaagguacucguauacgcuacagccaaccaggaaaaaggacagcgcacacccuaccaggcucuagacagcauggacgacgcauggagcuuccgcgagcuaaaggccuucguccgggaauccaagacacuuagcaacaagaaaaaggaguacuuacugaccgaggaagacaucaguaaauucgauguacgcaagaaauucaucgaacguaaccucguggacacacgguacgcaucgcgcguaguccucaaugcacuccaagagcacuuccgcgccaggaaaaucgauaccaaagugucaguaguccgaggacaguuuaccucucaacuaagaagacacuggggaaucgacaaaaccagagacaccuaccaccaccacgccguggacgcacuaauaauagcggcuagcucccaacucaaccucuggaaaaagcagaagaacacccuaguuucuuacuccgaagaccaacugcuugacauagaaacaggagagcugauuagcgaugacgaauacaaagaauccguuuucaaagcgcccuaccaacacuucgucgauacauuaaaaucaaaagaguucgaagacagcauacucuucucuuaccaagucgauagcaaauucaaccgaaaaauaucagacgccaccaucuacgccacccgccaagcaaaggugggaaaggacaagaaagacgaaacauacguccucggaaaaauaaaagacauauacagccaagccggcuacgacgcauucaucaaaauauaccagaaagacaaauccaaauuccuaauguaccgccaugacccccaaacauucgaaaagguaauagagccaauccucgaaaacuaccccaauaaagaaaugaacgaaaaggguaaggaaguaccuugcaaccccuuccucaaauacaaagaggaacacggagacuacauccgaaaauacucgaagaagggcaacggacccgaaauuaaaucccuaaaauacuacgacucgaaacuaggcaaccacauagacauaaccccaaagaacagcaacaacaaggucgugcuccaaucagucucgccauggcgugcggauguauacuucaacaaaacgacgggaaaguacgaaauacucggacucaaauacgccgaucuacaauucgaaaaagguacagggaccuauaaaaucucccaagaaaaguacaacgauaucaagaagaaagagggcguagauucagacucagaguucaaauucacgcuauacaaaaacgaccuacuccucaucaaagauacagaaaccaaagaacaacaacucuuccgauuucuaucccgcucaaugcccaacaagaaacacuacgucgaacugaagcccuacuccaaagauaaauucgagaaaaacgaaacccuuaucgaaauacuaggccccacggacaaaucaggucguugcauaaaaggccucgccaaaucaaaccugagcaucuucaagguacguacugauauccuaggaaaccagcauaucaucaaaaacgaaggcgacaagcccaagcucgacuucuga

SEQ ID NO: 6293 - RNA, 3387 nt, Artificial Sequence
  Cas9 variant
augaccaagauuuuaggucucgacuugggcaccaacuccaucgggugggcagucguagacgaaaagaaagagaaaauccuaggaaugggcucccguaucuucccggaaggcgucgucaauaucggggaaggagagggcagagaaaccagcaaaaacgcaagccgcaccgacgccagggggacccgccggcaauucuuccgaagacgccuaagaaaacgauaccuccuacgugaacucgccaagaaaggucuaugcccaaucaacuacacacugguaaaagaauggaacgaggcccaaaucuucaaaaacaaacagcuccaagaaugguucaagcucaacccguacgaacuccggagcaaggccauacaggagaaaauuucccucgaagaacuaggccgaaucuucuaccacuucauccaacgaagaggcuuccaguccaacagcagauccgcaggagucgacaacauagaaaagagcguuauuuucaaaggcgacacgaaaaccggcaagaucggaaucuccgagacacucgaaucgaucaagaacaccaaaacccuaggcucguaccuccacaccaucuacccgaaacagaauaagccauauagcggacacaaggagagaauccgaaaccgguacacaacccgccagauguacaucuacgaguucgaaaccaucugggaauaccagaaacaauucuacagcgagcucagcaacgagcuuaagaccgugcugggcggacgaaagaaagacggcuacaaagaagacggcauauuauuccaccagcggccacugcgaagccaaaaacaccuggugggcuacugcagcuucgaaccaaagaagaccaaaugucaaauuaacaccaucccauuugagcuauuccggaucuaccaaugggugaacaccgucgacugcaacgaaaaggucaccucagaagaccgcggaaaaauggucgagcuucugcugagcaaggagaaagucuccuucaaggaaauccgcaaagucaucaacaaaucggauggauacuaccaauucaauuacaaaaacgacgacaaaaucguaggcucauauaccaucuccaaccugagcaacaagaaauucuucggaaagaaaugguuugacuucucugacaaagagcaggaagacaucuggcacguccucucauucuucgacgaccgagacaaacucaaacaauaugcaaucaaguacuggggauucaacgaggaaaaggcagucaaaaucucgaaauuuaaccuaaaggaaggguacuccaacuuaagcagaaaagcaauacacaacauccucccauucuugaaacuaggcuucauguacgacgucgcggugggccucggcggcgucaagaacgcccucgcggacaaguggauagaaaaugaacaguucauccucgauaacgugccaucaguggugcgcucaaacuucaagggcggauacauagaaccacucaaacaaaugcuaaaauacgaauuugacgucagcgacaagcaacugcuaaaacucuaccaucacagcuccgccauagaaaccaccgaacuacucaagaaauugcccaucaacagcgaggccgacaaagaaauacaaucgaucaaaaacccgguaguaauaacagcauuauuugaaauaaggaaacucgucaacgaaaucauagacaccuacggaaaauucgacgaaauuaaggucgagcuggcaagggaccucaaagccucaaaaagcaagcgguacgacacccgccgcgaacaacuacgcuuggagaaagagaacgacaggaucaaaauagaacucgaaaaccucggccagcgaaucaaccacauaacaauucugaaauacaagcuaugggaagaaugcgacaaacgaugcccauucaccgggaaaaauaucgaaguaaacgaacuauuuagcggcgaaguacagaucgagcacaucuuccccuggucucgcucacuaaacgacuccuucaugaacaaaacccucugcuuugcagacgaaaaccgcgcuaaaggcaacaagacaccauaugaguucuacagcgaacaaggagaacaaaaaugggaggaaauaaaaauacaagcccucucaugcuuuaaaaacaaaccaaauuacccaaacgcauaccaaaaauucaaacaauucguaaagaagaaacacgaugaagacuucauaagcagacagcucaacgacacacgcuacaucagcaaagaagcgaagaacuaccucucaaagaucugcaacaacguccaagucgcacccggacagaugaccgccacacuccggcacaaaugggggcugaacacgauacugaacaaagacgacgacacaaagacgcgugacgaccaccgacaccacgcaaucgacgcccuaguaauggcaugcagcacucggucacaccuccaagagcucagcaaacgcaaccguuaccaaaaagacuacgaguucaaggacuucccgaugccuuggcaauucuuccggcaagacgccgagaaaagcguagaacaaauccucguaucacacaagaaacuuaacaccauacucacgguccgcacacacaaaaccaaaaagaacgggguagucuauaaaaacaucggaguagccgcgcgcggacaacugcacaaggaaacaguauucggcaaaagaacagccccggacggaaucgaagccuaucacguccggaaaccgauagaaucccucaguacucacaagcacauaaacaaagucgucgacgaaaccauccggcuccuaauacucaaacaaguaaacaagcuagggggauucgucaagggaaaaauaccugaaggcaccuucuacaacaccgacgagaauggaaacaaacaaccacagaucuuccugcccaauaaaaacggcaauccggucccaauaaagaaaauacgccugagagagaacauaggcggagcggaacaacuaaaaucaaccguaaaccagcacgucaacccacgcuccaaccaccacguccuaauauacaaagacuucgaugacaaucucaaagagaaagucguaacuuucuggaccgccgucgaacggaaaaagcaaaaacaagccgucuuucaacucccggaaaacggaaaagagauuguaaccacccuccagauuaacgauauguuccuacuaggacugaaggacgacgagaucaacugggagcacccaaaauucacccuccucaaggaacaccuguaccgaguccaaaaauucaccuccggagacuacuacuuccgcaaacacaucgaaagcaaucugaacggcgaacucgggaaggccuaccaguacauuaaaggauucggagaaggcaaaacaggcuggaagacguucaaccccaucaagaucaaggugagcgucagcggcaaaauugagaaagucuga

SEQ ID NO: 6294 - RNA, 3390 nt, Artificial Sequence
  Cas9 variant
augaacgguuuagugcuaggccuggauauuggaaucgcgucagugggcgccggcauccuaaagaaagauacgggcgagauaauacacgcgaacucgcgacuguuccccgcugccacagcagauaacaacguacugcgacgcucguccaggcaggcucgccgaaguacacgacgcaaacgccaccgugcgguucgccuacacgaccuauucgaagauuacggacugcuaacggacuucuccaaaguauccauaaaucucaaccccuacaaacuccgcgucgagggcauggacauacaacucacgacagaagaacucuucaucgcccucaaaaacaucauaaaacgccggggcauaucuuaccucgaugacgccagcgaagacggcgucacggucucguccgacuacgggaaagcaguagaggaaaaccgcaagcuccuuagugaacagacgccaggacaaauacagcuagaacgcuucgagaaguacggucaggugaggggagacuucacgguagaagaaaauggcgaaaaacgccgacuaauaaacgucuucucaaccagcacauaccgaaaggaggccgaacgaauccuccgcaaacaacaggaguucaacaacaaaauaacggacgacuucaucgacgacuaucucacaauacucaccgggaaaagaaaguacuaucaugggccuggcaacaaaaagucccgaaccgacuacggccgguacacaaccaagaaagacucagaagggaaauacauaacgcuagacaacaucuucggcguucuaauuggaaaaugcaccuucuacccagacgaauaccgagccucaaaggccucuuacacagcacaagaguucaaccuacucaacgaccuaaacaaccuaaccguaccaaccgaaaccaaaaagcuguccgaaaaacaaaagaagacaaucguagaguacgcuaaaacggccaagacccugggcgcguccacgcuucucaaauacaucgcgaagaugguagacgccagcgucgaccaaauccacggcuaccgaguugacgugaacaagaaacccgagaugcacacguucgacgucuaccggaaaaugcagucacuggagaccuucaacguaaaugaaaugccccgggaagugcuagacgaacucgcacacauccucacccuaaacacagagcgggaaggcaucgaggaagccauaaacacgaaacucaagggcaccuucaaccaagaccaagugcucgaacucguucaauuccgaaagaacaacagcucccucuuuuccaaaggcuggcacaacuucucacuaaaacucaugauggaacucauacccgaacuauacgccacuucagaagaacaaaugaccauacuuaccaggcuaggcaaacagaaaagcaaggaaauauccaagcgcaccaaauauauagaugagaaagagaucacggaagagaucuacaauccggucguagcaaaguccguccgccaagcaauaaaaaucauaaaugaggccacaaagcaauauggcaucuucgaccacauagugaucgaaauggcccgccucacaaaugaggaggacgcaaagaaagacuauauaaaaaggcaaaaagcuaaccuagacgagaaaaacgccgcaauggaaaaggccgccuuccaauacaacgggaagaaagaacuccccgacucaaucuuucacggccacaaagagcuggccacgaaaauccgccuauggcaccaacaaggcgaaaaaugccuauacaccggcaaaaacaucccaauauccgaucucauccagaaccaauacaaauacgaaaucgaccacauacugccccuuagucucuccuucgacgacagccuauccaacaaagucuuaguccucgccacagcaaaccaagaaaaaggacaaaggacacccuuccaggcccucgaccgcauggacgacgcgugguccuaccgcgaguucaaaucguacgucaaggacagcaaauugcuugggaacaagaaaaaggacuaccuccuaacugaagaagacauaaguaagaucgaaguaaaacaaaaauucaucgaacggaaccuuguagacacucgguacagcucccgcgucguacuaaacgcacuccaggacuuuuacaaaaaccaccacuucgacaccaccauaagcguaguccgcggacaauucaccucccaacuccggagaaaguggggacuagaaaagagccgcgaaacguaccaucaucaugcagucgaugcccucaucaucgccgcaagcucccaacugcgacucuggaaaaagcaaaacaacccccuaaucuucuacaaggaaggucaguucguggacagcgagaccggagaaauccucucgcuuaaugacgacgaauacaaagaacuuguauucaaagcaccauacgaccacuucgucgacacccuacgcuccaaaacauucgaagacagcauccucuucagcuaccaaguugacagcaaauacaaccgcaagaucucggacgccaccauauacgcaacacgcaaagcaaaacuugacaaagacaagagcaaagaaacauauguccugucaaagauaaaagacaucuacagccaggcaggauacgacgccuucauaaaaauauauaacaaggacaaaucaaaguucuugauguaccacaaagacucgcaaacguucgaaaaagucauugaggaaauccugcgcacauaccccuccaaagaguucaacgacaaaaacaaggaaguccccugcaaccccuucgaaaaauaccgacaagaaaacggccccauucgaaaauacucaaagaaaggaaaugggccugaaaucaaaagccucaaguacuacgacaaaaacauccccgaauccuucaucaacauuaccccauccaacaguaaaaacaaggucauucugcggcagcucaacccuuggagaaccgacguauacuucaaccaccaaaccgaaaaauacgagcuccugggacuaaaauacgccgacuugcaauucgaaaagaagacaggaacguacagcaucacgaucgacaaguacaacgaaaucaaggaaaaggagggagucggagaacaaucagaguucaaauucacccuauauaaaaacgaccuccuccuaaucaaagacaccaaaaacaacgaaaaacaaaucuuccguuuccuauccagaaccaugccaaacgucaagcacuauguggagcucaaaccauacaacaaagcaaaauuugacgggaaccagccccugaucacgaucuuuggcaacguagccaaagguggccaaugucuaaagggucucaacaagccaaacaucuccaucuauaagaucaaaacagacguccucggcaacaaguacuuuaucaaaaaggaaggagacaagccuaaacucaaguucuga

SEQ ID NO: 6295 - RNA, 3390 nt, Artificial Sequence
  Cas9 variant
auggcagacagaauaagccugggacuagacaucggcgucgcaagcguaggauuuucuguccucgacaucgacaaaggaaaggugauagagcuaggcucccgccuauucaacgccacaguagcggagggaaaccaggaucgaagaagcaugcgcggggcacgacgccuccucaacagaaacaaacagcgucgccaggacacaggaaaacuguuccagaaauuuggcuuacucgacaacuucaacaaagacaacuuuuacgacacguucaaccaaaacuggaaccccuacgaacuccgaguaaaaggacucacagaacaccugacaaagaaagagcuugcugaaucgcucuaccagaucguaaaacauaggggaaucucauacgcccucaaagacgcagacgccgacgaaggcggcacugauuacucagcaucccuaaagauuaacucacaagaacucgcagagaaaacgccagcgcaaauccagcugcaacgccuaaacgacuacggcaaaguacgcggccaagugguuauaggugacgacccagacaaccaaaaagugcuccuaaaugucuuccccacguccgcguacgaaaaagaagccaaacagaucaucgccacacaaaaacaguucuacccagaaauacugacugacgaguucacuaaggaauacugcaagauccucaccaggaagcgcgacuacuucguaggaccuggaaacgaaaaaucccgcacggacuacggcauauacaagacagacgggcgaacacucgacaaccucuucgaagaacugauaggccacgacaaaaucuacccggacgaacucagagccagcgcagcaagcuacacagcacaacucuucaacguccuuaacgaucugaauaaccuccgcauccuuagcuacgaagacggaaaacugaccaaagaagacaaagagaaaauaauagccgagaucaagagcaacaccaccacuaucaacaugcucaacguuaucaagaaagucgccggcugcuccaaagaggauaucaaaggcuuccgagucaacgaaaaggacaaaccagagaucagcuccauggccguuuaccgcaaaguacacaaggaccuccucaaagugggaguagacaucucagacuggccaguagaguucauagacaaacucagcuucauccugaccuuaaauacagaaaacggagaaauccgcaagcagcucaacaaccgccucguccccgaguucgacuuccuuaacgaugaccuaauccaacucaucaucgacaauaaagauuccuucgaaaucaaaacaaacaacaaauggcaccgguucucgcugaaaaccaugaacaaacucaugccagaaaugcuggagagaccugucgagcaaaugacccuucuaaacgaaaugggucuggucaagaaagacaagaaacgcuucgaaaacaacaaauaucucccauacaaagaaaucgcgaaagacauuuucaaccccguagcuaguaaauccguacgggaagcauuaaagaucgucaacgccguacuaaagaaguaugggcauaucgacuaccuggucaucgaaaugccccgggacaaaaaucuaaaagaggaacaagacaacaucaaagaguuccagaacaagaacaagaaagcuaaagacgcagcuuucgaagcauucguaaaaagcgucggcucugagcaaagggucaaggaagcccuaucaaagaacagaaaacuucaaaugaaaaugcgacuaugguaccagcaacaagaaaucgacccauacaacggugaaacgaucgacgcaacugaccucauuaacaaccccgacaaguucgaaauagaccacaucauaccacaguccauuaguuucgacgauuccaucaacaacaagacucuuugcuucgccucuaugaaccaaguaaaagggcaaaagaccccguacgaguucaugcucgaaggccacggacaaggcuacgacaaauuuaaagcgacgguacucgauaacaaaaacuucgaccguaacaaacgaaagaacuaccucuuugaggagaacguguccgauaucgagacccgcaaacgauuccugagucgcaaccucguagacacacgauacagcagucgcgucgucuuaaacucccugcaggacuucuuccacgaaaagucugccgacacaaaggucaccgucauccgcgggaaauucacguccaacaugagaaaacacuggcacaucgauaagacacgcgaaaccuuucaccaccacgccaucgacgcgucuauaaucgccgcgacgccuuuccuacgaauguggaagaaaggcggcacgaucuucccaguaaaagugggcgaagaaucgaucgacaucgaaaccggcgagauccuagacgacaagaaauucgacaaaguaauguacgaggaacccuacaacggguucguaucagaaauaaugaacgcagacgacagaauuaaauuuagccaccaaguggacaaaaagaugaaccgcaaggucagcgacgcaacaaucuacucgacccgcaccggaaaacuagcaaaagacaagaaagacgcagaguacaucguagcaaaagucaaagacauauauuccguagacggcuucaagaaauucaagaaaguauacgacaaagacaaaagcaaguucuuacuguacaaguacgaccccaggacauucagcgaacucgaacgcauaaucagcgacugcccagacaaaguggagaaaguccaaacaaacgguaaggugaaagcggucgacguuucccccuucgaaauguaccgaagauaccacgggaugaucaagaaauacucgaagaaaggcaacggcccagcaauaaaacaacuaaaauaucuggacaagaaacucggaucccauaucgacauuaccccggcaaacgccaacggcaaacacguaauacuacaaucccuaaaaccguggagaaccgacguguaccugaaucacgaaacaggagaauacgagauaaugggcaucaaauacuccgaccuaaaauucaacaaaaacgucggcuacggcaucaagaaagacaaauaccuugaaaucaagaaaaacgaagagguaagcgagaaaucagaguucauguucucucucuaccgcaaagaccgcguaagaauccaaaacaugaaaaccggcgaaagcguggaauugcuguucuggagccgcaacuucagcaacaagaaauacgcagaacuaaaaccgaucuucaaauucguaacagaagacgacgacuggcccgucuacggacacgccaaaacacaaauacuaaaacgccuaguaccuaaagacugcaaaauauggaaaguaaacaccaccauccucggcgacccguacuaccuggagaaagaaagcgauaaccccaaagacauucuagauuga

SEQ ID NO: 6296 - RNA, 3390 nt, Artificial Sequence
  Cas9 variant
augacgaacggcaaaauucugggccuggacaucggcaucgcguccguagguguggggaucauagaagcuaaaaccggcaaagugguccacgcaaacucaaggcuguucucggcggcgaacgccgaaaacaacgcggagcgccgaggguucaggggguccagaagacugaacagacggaagaaacacagggucaaaagaguacgagaccucuucgagaaauacggaauagugacggacuuccgcaaccugaaucucaacccauacgaacugagaguaaaaggacucacugagcaacuaaccaacgaggaacuauucgccgcauuaagaacaaucucaaaacgccgcggcaucuccuaccuggacgacgcggaggacgacagcacgggcagcacagacuacgccaagagcaucgacgagaaccgccggcugcucaaaaccaaaacaccaggccaaauccaacuagaacgccuugaaaaauacggccaacuacgagggaacuuuaccguauacgacgagaacggagaggcacaccgccuuauaaacgucuucagcacgagcgauuacgagaaggaggcgcgcaagauccuagaaacccaagcugacuacaacaagaaaauaaccgcggaguucauagacgacuacguagaaauacugacgcaaaaacggaaauacuaccacggccccgggaacgaaaaaucacggacagauuaugggcgcuuccgcacggacggcaccacgcucgaaaacauauuuggcauauuaaucggaaagugcagcuucuacccagacgaauaccgggccuccaaagccucguacacugcccaggaguacaacuuccugaacgaccuaaacaaccuaaaggucccaaccgagaccggcaaacuaagcacggagcaaaaggaagcguuggucgaguucgcgaagucgacggcaacccuagggccggccaaacuacucaaagaaaucgcaaaaauacucgacugcaagguagacgaaauaaaaggauacagggaagacgacaaaggcaagcccgaccuucacaccuucgaaccauaccggaagcucaaguucaaccucgauuccgugaacauagacgaccuaucacgggaaguacuugacaaacuugcggacauccuaacccucaacacugaacgcgaggggauagaagacgcaauaaaacgcaaccuacccaaccaauuuacagaggaacagaucagcgaaaucaucaacgugcgaaaaucccaaucaacagccuucaacaaaggguggcacagcuucucagccaaacucaugaacgaauugaucccagaauuauaugccacgagcgacgaacagaugacaauacucacccggcuagaaaaauucaaaguaaagaagaaaucaagcaaaaacauaaaaaccaucgacgaaaaggaaauaacagacgaaaucuacaaucccguagucgccaaguccguccgccaaacgauaaagauaaucaacgcggccguaaagaaauacggggacuucgacaaaauaguaauagaaaugccccgggacaaaaacgcggacgacgaaaagaaguucaucgacaagcgcaacaaggaaaacaagaaagagaaagacgacgcacucaagcgggcugccuaccuguacaacggcacggacaaacuuccggacgagguauuccacgaaaacaaacaacucgaaacaaaaauccgacuaugguaccaacaaggagaaagaugccucuacuccggcaaacccauaccaauccaggaauuaguccacaacuccaacaacuucgaaaucgaccacauacugccacugagcuuaucauucgacgauagccuagccaacaagguccucguguacagcuggaccaaccaggaaaaaggccagaggacaccguaccaaguaauagacucuauggaugcagccuggagcuuccgcgaaaugaaggacuacguccucaaacagaaaggccucggcaagaagaaacgcgacuaucugcuaacgacagagaacaucgacaaaaucgaggugaaaaagaaauucaucgagcgaaaccucguagacacgcgauacgccagucgaguugugcuaaacagucuccagagcgcacuccgagagcuggggaaagacaccaagguuucaguugugcgcggucaguucacgagucaacuccgacgcaaguggaaaaucgauaagucacgcgagacguaccaucaccacgccguagaugcccucaucauagcagccagcucgcaauuaaaacuaugggagaaacaagacaacccuauguucgucgacuacggaaacaaucaggucguggacaaacaaaccggcgaaauacuaagcguaucagaugacgaguacaaagaguuggucuuccagcccccuuaccagggauucguaaacacaauaucgagcaagggcuucgaagacgaaauacucuucagcuaccaaguagacagcaaguacaaucgcaaagugagcgacgcaaccaucuacuccacaagaaaagccaaaaucggcaaagacaagaaagaggagacuuacguccucggcaaaauaaaggacaucuacucacagaacggcuuugacaccuucguaaagaaauacaacaaagacaaaacacaauuccucauguaccaaaaagacccucuaaccugggaaaauguaauagagguaauccuccgagauuacccaacuaccaagaaauccgaagacggcaaaaaugacgucaaaugcaacccguucgaagaauaccgcagagaaaacggacuaaucugcaaauauagcaagaaaggaaaagguaccccgauaaaaagccuaaaguacuacgacaaaaagcucggaaacugcauagacaucacgccacaagaguccaaaaaccgugucguccuccgccaaaucagccccuggcgagcagacauauacuucaaccccgaaaccuuaaaauacgagcucaugggccuaaaguacucagaccucagcuucgagaagggcaccgggaaauaucacaucucucaggaaaaauaugacgccaucaaggagaaagaaggagucgggaaggacuccgaguucaaauucacgcuguacagaaacgaccuaauccucaucaaggacacgcucaacaacugcgaacgcaugcucagauucggcagcaagaacgacacaaguaaacacuaugucgaacucaaaccccucgaaaagggaacuuucgacuccgaagaagagauucuacccguccucggaaaagucgccaagucgggccaauucauaaaagggcucaacaagcccaacaucagcauauauaaaguaagaacagacguccuaggcaacaaauacuucgucaagaaagagggcgacaagccaaaacuagacuucaagaacaacaagaaauga

SEQ ID NO: 6297 - RNA, 3390 nt, Artificial Sequence
  Cas9 variant
augagcaacggcaaaauccucggacuagacaucggagucgcgagcgucggggugggcaucauagacagcaagacaggcaacgucauacacgcaaacuccagguuauuuagcgcagcgaacgccgagaacaacgccgaacgucgcggauuccggggcgccagacgccugacgagacguaaaaagcaucgaguaaaacgagucagagaccucuucgaaaaauacgacauaagcaccgacuuccgcaaccuaaaccucaaccccuacgaacuacgagucaaagggcuaaccgaacaacucacgaaugaagaacucuucgcggcacugcgcaccauagcaaaacgccgagguauaucauaucuggacgacgcggaagacgacucgacaggauccagugacuacgcaaaguccaucgaugaaaaccgcagacuccuaaaaaccaaaacccccgggcaaauacaauuggagaggcuggaaaaauacggccagcuucguggaaacuucaccgucuacgacgagaacggggaagcccaccgccuaauaaacguguucucgaccagcgacuacaaaaacgaagccaggaaaauccucgaaacccaaucaaacuacaauaagcagaucaccgacgaguucaucgaggacuauaucgagauccuaacacaaaagcgcaaguauuaucacgggccaggaaacgaaaaaucucguacggacuacgggcgcuuuagaacggauggaacaacacuugaaaacauauucggaauacucauugguaaaugcagcuucuaccccgaagaguacagggccuccaaagcguccuacacggcccaagaguucaacuuccugaacgaccuaaacaaccugaaaguaccaacggagaccggcaaacuguccacggaacaaaaagaguaucucgucgauuucgcaaagaaaaguaaagcacugggcgcgucuaaacuccucaaagaaaucgccaaaaucgucgacugcaguguugacgacauaaagggguacagagucgacaacaaagacaaaccagaccuacacaccuucgaacccuaccgaaaguuaaaauucaaccuaucuagcaucgacaucgacgaacugagccgagagacacuugacaagcuggccgacauccucacucuaaauacagaacgggagggcauagaagacgcgauaaaaaggaaccugccaucccaauucaccgaagaacagaucuccgaaauaguccagauccgcaagaaccagucgagcgccuucaacaagggcuggcauaguuucagcgccaaacuuaugaacgaacucauaccagagcucuacgucaccagugaagaacaaaugaccauccugacuaggcuggagaaguuuaaaguaaacaaaaaguccagcaagaacaccaagacaauagacgaaaaggagauaaccgacgaaauauacaacccugugguagcaaagagcguccgucaaacaauuaaaauaaucaaugcggccguuaagaaguacggcgacuucgauaagaucguuaucgaaaugccacgagacaaaaacgcggaagacgaaaagaaauucaucgacaagaaacaaaaagagaacaagaaagaaaaagacgacagccuaaaacgagccgccuuccuauacaacgggacagacaacuuaccggacggcgucuuccacggaaacaaagaacucaagacaaaaauacgccucugguaccagcagggugagcgaugccucuacucagguaaauuaaucagcauccaugaucuuguccacaacaguaacaaauuugaaauagaccacauccuaccccugucgcucagcuucgacgacagccuggccaacaaaguacucguauacgcauggaccaaccaagaaaaaggccaaaagacgcccuaccagguaauagacuccauggacacagcuuggucauucagagagaugaaagacuacguccucaaacagaagggacuggggaaaaagaaaugcgaguaccuccuaacaaccgaaaacaucgacaaaaucgaagucaaaaagaaauucauugaacgaaaccucguagacacacgcuacgcuucccgcguaguccugaacucacuccaaacagcauuaaaagagcugggaaaagacaccaaagucagcgucgugagagggcaauucacaucccagcugcgccgcaaauggaacaucgacaaaucgcgcgaaacuuaccaccaccaugccgucgacgcccuaauuaucgcagcaucaagccagcucaaacuguggcagaaacaagagaaccccauguucgaguccuacggcgaaaaccaagucgucaacaaggagaccggcgagauccuaucaauuuccgacgacaaauacaaagagcucguuuuccaaccacccuaccaaggauucguaaacaccaucagcucgaaaggauuugaagacgaaauauuauuuuccuaccagguggacuccaaauuuaacagaaaagucucagacgcgacaauauacagcacccgcaaggccaagcucggcaaggacaagaaagacgagaccuauguccugggcaaaauaaaagacaucuacucccaagauggcuucgacaccuucauaaaaagauacaagaaagacaaaacacaguuucugauguaccagaaagauccccuaacgugggaaaaugucaucgaggucauacugcgggauuaccccagugagaaacucucagaggacggcaagaaaacgguaaaaugcaaccccuucgaagaauaccgccgcgaaaacggcuugaucugcaaauacagcaaaaagggcaacggcacccccauuaaaucacuaaaguacuaugauaaaaagcucggcaacugcaucgacauaacacccgagaaaagcaaaaaccgcguaguccuccgccagaucagcccguggcgagcggacaucuacuuuaaccuggagacucugaaauacgaacucaugggcuugaaguacucagaccuaaguuucgaaaaaggaaccgguaaguaucacauaucacaggaaaaauacgacgccauccgugaaaaagaaggcauagggaaaaagucagaguucaaauucacauuauaccgaaacgaccucaucuuaauaaaggacacacuaaacaacugcgaacggaugcugagguuuggauccaaaaacgacacauccaaacacuacgucgaacuaaaaccgcuagaaaaagggacguucgacuccgaggaagaaauccuaccaguccuggggaaggucgcaaagagcggccaguucaucaaaggccuaaauaagcccaauauauccaucuacaaagucagaacugacguccucggaaacaaguucuucauaaagaaagaaggcgacaaaccaaaacucgacuuuaaaaacaacaacaaauga

SEQ ID NO: 6298 - RNA, 3390 nt, Artificial Sequence
  Cas9 variant
auguccaacggcaagauuuuaggacucgacauuggcguagcgaguguaggggucggcaucaucgacgccaaaacaggaaacguaauccacgcaaacagccgccucuucagcgcggcgaacgccgagaacaacgccgagcgaagaggcuucaggggagcgagacgacucacgagacgcaagaagcaccgcgugaagcgcgugcgagaccuuuucgaaaaauacgauauaucuaccgacuuccgaaaccucaaccucaauccauacgagcuccgcguaaaaggccucacagagcaacuaaccaaugaggaacuauuugcagcccucaggacaauagcgaaacgacgagggauauccuaucucgacgacgccgaagacgacagcaccggaagcuccgacuacgcgaaguccauugaugaaaaccgccgacuccuaaagacaaagacaccgggucaaauccagcucgagagacucgagaaauauggucaacuacgcggaaacuuuaccgucuaugacgagaauggcgaggcacaccgauuaauaaacguauucucgaccuccgacuacaaaaacgaagcgcggaaaauccuagaaacacaauccaacuacaacaaacaaaucacagacgaguucauagaagacuacaucgaaauccugacccaaaaacgaaaauacuaucacggccccggaaacgaaaaaucccguacugacuacggacgguucaggaccgacggcaccacccucgaaaacaucuucggcauacucaucggcaaaugcagcuucuaccccgaggaauaucgcgcuucgaaagccagcuacaccgcccaagaguucaacuuccuaaacgaccucaacaaccugaaagugccaaccgaaacgggcaaacucagcaccgaacagaaagaauaccuggucgacuucgccaaaaagucuaaagcgcugggcgccuccaagcuacucaaagaaaucgcgaaaauagucgacugcuccguggacgacaucaaggguuaccgcguagacaacaaggauaagcccgaucuccacaccuucgagccauaccggaaacuuaaauucaaccugucaagcaucgacauagacgaacugucacgagagacccucgauaaacucgccgacauacucacgcuaaacacggaacgcgaagguaucgaagacaccauuaaacgaaaccucccgucccaauucacagaggaacaaauaagugaaauuguacagauacggaaaaaccagucaucggcauucaacaaaggguggcacagcuucagcgcaaaacuaaugaacgaguugaucccggaacucuacgucacaucagaagaacagaugaccauccugacaagacuggagaaauucaaaguuaacaagaaaucaagcaaaaacacaaaaacgaucgacgaaaaggaaaucacugacgaaauauacaaccccguggucgccaaauccguccgacaaaccauaaaaauuauaaacgccgcagugaaaaaguauggcgacuucgacaaaauuguuaucgaaaugccaagagacaagaacgccgaggacgaaaagaaauucaucgacaaaaaggagaaggaaaacaagaaagaaaaagacgacucccuaaaacgugcugcauuccucuacaauggcacugacaaccuaccagacggagucuuccacggcaacaaagaacucaagacgaagauacgacuuugguaccagcagggcgaacgaugucucuacagcggcaaacuaaucucgauccacgaucucguccacaacagcaacaaauucgaaaucgaccacauccucccccuaucgcucagcuuugacgacagccuagccaacaaaguacuggucuacgccuggacaaaccaagaaaaaggccagaaaacaccauaccaagucaucgacuccauggacgccgccugguccuuccgcgaaaugaaagacuacguacuaaagcaaaaagggaucgggaaaaagaaacgcgaauaccuccucaccacggaaaacaucgacaaaaucgaagugaaaaagaaauucaucgaaaggaaccuaguagacacacgguacgccucacgggugguccucaacucacugcagaccgcccuuaaagagcucggcaaagacacgaaaguaagcguuguccgcggccaauuuacaagccaacugcggcgcaaauggaaaauagacaaaagccgcgagacauaucaccaccacgcaguagacgcacuaauaauagcggcaagcggacaacuaaaacuuuggcagaaacacgaaaacuugauguucgagaauuacggggaaaaccaagucgucaacaaggagaccggagaaauacucuccaucagcgacgacgaauacaaggaguuaguauuccaaccgcccuaccaaggcuucgucaacacaaucuccucuaaaaccuucgaagacgagauccuguucuccuaucaaguggacagcaaauucaauaggaaggucucagacgcaaccaucuacucgacacgcaaagccaaacugggcaaggacaaaaaggaagaaaccuacguccugggcaaaaucaaagacauauacacacaggauggcuuugacacauucauaaaacgauacaagaaagacaaaacccaauuccuuauguaccaaaaagaccccuuaacaugggaaaaugugauagaggucauccuacgagacuaccccagcgaaaaacugagcgaggacgggaagaaaacuguaaaaugcaacccuuuugaggaauaccgaagggagaacggccucaucugcaaauacucgaagaaagggaacgggaccccuauuaaaagucuaaaauacuacgauaagaaacuggggaacugcaucgacauaacccccgaaaaauccaaaaaccgggucguacuucgccaaaucucacccuggcgggcagacaucuacuucaaccuagaaacccugaaauaugaacucauggggcugaaauacagcgaucucaguuuugaaaagggaacaggaaaauaccacaucucccaagaaaaguacgacgccauacgugaaaaagaaggaauaggaaagaaaagugaguucaaauucacgcucuacaggaacgaccuaauucuaaucaaggacacacucaacaacugcgaacguaugcugcgguucggauccaaaaacgacacaucaaaacacuacgucgagcucaaaccccuagaaaaaggcaccuuugacuccgaagaagagauucuuccaguccucggcaaaguggcaaaaagcgggcaauucaucaagggacuuaacaaaccuaacauaagcauauauaaaguacgcaccgacguccugggcaauaaauucuucauaaagaaagaaggcgauaaacccaaacucgacuuuaaaaacaacaacaaauga

SEQ ID NO: 6299 - RNA, 3393 nt, Artificial Sequence
  Cas9 variant
augaauaaaauacucggccuugaccucggcaccaacucgauuggcugggcccuaauagaaaauaacaucauccucgggauggguucaagaguauucccagaaggcgucgucaaccugggagagggcgaaggccgagaaaccuccaaaaacgcgucgcgcaccgaagcccgcggaguccgacgacaaauauuccgccgucgacuacgaaagcgcuaccuccucaaggaacucgccaaacacaaucugugccccaucagcccaacguuaauaaaagacuggaaugggacagacaucuucaagaacgagcucauaauccagugguuccagcuuaacccauacgaacuacgugcgaaagccauacaggaggaaaucacacugaucgagcugggacgcauauucuaccacaugauacaacgccgcggauuccuauccaacucccgcucagcuggggccgacgucaaagaaacuucaaccaucuucaagggcgacgccaaaaucggaaaaaucggaaucuccgacacacuaaaaucuaucgagcaaaacaagacccuuggcagcuuccuacacuccauccagccuaaagaaaacgaacccuucucaggagagcuagaacgaauaagaaaccgauauaccacacgccaaauguacaucgacgaguucgagaccaucugggaguuccaaaaacaauaccacuccgaacucaacucgaaccucaagacaauucugggaggacggaaaaaggauaacuacaaggaagacggcgugcuauuccaucaacgcccucugcgaagccagaaacaccuaguuggcuucugcuccuucgagccaaagaaaacaaaaugcaaacuaagugcuauaccauucgaacucuucagaaucuaucaaugggucaacacccuaagcuacgacguaaacgguguacgacaaaagaucacccaggaggaacgaaagaaaauaauagaccuucuccuaagcaaagaaaaacccuccuucaaagagauccgcaaagcgaucgggaaacucgacgguucauaccaauucaacuacaaggacgacgacaaaaucguaggaucacacacgauauccaaccuguccaacaagaaauucuucggaaacaaaugguucgacuucuccgagaaagagcaggaaaacaucuggcacauccucuccuucuucgacgaccgcgaaaaauuaaaagaauaugcuaucaaaaacugguccuucgacgaggaaagagcagucaagaucucuaaauucaaucucaaagacggcuacagcaaccuaucgcgcaaagcaauacugaacauacugccauuccuucaaaaaggcuucauguacgacgucgcuguaggcuuagcaggagugaaaaauacccuaaguguaaacugggaggaacacgaacaauuuguccuggacaacguccccgagauugucagauccaaccucaaaggcgguuauaucgagccccucaagaacaugcuuaaaaacgaguucaacugcaaugacaaacagcuugaaaaacuauaccaccacucgagugcaauagaaacggagaacauccuugaccgucugccagugaaucuccacgccgaccgcgaaauccagaaaaucaaaaaucccguaguaauaaccgccuuauucgaaaucagaaaacucgucaacgaaguaaucgacaccuauggaaaacccaacgaaaucaaagucgagcuugcaagggaccucaaagccucaaagucaaaccgccucgaggcacgcaaacgacaaaaagaccuagaaaaacaaaacgacagaguaaaacuggaacucgaaaaccugaaccaacgcucaaaccacauaaacaucuuaaaauacaagcucugggaagaaugcaaccacacaugcccauucacaggccagaucaucacgauuucccaacuguuuacaggcgaggugcaaaucgaacacaucuuccccuggucacgcucacuaaacgacagcuucaacaacaagacccucugcuucgcagacgagaaucgcgccaaaggaaacaaaacccccuacgagcuguacucugagcagggagaccaaaaaugggaagccauaaaacuccaagcacuaucaugcuuuaaaaccaaagccaacuaucccaacugcuauaacaaauucaaacacuucguaaagaagaaacacgacgaagauuuuaucucccggcaacucaacgauacacgcuauauaucaaaagaagccaaaaacuaccuaucuaaaauaugcucaaacgucuuggucgcucccggccagaugaccgccacacuacgacaccacuggggacucaacuccauccuaaaccucgaagacgacacaaaaacgcgagacgaccaccgccaccacgccaucgaugcucucguaauggccugcagcaccagaucccaucuacaggagcucagcaagcgcaacagguacaacaaaaacuacgaccucaaggacuucccugacccguggcaaaacuuccgccaagacgcagaaaacgccguagcucaaauccuugucucacacaagaaaucuaaaucgcugcugacagugcgaacacacaaaacgaucaagaagggcguagagcacaagaacauuggcguggcggcccggggacaacuccauaaggaaagcgucuacgggcuacgcaaagcccccaacucgaauaaagcauuccacauacgcaaaccacucgaaagccuuaccaccgaaaaacagcuugagaaaaucguagaugacuccauacggcuccuaauccuaaagcgaaucaacaucaucggcggguucaucaaaggcaaaaucccgaaagaaaccuucuucgucguagacgagaacggaaucaagcaaccccagauauuccuccccaaccguaacgguaauccaguacccaucaagaagguccgcauccgggaaaacauuggaggcgcugaaaagcucaaggagaacacaaaccaauacguaaacccacgaaguaaccaccacguaaucguguacgaggacagcaacggagggcucaaagaugaugucgucaccuuuuggaccgccgucgagagaaaacgacaaggccaggacguguucaaacucccuaacgacggcgagaaaauaguuuccacacuacaaaucaacgauauguuccuacucggccucaacgacgacgacauaauaacacugacgucaaaggaacucaagaaacaccucuucaaaguccaaacacucuccagcagcuucuacgaguuccgacuauccaccgacaguacacaaaacaaaaauacgaacagcacaguauuucguaggauucaauccuucgguaugggaaaaacaggauggaaagccuucaaccccaucaaaguaaaacuaaacagcaucggcgaagugaaaaucaucuga

SEQ ID NO: 6300 - RNA, 3393 nt, Artificial Sequence
  Cas9 variant
augaccaacgggaaaauccuaggcuuggacaucggcaucgccuccguuggcgucggaaucauagaagcaaaaacaggaaaggucguacacgcaaacucacgccuguucucggccgcgaacgcagaaaacaacgcagaaagacggggcuuccgcggaucccggaggcuaaaccgcagaaagaaacacagggugaaacgcguccgcgacuuauucgagaaauacggaauagugacagacuuucgcaaccugaaccucaaccccuacgaauuaagggucaaaggccuaacagaacagcucaccaacgaagaguuauuugccgcgcuacgcacgauaagcaaacgccgcggcaucagcuaccuagacgacgcugaagacgacagcacagggagcaccgacuaugccaagagcaucgacgaaaaccggcgacuccuaaagacaaaaacaccggggcaaauccagcuagaacgcuuagagaaauauggccaacugagagggaacuucaccguauacgaugagaacggagaggcccaccgacuaauuaacgucuucaguaccagcgacuacgaaaaagaagcuagaaaaauacuggagacacaagcggauuacaauaagaaaaucaccgcugaguucauagaugacuaugucgaaauacucacccagaaaagaaaauacuaccacggacccggcaacgaaaaaucacgcaccgacuacggacgcuuuagaaccgaugggacaacacuugaaaauauauucggcauacucauaggaaagugcagcuucuaccccgacgaauaccgcgccagcaaagcaagcuacacagcucaagaauacaacuucuuaaacgaccugaacaaucucaagguaccgacagaaaccggcaagcucucaacggaacaaaaggaggcacucgucgaguucgcaaaguccaccgcaacucuagggcccgccaaacuccucaaggaaaucgccaaaauacuagacugcaaggucgacgaaauaaagggcuauagggaagacgacaaaggaaagcccgaccuacauaccuucgaaccguaccgcaaacugaaauuuaaccuggacuccguaaacaucgacgaccuaagccgggaaguccucgacaaacucgcagacauacucacgcuaaacaccgaacgugaagggauagaagacgcaaucaaacgaaaccuccccaaccaauucaccgaggagcaaauaucugagauaauaaauguacgaaagagccaaagcacagccuucaacaagggauggcacucuuuuagcgccaaguuaaugaacgaacucauucccgagcuguaugccacaagcgacgaacagaugaccauacucacacgccucgaaaaauucaaaguuaagaagaaaagcuccaaaaacaucaaaaccaucgacgagaaagagaucaccgacgaaauauacaacccggucgucgcgaaaagcguccgccaaaccauaaagaucauaaacgccgccgucaagaaauacggcgacuucgacaaaaucguuaucgaaaugccacgagacaagaacgccgacgaugagaagaaauuuauagacaaacgcaacaaagaaaacaagaaagagaaagacgacgcccuaaagagagccgccuaccuauacaacggcacggacaaacuacccgacgaagucuuccacggcaacaagcagcucgaaaccaaaauccggcuuugguaccaacaaggcgaaaggugccucuacuccggaaagcccauccccauccaagaacucguccacaacuccaauaacuucgaaaucgaccacauacugccccucagccucagcuucgacgacucccuagccaauaaaguuuuagucuacucauggacaaaucaagaaaagggacagcggacccccuaccaaguaaucgacuccauggacgcggccuggucauucagagagaugaaagacuacguacucaaacagaaaggccuagguaagaagaaacgagacuaccuccuaacuacagagaacaucgacaaaauagaagucaagaagaaauucaucgaacgcaaccucguggacacgcgcuacgcgucccgcguaguacucaacagccuacaaucagcacucagagaacuggguaaagacacaaaagucagcgucguccgcggccaguucacaucccagcugcggcggaaauggaaaaucgacaaaucccgcgaaacauaucaucaccaugcggucgacgcccuuauaaucgcagcuagcucgcagcucaagcugugggaaaagcaagacaacccaauguucgucgacuauggcaacaaccaggucguugacaaacaaaccggugaaauacugagugugucagauaacgaauauaaagaacucguuuuccaaccgccauaccaaggguucgucaauacuauaagcucaaaaggauucgaggacgagauacucuucaguuaccagguggacucaaaguacaaccggaaaguguccgaugccacgaucuacagcacgcgcaaagcgaaaaucggaaaagauaagaaggaggaaaccuacguucucgggaaaaucaaggacauauacucccaaaacggcuucgacacuuucguuaagaaauacaacaaagacaaaacgcaauuucucauguaucaaaaagacccccugaccugggaaaacgugauugaagucauucuaggcgauuacccaaccacaaagaaaucagaagacggcaaaaacgaugucaaaugcaacccguucgaggaauaccgucgugagaacggacugauuuguaaauacucaaagaaaggcaaaggcacgcccauaaaaucacugaaauacuacgacaagaaacucggaaauugcaucgauaucacccccgaagaaagucgcaacaaagucauacuacagaguaucaacccguggcgggccgacguauauuucaacccagaaacccugaaauacgagcucaugggccucaaauacagcgaccuuagcuucgaaaaaggcaccgggaacuaccacauaucucaggaaaaauacgacgccaucaaagaaaaagaagggaucggcaagaaaucggaguucaaauuuacgcuauaccgcaacgaccuaauccuaauaaaagacaucgcgagcggcgaacaggaaaucuaccgcuuccucucccgcaccaugccaaaugucaaccacuauguagaacucaaacccuaugauaaggaaaaauuugacaacguacaagagcuagucgaagcccuaggagaagccgacaagguaggccggugcaucaagggccucaauaagccgaacaucucaaucuacaaaguacggacggacgugcuaggaaauaaauacuucgucaagaaagaaggcgacaaaccuaaacucgacuucaaaaacaacaagaaauga

SEQ ID NO: 6301 - RNA, 3393 nt, Artificial Sequence
  Cas9 variant
augaccaacggaaaaauacugggcuuagacauaggcaucgcauccgucggcgucggcauaaucgaagcgaagaccggaaaggucguccacgcaaacagccgccuguucuccgcggccaacgcagaaaacaacgcagaaaggcgaggguucaggggaagcaggcgccucaaccgccguaagaaacauagggucaaacgaguacgggaccuguucgagaaauacgaaaucgucaccgauuuccggaaucucaaccugaauccguacgagcuccgugugaaaggacugacagaacaauugaccaacgaagaacucuucgcggcacuacggaccauaucaaagcgcagaggcaucucuuaccuggacgacgccgaagacgacuccacaggcucaaccgacuacgcaaaaagcaucgacgaaaaccgaagacuacucaaaaccaaaacgccgggacaaauccagcuugaacggcuagaaaaauacggccaacuccgagggaacuucacaguauacgaugaaaacggcgaagcucaccggcucauaaacguauucuccacauccgacuacgaaaaggaagcgcgaaaaauccuagagacccaagcagacuacaacaaaaagaucacggccgaguucaucgaugacuacguagaaauacugacccaaaagagaaaauacuaccauggccccggcaacgaaaaaucccgaaccgacuacggccgcuuccgaaccgacggaacaacccuagagaacauuuucggcauccuaaucggcaagugcucuuucuacccagacgaauaucgcgccagcaaggcauccuauaccgcacaagaauacaauuuccugaacgaccuaaacaaccucaaagucccgaccgagacgggcaaacucuccacagagcaaaaggaggcacucguagaguucgccaaguccacggcgacccuggggcccgcuaaacugcuaaaagaaaucgccaaaauccucgacugcaagguagacgaaaucaagggcuaccgcgaggacgacaagggaaaaccggaccugcacacauucgaaccauaccggaagcugaaguucaaccuagacagcguaaacaucgacgaccuuagccgagaaguccucgacaagcuagcagacauccugacccucaacaccgaacgcgaaggaaucgaagacgccauaagacauaaccucccaaaucaguucaccgaaggacaaaucagcgaaauaauaaaagugcgaaaaucccaaucaacagcauucaacaaaggauggcacuccuucagcgccaaauuaaugaacgaacucauaccggagcucuacgcaaccagcgacgaacaaaugacgauccugaccagacuagaaaaauuuaaagucaacaaaaagucaagcaagaacacaaaaaccauagacgaaaaggaaguaaccgacgaaaucuacaaccccgucguagccaaaucgguacgacaaacaaucaaaaucauuaacgcagcggugaaaaaguacggagacuuugacaaaauaguaauagaaaugccacgagacaagaacgcagacgacgagaagaaauucauagacaaaagaaacaaagaaaacaagaaagaaaaagaugacgcacuuaaacgagcagcuuaccuauacaacgggaccgacaaacuaccugacgaagucuuccacggcaacaagcaacuggaaacaaagauacgccucugguaccaacaaggcgaacgaugccuguauagcggcaagcccaucccaauacaagagcugguccacaauagcaacaacuucgaaaucgaccacauccucccacucagccuauccuucgaugacagccucgcgaacaaaguucucguguacgcauggaccaaccaagagaaaggacaaaagacuccauaucaagucaucgacagcauggacgcagccuggagcuuccgagagaugaaggauuacguacuaaaacaaaaaggcuuaggcaagaaaaagcgagacuaccugcucacaacugagaacaucgauaagauagaaguuaaaaagaaauucauugaaagaaauuuaguagacacacgguacgcaucacggguaguacugaacucacugcaaagcgcccugagggagcuggggaaagacaccaaaauaagugugauacggggacaguucacaucccagcucaggaggaaguggaaaauagacaaaucaagggaaaccuaccaccaccacgcggucgaugcgcucaucauagccgcguccucucagcugaaacugugggaaaaacaagacaacccaauguucguagacuacggaaacaaccaaguugucgacaagcaaaccggagaaauccucagcgucagcgacgacgaguacaaagagcuaguauuccaaccgccuuaccaaggauucguaaauaugaucagcuccaaaggauucgaagacgaaauccuguucuccuaccaagucgacagcaaauauaacagaaaggucuccgacgcgacaauuuacucgacacggaaagccaagaucggaaaagacaagaaagaagaaaccuaugugcuggggaaaauaaaagacaucuacucacagaacggauucgacaccuucaucaagaaauauaauaaggacaagacccaauuccugauguaccagaaagacccacuaacgugggaaaacgucauagaagucauccugcgagacuaccccaccacaaagaaaagcgaggacggcaaaaacgacgugaaaugcaauccguucgaagaauaccgacgcgagaauggacucguaugcaaguacaguaagaagggaaaaggaacaccgaucaagagccucaaauacuacgacaagaaacugggcaacuguauugacaucacucccgaaggcagcaaaaacgaaguaguccugcaaucacucaaucccuggagagccgacguauacuucaacccggaaacccucaaauaugaacuccucggccucaaauauucugaccucuccuucgaaaagggcacaggcaaguaccacaucagccaagagaaauaugacguuaucaaagaaaaggaaggaauaggcaagaaaagcgaguucaaauucacacucuaccggaaugaccugauacuaaucaaagacacggcgagcggcgagcaggaaaucuaccgauuccucucccgaaccaugcccaacgucaaacacuaugcagagcuaaaacccuacgacaaagagaaauucgacaacguacaggaacugguagaagcacugggagaggcagacaaggucggccgguguaucaaagguuugaacaaaagcaaccucagcauauacaagguacggaccgacguucucggcaacaaauacuucgucaagaaggagggcgacaagcccaaacuagacuucaaaaacaacaagaaguga

SEQ ID NO: 6302 - RNA, 3393 nt, Artificial Sequence
  Cas9 variant
augacaaauggaaagauccuagggcuagacauaggaaucgcaucgguaggaguugggauaaucgaagcaaaaacgggcaaagucguacacgcaaacagccgccuauucucggccgcaaacgcggaaaacaacgcagaaagaagaggauuccgcggcucgagacgacucaaccgaagaaagaagcacagaguaaaaaggguccgagacuuauucgaaaaauacggaauagugacagacuucagaaaucucaaccugaaccccuacgaacuccgaguaaagggccuuaccgaacaacucaccaacgaagaacuguuugccgcccuucguacaauuagcaaacggcgcggaauaucauaucucgacgacgccgaggacgauucgacagguagcacggacuacgcgaaguccaucgacgaaaaccgccgccuucuaaagaccaaaaccccagggcaaauccaacuggaacgacucgagaaauacgggcaacuccgaggaaacuucacggucuacgacgagaauggcgaagcucaucgucugaucaacgucuuuagcaccuccgacuacgaaaaagaagcuagaaagauccucgaaacacaagcagacuacaacaaaaagaucacggcugaguucaucgaugacuauguggaaauccuaacacagaaaagaaaauacuaccacggcccgggaaacgaaaagucgcgaacagacuacggacgauucaggacagacggcacaacccucgaaaacauauucggaauacuuauagggaagugcaacuucuaccccgacgaauaucgagcauccaaagccucauauacagcucaagaauacaacuuccucaacgaccucaauaaccucaaaguccccacagaaaccggaaaacucucaaccgagcaaaaagaaucgcucgucgaguucgcuaaaaacaccgccauccugggacccgccaaacuccucaaagaaaucgcaaaaauccucgacugcaaagucgacgaaauaaaaggauaucgggaagacgacaaaggcaagccggaucuccauaccuucgaacccuaccgaaaacugaaauucaaccucgacucgguaaacaucgacuaccuaucccgcgaaguacucgacaaacuggcggacauccucacccucaacacagaacgcgaaggcaucgaagacgcgaucaagcgcaaccuccccaaccaauucaccgaagaacaaaucagcgagaucauuaauguccgcaaaucucaaagcacagccuuuaauaaaggguggcauucauucucugcaaaacucaugaacgaguugaucccagaacucuacgccaccuccgacgaacaaaugacaauacuaacccgucucgagaaauucaaagucaagaagaaaucaagcaaaaacaucaaaacaaucgacgaaaaagaaauaacagacgaaaucuacaaccccgucgucgccaaaagcgugcgacaaacgaucaaaauaauaaacgccgcggucaaaaaguacggagacuucgacaagaucguaaucgagaugccccgagauaaaaacgcagaugacgaaaagaaauucaucaauaaacgcaacaaggaaaacaagaaagaaaaagacgacgcccuaaagcgugcggccuaccuguauaacgggacagacaaacucccggacgaaguauuccacggcaacaaacaacuggaaaccaaaauccgacuuugguaccaacaaggagaaaggugccuauacucgggaaagccaauaccgauacaagaauugguucacaacagcaacaacuucgagauagaccacauccugccccucagucucagcuucgacgacagccuagcaaacaaaguccuaguguacucauggaccaaccaagaaaagggacagaaaacaccauaccaagucauagacaguauggacgcagcguggucguuucgggaaaugaaagaauacgucuuaaagcagaaaggcuuaggaaagaagaaacgugacuaccugcuuaccaccgagaacaucgacaaaaucgaggugaaaaagaaauucauagaacgcaaccuuguagauacccgauacgccucgcggguaguacugaacagccuccaauccgcacuacgcgaacucggcaaagacacgaaaguaucagugguucgaggacaauucacaagccaacucaggcgaaaauggaagaucgacaagagccgcgaaaccuaccaccaccacgccguagacgcccuaaucaucgccgcaucgagccaguuaaagcucugggaaaaacaagacaaccccauguucgucgauuacggcaauaaccaagucguugacaagcagaccggcgaaauccuauccguaucugacaacgaguacaaggagcucguauuccaaccacccuaccagggcuucguaaacacaaucaguucaaagggcuucgaggacgaaauacucuucagcuaccaggucgacuccaaauacaaccggaaggucagcgacgcuacuaucuacucgacacgaaaggcaaagauagggaaggauaagaaagaagaaacauauguccuaggaaaaauuaaagacauauacagccaaaacggauucgacacauucgucaagaaauauaacaaggacaagacccaguucuugauguaccaaaaagacccccuaaccugggagaacgucaucgaggugauccugggagacuaccccaccaccaaaaagagcgaggacggcaaaaacgacguaaaauguaaccccuucgaggaauaccgaagagagaacggccucaucugcaaauacagcaagaaaggcaaaggcacacccauaaaaagccucaaauacuaugacaagaaacucgguaauugcauagacaucacacccgaagaaucacguaacaagguaauccuccagagcauaaaccccuggagagcagacguauacuucaaccccgaaacccucaaauacgagcuaaugggccucaaauacagcgaccucagcuucgaaaaaggaacggguaacuaccacauaucccaagagaaguacgaugcaaucaaagagaaggagggcauaggcaagaaaucagaguucaaauucacccuauacagaaacgauuugauacucauaaaagacaucgcguccggcgaacaggaaauauauagauuucuaagccgcacgaugcccaacguuaaccacuacgucgaacuaaaacccuacgacaaagagaaauucgacaauguucaggagcuaguggaagccuuaggggaggcagacaagguaggccgcugcaucaaaagccuuaacaaaccaaacaucuccauuuacaaaguccggaccgacguacuaggaaacaaguacuucgucaaaaaggaaggcgacaaacccaaacucgacuucaagaauaacaagaaauga

SEQ ID NO: 6303 - RNA, 3393 nt, Artificial Sequence
  Cas9 variant
augagcaacgggaaaaucuugggccuagacaucgguguggcuucaguaggaguagggauaauagacgcaaagacgggcaaagugauacacgccaguucaagacucuuuuccgccgccaacgcggagaacaaugcggaaagacgcggguuccgaggcgcccgacgccuaacacgacgaaagaagcacagaaucaaacggguacgagaccuauucgaaaaguacgaaaucgucaccgacuucucgaaccucaaucucaacccguacgagcuucgaguaaaaggccuaacugaacagcugacaaaugaggaacucuuugcggcccuacgcacaauagcaaagcgccgcgggaucagcuaucucgaugacgccgaggacgauagcaccggcagcuccgauuacgcaaagagcauagaagaaaaccggcgacuccucaaaaacaugacacccggccaaauacaacuagagcgccucgaaaaauacggacagcuccgcggcaauuucacaguguacgacgaaaacggcgaggcgcaccgccucaucaacguauucagcaccuccgacuacaagaacgaggccagaaaaauccuggaaacccaaagcaacuacaacaaacaaaucacugacgaguucauagaagacuacaucgaaauacuaacgcaaaaacgcaaauacuaucacgguccugguaacgaaaaaucacgcacagacuacggccgcuaccguacagacggcacaacgcuugaaaacaucuucggaaucuuaaucggcaaaugcacauucuacccugacgaauaccgcacaagcaaggcgagcuacacagcacaagaguacaacuuccugaacgaucucaacaaccuaaaagugccaaccgaaaccggcaaauugagcacagaacagaaacacuaucucguggacuucgccaagagcagcaaggcgcugggcguggcgaaacuccugaaagaaaucgcgaaaauagucgaaugcuccguagacgacauuaaggguuaccgcgaagacaacaagggcaaaccagaccuacauaccuucgaacccuaccguaaacuuaaauucaaucugagccuaauagacauagacgaacuguccagggaaacucuagacaaacuugccgacauacuuacccuuaacaccgagcgggaaggaauagaagacgcgaucaaacgcaaccucccaaaccaguuuacagaagaacagauuguagagcucguaaacguccgcaaaaaccagucaucagcguuuaacaagggcuggcacagcuuuuccguaaaacugaugaacgaacucauacccgaacuauaugccucaucagaggaacaaaugacaauccugacgaggcucgaaaaguucaaagucaauaagaaaagcagugagaacacgaagaccauuaacgaaaaagaaauaaccgacgagaucuacaaccccgugguagccaaaucagugucacaaaccguaaaaauaauaaaugcagcagucaagaaauauggagacuucgauaaaaucgugauagagaugccaagagacaagaacgccgacgaugaaaagaaauucauagacaagaagcagaaggagaacgcgaaagaggucgaagacgcccuaaaacgugcagccuaccucuacaacggcaccgacaaacuaccagacggcgucuuccacggcaauaagcaacucaaaaccaagauaagacucugguaccaacaaggagaacgaugccuauauuccgggaagcccaucuccauacaggaccucguccauaauagcaacaacuucgaaaucgaccacauccucccccugucacucucguucgacgacagccuggcaaacaagguccucguguaugccuggaccaaccaggagaaaggccagaagacaccuuaccaaguaaucgacagcauggacgcagcuuggagcuuccgggagaugaaggacuacgucuugaaccaaaaagggaucggcaaaaagaaacgcgaguaccuccucaccacggaaaacaucgacaaaauagaagucaagaagaaauucaucgagaggaaccuaguagacacacgguacgcaucacgagucguauugaacuccauccaggcagcgcucaaagaacuggacaaagacacaaaagugagcguaauccgcggccaauucacgucacaacucaggcggaaauggaaaaucgacaaaucacgcgagacguaccaccaucaugcugucgacgcccuaauuaucgccgccagcucccaacuaaaauuguggcagaaacaagaaaacccgauguucguagacuacggagaaaaccaagucgugaacaaagaaaccggcgagauccucuccgucuccgacgacgacuacaaagaacucguauuccaaccacccuaccaaggcuucgugaacaccaucuccagcaaagccuucgaagaugagauucuauucagcuaccaagucgacuccaaguacaaccgcaaagucagcgacgccaccaucuacucaacccgaaaagcaaaacucggcaaagacaagaaagaggagacguauguccugggaaaaaucaaagacauauacagccaagacggauucgacgccuucaucaaacgguacaagaaagacaaaacccaauuccucauguaccaaaaagaccccguuacaugggagaacgucaucgaagucauacucagagacuacccaucagaaaaacuuagugaggacggaaagaaaaacgugaaaugcaacccuuucgaagaauaccgccgcgagaacggccuuaucugcaaauauuccaagaaaggcaaaggcacacccaucaaauccuuaaaauacuacgacaagaaacucgggaauugcauagauaucacgccgaaagggagcaaaaacgaaguagugcuccaaucacugaaccccuggcgagccgaccuuuacuucaacccggacacccugaaauacgaacucaugggacuaaaauacucagaccucuccuucgaaaaaggaaccggaaaauaccacauuucgcaagagagauacgacgaaauaaaaguaaaagagggcaucgguaaaaacagcgaguucaaauucacacuguaccggaacgaccugauccucaucaaagacacggaaucgggcgaggaggaacucuaccgguuucuuucaagaacaaugccuaacgucaaacacuacguagagcucaaaccauacgacaaagaacgguacgauggaggccaagaacucaugaaaguuuucgggaacgucgccaacggcggacagugccucaaaucgcucaacaaaagcaaccucucuauauauaaaguacgcaccgauguccucgguaacaaguucuucauaaagaaagagggcgacaaaccaaaacucgauuucaaaaacaacaagaaauga

SEQ ID NO: 6304 - RNA, 3393 nt, Artificial Sequence
  Cas9 variant
augacgaacggcaaaauccucggccucgacauagguaucgcgucagugggcgugggcauaaucgaagcgaaaaccggcaaaguaguccaugccaacucacgguuauucagcgcagccaacgccgaaaacaacgcagaacgccgcggguuccgagggucacggagacuaaacagacgcaagaaacaccgcguaaaacgcgucagagaccucuucgagaaauacggcauagugaccgauuucaggaaccugaaccugaacccguacgagcugcgagucaaagggcucacagaacaacugaaaaacgaagaacucuucgccgcacuccgcacaaucagcaagcgaagaggaauaucguaccucgacgaugcagaagacgacagcaccgguuccacggacuacgcgaaaucaaucgacgaaaaccggcgacuacucaagaacaaaacgccaggacaaauacaacuggaaagacucgaaaaguacggacaacugcggggcaacuucaccgucuacgaugaaaacggcgaagcacauaggcuuaucaacgucuucucgacauccgacuacgaaaaagaggcccggaaaauccuggagacacaagccgacuauaacaagaaaaucaccgcagaguucaucgacgacuacgucgaaauacucacccaaaaacgcaaauauuaccauggaccugggaacgaaaaaucccgcacagacuacggacgguuccgaacagacggcaccacacuggaaaacaucuucggcauccucaucggaaaaugcaacuucuacccagacgaauaccgcgccagcaaagcgucauacacagcccaagaguacaacuuccuuaacgaccuaaacaaccucaaagucucgaccgaaacagggaagcucagcacugaacagaaggagucacucgucgaguucgccaaaaacacagcaacccugggcccagccaaauuacuaaaagaaaucgccaagauccucgauugcaaagucgacgaaaucaagggcuaccgugaagacgauaagggcaagcccgaccuccacacguucgagccauaccgaaaacugaaauucaaccuagaaagcaucaacauugacgaccugagccgggaagugaucgacaagcuagccgauauccucacccugaacacagaacgagaagguauagaagaugccaucaaaaggaaccuuccaaaccaguucaccgaagaacaaaucuccgagauaauaaaaguccggaaaagccaaagcacagcauucaacaaaggcuggcacagcuucuccgcuaaacucaugaacgagcucauaccagaacucuacgccacguccgacgaacagaugaccauucugacccgccuagagaaauucaaagucaauaagaaauccagcaaaaacaccaaaacgaucgacgagaaggaagucacagacgaaauauacaauccgguaguagccaaaucgguccgccaaacgauuaaaauaaucaacgccgcagucaaaaaguacggcgacuucgacaaaauuguaaucgagaugccccgagacaaaaacgcagacgacgagaagaaauucaucgacaagagaaauaaagaaaacaagaaagagaaagacgacgcccugaaacgagcggcauaccucuacaacucuagcgacaagcuaccggacgaaguauuccacgggaauaaacagcuggaaacaaaaauacgccuaugguaccagcaaggugaacgcugcuuguacuccggcaaaccuauaagcauacaggaacucguccauaacucaaacaauuucgaaaucgaccacauccugcccuuaagccuaaguuucgacgacagccucgcaaauaaaguccuaguauacgcauggaccaaccaagaaaagggccagaaaaccccguaccaagucauagacucgauggacgcagcauggucguuccgagagaugaaagacuacguguugaaacaaaagggccucggaaagaagaaacgagacuaccuccucacuacagaaaauaucgacaaaauagaagucaagaagaaauuuauagagcgcaacuuaguagacacaagauacgcaagucgggucguacugaacagucuacaauccgcacugcgcgaacuaggcaaagacacaaaaguguccguggucagaggacaauucaccucacaacuccggaggaaauggaaaaucgacaaaucccgagaaaccuaccaccaucacgccgucgaugcccuuauaaucgcagccuccucacaacucaagcuaugggagaagcaggacaauccaauguucgucgacuacgguaaaaaccaagucgucgauaaacaaaccggagagauccucagcguguccgacgaugaguacaaggagcuagucuuccaaccacccuaccagggcuucgucaauacuaucagcuccaaaggguucgaagacgaaauccuguuuagcuaucaggucgacuccaaauacaaccggaaaguaucagacgcgacaaucuacagcacccgaaaagccaagaucggcaaagacaaaaaggaggaaacauacguacuagggaaaauaaaagacaucuauucgcaaaacgguuucgacaccuucaucaagaaguacaacaaagacaaaacacaauuccucauguaccaaaaagauucccuaacaugggagaacguuaucgaaguaauccugagggacuacccaacgaccaaaaaguccgaagacgggaaaaacgacguaaaaugcaaccccuucgaggaauacagaagggagaacggccugaucugcaaguacucaaagaagggcaaaggcacaccaauaaaaagccuaaaguacuacgacaaaaagcuagggaacugcauagauauaacccccgaagagucacgaaacaaagucauccugcaguccaucaaucccuggcgagcggaugucuacuucaaccccgaaacccuaaaguacgaacugaugggucuaaaguacagcgaccucuccuuugagaaaggcaccgggaacuaccacauaucucaagaaaaauacgacgccaucaaagaaaaagagggaauuggcaagaaaucggaguucaaguucacguuauaccgaaacgaccucauccuaauuaaagacauagcaagcggcgaacaagaaauauaccgauuccucucccgcaccaugccaaacgucaaccacuacgucgaacucaaaccguacgacaaagaaaaauucgacaacguccaggagcucguggaagcacuaggcgaggccgacaaagucgggcgaugcaucaaaggucugaacaagccgaacaucagcaucuacaagguaaggacagacguacucgggaacaaauacuuugucaagaaaaagggcgauaaaccgaagcucgacuucaagaacaacaagaaauga

SEQ ID NO: 6305 - RNA, 3393 nt, Artificial Sequence
  Cas9 variant
augacgaacggaaaaauccucggccucgacaucggaaucgcgucagucggagucggcauuaucgaagcgaagacaggcaaggucgugcacgcaaacucacgucucuucagcgcagcgaacgccgagaacaacgcugagcggcgagguuuccgcggcucccgacgccucaaccgccgcaaaaagcaccggguaaaaagaguccgagaccuauucgaaaaguacgggauugugacugacuucagaaaucuaaauuuaaacccuuaugaauuacggguaaaaggccuaaccgaacagcucacuaacgaggaauuguucgccgcacugcggaccaucuccaaaagaagaggcaucucauaccucgacgacgcggaagacgacagcacaggcagcaccgacuacgcaaaaagcauagacgaaaaccggcgacuccucaagacaaagacccccgggcaaauccagcucgaacgccucgaaaaguacggccaacuucgaggcaauuucaccgucuacgacgaaaacggagaagcacaccgacucauaaacgucuucagcacaagugacuacgagaaggaggcacgcaagauucucgaaacacaagcagacuacaauaaaaagaucacagcagaguucauagacgacuacgucgaaauacugacccagaaaaggaaauacuaucacgggccaggcaacgagaaaagccgcacagacuauggccgcuucagaaccgacggcacaacacucgaaaacauauucgggauucucaucggaaaaugcagcuuuuaucccgacgaguauagggccuccaaggccagcuacacugcccaggaguauaacuuccugaacgauuuaaacaaccucaaagucccaacggaaaccggaaaacuguccaccgagcaaaaggaagcccuagucgaauuugcaaaaucuacggcgacccucgggcccgccaagcuacuaaaagaaaucgcgaaaauccuagacugcaaggucgacgaaauaaaaggcuaccgcgaagacgacaaaggcaaacccgaccugcacaccuucgagccauacagaaaacuaaaguucaaccuagacagugucaacaucgacuaccuaucccgggaaguccuagacaagcucgcgggcauccucacccucaacacggagcgagaaggcaucgaagaugcaaucaagcgcaacuugccaaaccaauucaccgaggaacaaaucagcgaaauuaucaauguccguaaaagucaaucgacugcguucaacaaaggauggcacagcuucagcgccaagcuaaugaacgagcucauccccgaacuauacgcaaccucagacgaacaaaugaccauacucacaagacuagaaaaguucaaagucaaaaagaaaucuagcaaaaacaucaaaacgaucgaugagaaagaaaucacagacgaaaucuacaaccccgugguagcaaagagcguccgccaaacgaucaaaauaaucaaugccgcaguaaagaaauacggcgacuucgacaagauaguaauagagaugcccagggacaaaaacgcagacgacgagaaaaaguucauuaacaaacgcaacaaagaaaacaagaaggaaaaggacgacgcccuaaaacgcgccgcguaccucuacaacggaaccgacaaacuucccgacgaagucuuccaugggaacaaacagcuggaaaccaagauccgccuaugguaccaacagggggaaagaugccuauacuccggaaagccgauaccaauucaagagcuaguccacaacucaaacaacuucgaaauagaccacauccuaccccucucccugucauucgacgauagccuggcgaauaaaguccuaguauacagcuggaccaaccaggagaaaggccagaaaacgcccuaccaaguaaucgacagcauggacgccgcauggucauuccgcgaaaugaaagaauacguucuaaagcagaagggacuaggcaagaagaaaagggacuaucuacugacaacagaaaacaucgauaagauagaagugaaaaagaaauucaucgagcgcaaccugguagauacccgguaugcaucucgcgucguacuaaauucacuccaauccgcgcugagagagcucggcaaagacacgaaagucuccguaguccgaggacaauuuaccagccaacuccgccgaaaauggaaaauagacaagucaagggagaccuaucaccaccaugcagucgaugcacucaucauagcggcaagcucccaauuaaaacucugggagaaacaggacaauccgauguucguagacuacgggaacaaccaaguaguggacaaacagacaggagaaauccucagcgucucagacaacgaauacaaagaacugguuuuucagccacccuaccaaggcuucguuaacacaauauccaguaaggguuucgaagacgagauacucuucagcuaccagguagacuccaaauacaaccgaaaggucucagacgccacaaucuacagcacgcggaaagcaaaaaucggcaaagacaagaaagaggaaaccuauguucucggaaaaaucaaggacaucuacucgcaaaacggcuucgacacguuuguaaagaaauacaacaaagacaaaacccaguuccucauguaccaaaaagacccgcucacuugggaaaaugucaucgagguaauacucggggacuaccccaccacaaagaaaagcgaagacggcaaaaacgaugucaagugcaacccauucgaagaauaccggagggaaaacggacuaaucugcaaguacagcaagaaggggaaaggaacacccauaaaaucgcuuaaauacuacgauaagaaacucgguaacugcaucgacaucaccccagaggaaagccgcaacaaaguaauccugcaaagcauuaacccauggagagccgacguuuacuuuaaccccgagacgcucaaauacgaacugauggggcucaaauacuccgaccugagcuucgaaaaaggaacaggcaacuaccacaucucccaggaaaaauacgacgccauaaaagaaaaagaaggcauaggaaagaaauccgaguucaaauucacgcuauacagaaacgaucucauccuaaucaaagacaucgcaagcggagaacaggaaaucuaccgcuuccuguccaggacuaugccuaacguaaaccacuauguggaacucaaacccuacgacaaagaaaaauucgacaacguccaggaacugguagaggcgcucggagaagccgacaaaguaggccgaugcauaaaagggcugaacaaacccaauaucagcaucuauaaagugcgcacggacguacucggcaacaaguacuucguaaagaaggagggcgacaaacccaaacuagacuucaaaaacaacaaaaaguga

SEQ ID NO: 6306 - RNA, 3396 nt, Artificial Sequence
  Cas9 variant
auggcccagcauguauuuggacucgacauaggaauagcgucaguuggaugggcaauacucggcgaacaacgcaucauagaccucgguguacgcugcuucgacaaagccgaaaccgcgaaagaaggcgacccccucaaccucacgcgaagacaggccagacuccuaagaagaaggcuauaccggagagccuggagacugacccaacuauccagacucuuaaaacgaaaaggucucauugcggacgccaaacucuucgcgaaagcaccauccuacggcgacucggcaugggaacucagaagacagggacucgaccggcugcugaccccacuagaaugggcccgagucaucuaccaucaaugcaaacaccgcggauuccacuggaccagcaaggccgaagaagccaaagccgauuccgaugccgaaggcggccgcgucaaacaaggccuagcccacacgaaagcccucaugcaagccaaaaauuacaggagugcagccgagaugguacuagccgaauuuccagacgcccagcgaaacaaacgaggccaguaugacaaagcacuuucccggguccuacucggcgaggagcuugcacuacuguucgcaacgcaacgaaggcucggaaacccccacgcgucggacuucuucgaaaaauuaauacugggagacggagaccgcaaguccgguuuguucuggcagcaaaaacccgcacucuccggcgccgaccuguuaaaaauguuaggcaaauguaccuucgaaaaaggagaauacagggcaccaaaggccagcuucuccguagaacggcacguauggcuaacccgccuuaacaaccuccgcauagucguagacggcagaucaagaccccucaaugaagcggaacgacaagcggcauuacuccuccccuaccaaacagaaacaagcaaauacaaaacacugaaaaacgccuucaucaaggcaggccuauggggagacggcgucagauucggaggccuagcauacccaagccaagcccaaauagaugcugagaagacaaaggacccggaggaccaauuccucgucaagcuaccagccuggcacgaacuccgaaaagcauucaaagcggcagggcaugaagcacuauggcaacaaauaagcacccccgcacuggacggagacccaacccuacucgaccagaucgcuacgguccucuccguguacaaggacggcgccgaggucguccaacaauuacgccaacuagccuuaccagaacccgcagccagcaucgcuguacuggagaaaaucucauucgacaaauucuccagccuaagccuaaaggcacuccgaagaaucguaccgcuuaugcaauccggccuacgguacgacgaagcgguggcccaaaucccagaauacgggcaccacagccagcgcaucgaacccggagcagcgaagcaccuauaccuaccaccauuuuacgaagcacaacgaaaauacgcaggaaagggcgaccacauaggaucaaugcaauuucgcgacgacgcagacaucccccgcaacccugucgugcuucgggcacucaaucaagcacgaaaagucguuaacgcccucauacgcgaauacggcucacccauagcagucaacaucgaaauggcgcgcgaucuaucacgcccgcucgacgaaagaaacaaagucaagagggcccaagaggaguuccgagacagaaacgacagagcccgaagcgaauuugaaagagacuucggcuacaaacccaaagccgccgccuucgaaaaauggaugcucuaccgggaacaacucggccagugcgcauacagccaacaaccacuagacauacaaagaguucuggaugaccacaacuacgcccaaguagaucacgcccuccccuacucaagaaguuacgacgacuccaaaaacaauaaaguguuaguccugacacacgaaaaccaaaauaaaggcaaucgaacagcauucgaauaccuuacauccuuuccagacggcgaagacggcgaaagauggcgcacauucguugcguggguccaagguaacaaggcuuacagaauggccaaacguaacaggcuacuccguaaaaacuacgguguagacgaaaguaaaggauucaucgaccggaaccuaaaugacacacguuacaucugcaaguucuucaaaaacuacguagaagaacaucuacaacuagccgcgagagccgacggggacacggcgcggagauguguagucguaaacggacaacucacagcauuccuaagagcucgcuggggccucacaaaggucagaggagacagcgaccgacaccaugcucucgaugccgccguaguagcagcaugcacacacggaaugguaaaggcacuggccgacuacucacgaagaaaagaaauuucauuccuacaagagggauuccccgauccagaaacaggggaaauccucaaccccgccgcuuucgaccgcgccaggcagcacuuccccgaacccuggacgcacuucgcccacgagcuaaaagccagacuauuuaccgacgaccuagcagcacuccgagaggacaugcaacggcucgggagcuacacgaccgaagaccugggacgccugagaacccuguucgucucccgagcaccccaacgcagauccggaggggccguccauaaagagaccauuuacgcccaaccagaaucucuaaaacaacaaggcggggucauagagaaaauucuacucacgucucuaaaacugcaagauuucgacaaacuucucaacccagaaagcaacgaccauuucguagaaccgcacaggaacgaacgccuguacgcggcaauacgccaacgccuagagcaguucgggggacgugcagacaaagccuucgggccagacaaccuauuccacaaacccgacaaaaacaaccagccaaccggcccuguaguacgcucaauuaagcuagucagaggaaaacaaacaggcauacccaucagaggcggccuggccaagaacgacagcaugcuccgcgucgacaucuucacaaaggcaggaaaauuccaccugguuccaguauacguccaccacagagucacgggucuccccaaccgagccauagucgcauucaaagacgaggacgaauggacacugaucgacgaauccuucgccuucuuguuuucagucuacccuaacgauuacgucaaagugaccuuaaagaaagaacaacaaagcggcuacuacucgggagccgacagaagcacuggcgcaaugaaccucugggcucaugaucgagccgcaucagucgggaaagacggccucauccgcggcaucggagucaaaacggcucucagcgucgaaaaauuuaacgucgacguacucgggcgaaucuaccucgcuccaccagaaacccgcucgggucuugcauga

SEQ ID NO: 6307 - RNA, 3399 nt, Artificial Sequence
  Cas9 variant
auggcgcaauacguauucggacuugacaucgguauagccucagucggcugggcgguccuggaugcccaacgcauaguagaccuaggcgucagaugcuucgacaaagcugaaaccgcaaaagaaggagacccccuaaaccucacucggagacaggcccgauugcuaagacguagacucuaccggagagcauggaggcucacucaauuagccagacucuucaaaagagaaggccugauagacgaugcuaaacucuucgcgaaagccccaucauggaccgaaaacgcaugggaacuccgacuacggggacuagaccaucugcucacaccccuagagugggcccgagugauuuaccaccucugcaaacacagaggauuccacuggaccagcaaagccgaggaagccaaagcggaaucagacgccgaaggagggagggucaaacaagggcuagcccacaccaaagcccucaugcaagugaaaaacuaccggucaacagccgagauggugcuagccgaguucccaggggcccaaagaaacaagcgagggcaauacgacaaagcacugucaagaguacuacugggagaagaacuggcgcuacuguuugcgacacaacgacgacugggaaacccacacgccucagagcacuucgaacaauuaauauuaggccacggggacagaaaauccggucuauucuggcaacagaaacccgcacugagcggcgccgaccuauugaaaaugcuaggaaagugcacuuucgagaaaaccgaauacagagcaccaaaagcgucauucagcgcagagagacacguuuggcuaaccagacucaauaaccuacggaucguaguagacggcagagcgagaccgcuaaaugacgccgaacgccaggccgcacuccuacuacccuaccagacggaaaccuuuaaauacaagacccuaaaggccgcauucguaaagguaggacucuggggcgacggggugcgauucgggggacuagcauauccgucacaagcacaggcggaagccgaaaaggcuaaagaccccgaagaccaauuccucgugaaacugcccgccuggcacgagcuccgcaaagccuucaaagccgcaggucacgaagcacuauggcagcaaauaagcaugcccgcgcuggaagaagacccaacucuacuagaccagaucgcuaccguccucucagucuacaaggacggaacugaagucguccaacaacugcggcaguuggcccuacccgaacccgacgcaucgaucgccguacuagagaaaauacgcuucgacaaguucuccucgcuaagccucaaagcacuucggagaauagucccccuaaugcaaggaggacuaagauacgacgaagccgucgcccagaucccggaauacgggcaccacagccaacguaucgaccccggagccacgcgccaccucuaucuaccacccuuuuacgaagcccaaaggaaauacgcagggaaaggcgaccgcauaggauccaugcaguuccgagaagacgccgacguaccccgcaaccccgugguccucagagcacuaaaccaagcccgaaaaguuguaaacgcacugauccgggaauacgguucaccaguagccgucaacaucgaaauggcgcgcgaccuuagcaggccacucgacgagcgaaauaaagucaaaagagcccaggaagaguuccgagaucgaaacgacaaagccagaagugaguucgaaagagacuucggcuacaaaccaaaaggggccguauucgaaaaauggaugcucuaccgagaacaacugggccagugcgcauacucgcaacagccgcuggacauccaaagaguacuagaugacccaaacuacgcacagguagaccacgcccuccccuacagccgaagcuaugacgacagcaaaaacaacaaaguacucguacugacacgcgagaaccaaaacaaaggaaaccgaacacccuucgaauaccugacaucauucccgggcggagaagacggcgaacgcuggagagccuucguagcauggguccaaggcaacaaggcuuaucgaauggcaaaaaggaaccgccugcuccguaaaaacuacgggacagacgagucaagaggguuuauagacaggaaccucaacgauacccgauacaucugcaaauuuuucaaaaacuacguugaggaacaccuacagcuagcugcgcguacagauggggacaccgcacgccgaugcguaguagucaacggacaacugaccgccuuccuccgugcaagauggggccuggcgaaaguccgcggggacuccgacagacaccacgcccuugacgcagccgugguagcagccugcacacacggaauggucaaagcccuagccgacuacucacgaagaaaagaaaucgcguuccugcaagaaggcuucccagacccagaaacgggagaaauccuaaaccucgcagcguucgaccgagcgcgagaacacuucccggaaccauggccacacuucgcccacgaauuaaaagcgagacucuucauagaugaccuggucgcgcuccgagaagacaugcaacaccucggaagcuacgcacaagacgaucuagaccgcuuacgcacccuauucgucucacgagcaccacaacgacgcaacgggggagcuguucacaaaggcacaaucuacgcgcaaccagaaaaccuaaaacaacaaggaagcacaauugagaaaauccuacucacgggacucaaacuccaagacuucgacaaacuacuaaaccccgaaagcuccgaccacuucguagaaccccaccgaaacgaacggcuauacgccgcaauccgccgacgacuagaagaguucggcggcaaagcggacaaagccuuuggacccgauaaacccuucuacaaaccagacaagaauggccaacccacaggcccgaucgugagaucaaucaaacucgucagagguaaacagaccggaauacccauacggggcggacucgcgaaaaacgacuccaugcuacgcguagaugucuucacaaaagccggcaaauuccaccugguacccguauacguccaccaccgcgucacggguuugccagaccgggccauagucgcuuuuaaagaugaagaagaauggacccugauagacgaaaguuacgccuucuuauucuccgucuacccaaacgauuucguaugcgugcaacaacggggaaaaccccuaaucgaaggauacuacgcaggccuagacagagcaaacggcaacaucaacguaugggcgcacgacagagcagcaagcguaggaaaggacggacucauccgcggaaucggcgucaaaaccgcacuaucauuagaaaaacucaacguagacgugcuagggaggauauauccagcuccaccugagacccgacguggucuagcauga

SEQ ID NO: 6308 - RNA, 3399 nt, Artificial Sequence
  Cas9 variant
augaagaaaauccuaggcgucgaccucgggaucaccagcuucggguacgcaauacuccaggaaaccggaaaagacuuguaccgcugccuagauaacagcgucguuaugcgcaacaauccauaugacgagaaaagcggcgaauccucacaaucgaucaggucaacccagaaaagcaugcgcagacucauagaaaagcgcaagaaaagaauccgaugcguagcacaaaccauggaaagguauggcauucuugauuacucggaaacaaugaaaauaaacgaccccaaaaacaaccccaucaaaaaccgcuggcaacuccgagcagucgacgccuggaaacgcccgcucucgccccaagaacuuuucgcaaucuucgcacacauggcgaaacaccgcggauacaaauccaucgcgacggaagaccugaucuacgagcuggaacucgaacucggacucaaugauccagaaaaagagagcgaaaagaaagcagacgaaaggcgacaagucuacaacgcauuacgccacuuagaggagcuacgaaagaaauacggcggcgagacuauagcgcaaaccauccaccgcgcggucgaagcaggagaccuacgcagcuacagaaaccacgaugacuacgagaaaaugauccgccgggaagacaucgaagaggagauagaaaaaguccuacuccgacaagccgagcuaggcgcccuagggcuaccagaggagcaaguguccgaauuaauagacgaacugaaagccugcaucaccgaccaagaaaugccaacaauagaugagagccuauucggaaaaugcacauucuacaaagacgaacuagccgccccugccuacagcuaccuuuacgaccucuaccgacucuacaagaaacucgccgaccuaaacauagacggguacgaagucacucaagaggaccgagaaaaaguaauagaauggguggaaaagaaaaucgcacaaggcaaaaaccucaaaaagaucacacacaaagaucuacgaaagauacugggccuggcacccgaacaaaagauauucggaguggaagacgagagaaucgucaagggcaagaaagaacccagaacauucgucccauucuuuuuccuggcggacaucgccaaauucaaagaacucuucgccagcauacagaaacacccagacgcacuacagauauucagagagcuagcagagauccuacagagaagcaaaacaccccaagaagcccuggaccgccucagggcccucauggcaggaaaaggaauagacacagacgaccgagaacuccucgagcuauucaaaaacaaaagaagcgggacucgcgaacucagccacagauauauccucgaagcauuaccucucuuccuagaaggguacgacgaaaaagagguacaaagaauccuaggauucgaugaccgggaggacuacucccgcuacccaaaaucgcuacgacaccuccaucugcgcgagggaaaccuauuugagaaagaggaaaauccgauaaacaaccacgccgucaagagcuuagcgucaugggcacuaggacuuauagccgaccuauccuggcgguacggcccauucgacgaaauaauccucgaaacaacaagagacgcacucccagagaaaauccgcaaagaaaucgauaaagccaugagggaacgcgaaaaagcacucgacaaaaucaucggaaaauacaaaaaggaauuuccaagcauagacaaacgccucgcccgcaaaauacaacucugggagagacaaaaaggacuggaccuuuacuccggcaaaguaaucaaccuuucccaacuacucgacggauccgccgacauagagcacauagugccucaaucccuaggcggccuauccacagacuacaauacaaucgucacacugaaaagcgucaacgcagccaagggcaacagacucccuggcgacuggcucgccggcaauccagacuaucgggaacgaauagggaugcuaucggaaaaagggcucaucgacuggaagaaaagaaagaaccuucucgcgcagucccucgacgagaucuacacagagaacacccacuccaaaggcauccgagccaccucauaccuggaagcgcuagucgcacagguccugaaacgauacuacccauuccccgacccagagcuccggaaaaacggcaucggcguacgaaugauacccggcaaaguaacaagcaaaacccgcagccuucuagguauaaaauccaaaucgcgagagacaaacuuccaccacgcagaagacgcacucauacuauccacucucacccgcggcuggcagaaccgucuccaccgcaugcuaagggacaacuacgguaaauccgaagccgagcucaaagaacucuggaaaaaguacaugccacacaucgaaggccuaacgcuugccgacuacauagacgaggccuuccgaagguucaugagcaaaggggaagagagccuuuucuauagagacauguucgauacaaucagaucaauuagcuacuggguagacaagaaaccacuaucagcaucgagccacaaagaaacagucuacagcagccgccacgaagucccaacccuccggaagaacauccucgaagccuucgauucacuaaauguaaucaaagaucgacacaaacucacuacagaagaauuuaugaaacgauacgauaaagaaaucaggcaaaagcucugguuacacagaauagggaacacaaacgacgaaucguaccgagccguggaggaacgcgcaacccaaaucgcacagauucuaacccgguaccagcucauggacgcacaaaacgacaaagaaaucgacgagaaguuccaacaagcccucaaagaacugauaacgucccccauugaaguuaccgggaaacuacuccgaaaaaugcgauucgucuacgacaaacucaacgccaugcagauagaucgaggacucgucgaaacggacaagaacauguuaggcauacacauaucgaaagggcccaacgaaaaacucaucuuccggcggauggacgucaacaacgcacacgaacuccaaaaagaaagaucaggcauacugugcuaccugaacgaaauguuauucaucuucaacaaaaaggggcucauccauuacggaugucuaagaagcuaccuagaaaaaggccagggaaguaaguacaucgcgcuauucaacccccgcuucccagcuaaccccaaagcccaaccaagcaaauucacguccgacuccaagaucaagcaaguagggaucggcucggccaccggcaucauaaaagcccaucucgaccucgacggucacguaagauccuacgaaguauucggcacacuccccgaaggcuccaucgagugguucaaagaggagucgggauacggccgaguugaagacgacccacaucacuga

SEQ ID NO: 6309 - RNA, 3402 nt, Artificial Sequence
  Cas9 variant
auggacuugaauuaccgaauaggacuggacaucggaaucgccuccgucggaugggcgguacuggaaaacaacucaaaagacgaaccgguacgaaucguagaccuaggggucaggcuauuugaagcagcggaggugcccaaaacaggcgcagcgcuugccgaaccgagaagagaggccaggacaacaaggcgcagacuaaggcgaagaaaacaccgccuggaacggaugaaguggcuccuacaagaauauggacuaauacaaacagaagaguucaugaaacgguaccacagugccggacuccccgacguauaccggcuccguuacgaggggcucgagcgcaaacuaaaagacgaggaacuagcccagauccucauccacauaggcaaacaccgaggguucaggagcaccaggaaggcagaacuaaaagacaaaaacgacaaagagacaggcgcagugcuaagcgcgacuagggaaaacgagaagcucauggaagaacacggauaccggaccgcgggagagaugauauacaaagacgacaaauuccgcaccggcugcaccuggaaagaagagggcuacagacugacgcccagaaacaaagagggagacuacaaaaacaccaugcuacgggcccugcuagaagacgaagugaaaguaauauucgauugccaaagaaaguucggcaaccaaaaggcaucagaggagcucgaaaaagcauaccucgccaucaugaccucacaacgcagcuucgacaugggaccagguaaacagccagacggcuccgcaagcccguacgcaauggagggcuucggagaccgaguggggcucugcgcccuugaaccacgugaaaagcaggaaccaagagcucccaaggccgccuacacaucggaacuguucgucgcgcuacaaaagaucaaccaucugcgaaucacagaaaagaacggaaaaggccgaggauuaaccucggaggagcgcgaacgacugagcgaucuauugcacaagaaaaaggagcugacguacggcgcggugaggaaagagcuacagcuagaccuacgauaccgauucaacaccuuaaacuacucaucaaagaagaugacagaagaagagaaaaucaaagacgccgaaaaagcaaaauucgucagcauggucucacacuacgaauacaggaagcggaugagcgggaugcuggaacaacugucaccagaagaacaggccgaccuaauggacgaagucggcaaaauccugacauuauacaagaacgacgauacgaggucccgagaauuucagaaacucggacuggauucggaaauaaccgaagaacuacucgaacucaacccccgaggcuuccaacacgugagcuuaaaagccaugaagaaacuaaugcccuaccugaaagagggacuuaccuaugacaaggcgugcgccgaagcaggauacgacuuccaagggagcgugcagaaagagcgcucaaggcuacucaaaggaaaagaaaucacagacaucauaaacgacaucaacaacccagucgucaaacgaucggugagccagaccguaaaagucauaaacgccauaauacaaaaauaugggagcccacaggcggucaacauagaacuggcccgcgagaugagccgaaacuaugacgaaagacggaaaauggaaaagcaaaugaaagaucgacagagugaaaaugaacgcgcgaagaaggagauccaagaacucggaaacgcguuccccacgggacaagacauccucaaauaccgacuauggcacgaccaggacgggaucugcauguacagugcgaagaggaucccucuggcagaacuauucacaggagcauacgacauagaccacaucuuaccauacuccaucaccuucgaugacucguacagaaacaaaguccuaguaacgucagaagagaaccgacaaaaaggaaacagaauacccuacgaguacuucgggagcgacucggagagauggagcaaauucgagacacucgucaacagccgaauacgcgacuaccgcaaacaacaaaaccugcucaaacagagcuucacggaggaagaaaggaaagaguucaaacaacgcaaccucaacgacacaaaauacauaacaagaguaauauacaauaugaucagagaaaaccuggcacuagcaccguacaacuccccaggaaagaagaaacaagucuucgcagucaacggcggagugaccgccuaucuccgaaaaagauggggaauguccgcaaaggauagauccauagacacccaccaugcacgagacgcaguagucaucgcaugcugcacagacggaaugauacagaagaucagccgcaauauccagggccgagaacuacuguacgcgcgcggauucaccgcagucgacgucgagacuggcgagaaguuuacaagagacgacuucacccgagaccaaugggacgagauauucggcguccaaguaccaaaaccaugggaguacuucaacgaggaacucgacauaagacugggggaaaacccaguagaguucauugaaacccacuccgacguaagccgaaaguuagauuacccagcaugguucuacgaaaauaacaucauacgacccgucuucgucagcagaaugccaaaccgaaaggucacaggggcggcgcaugcagacaccauacggucgccacgacacuaccaagaaacagguagcguccuaacaaagaccgcccuaaucgaccuaaaacuaaacaagaagacgggagaaauagaaaauuacuacaaaccagaaucagacacacuacuauacaacgcccucaaggaaaggcuagaacuguacggaggagacggcaagaaggccuucgaagaacccuuuuauaagcccaaagcagacggcucccgcgggaaucuagugcgcaaaguaaagaccuacgacaagcuaacccucggggucuacgucaacagccagcacggaaucgccgccaacgcaaacgggagcauggugaggguagacgucuuccgcguaagcggcaaguauuauuucguaccaguauacauagcagauguagugcgcaagcgacugccaaugaaagcggucgugcaggggaaacaguacaucgacuggaaagagauggaagacaaggacuuuauauucagccuauacacacgggaccugauaucguucaaaagcaagaacgggaagaaaguaacaugcguagacggaaccaguaaagcggucaacgaagaaaucgucuacuacuacggagcaaacaucucgacagcaaguuucagcggcaaaagccauaacggcagcuucgaguucaccucccucggaauccaggggcuagaauaucuuaagaaauaccaaguugacguccugggaaacguaagcgaagucaagcgugagaaacgaaugggcuucagguga

SEQ ID NO: 6310 - RNA, 3402 nt, Artificial Sequence
  Cas9 variant
augggaggcuuugaagucgauagaaaaaucucccuuggcuuggacaucggcgucaguuccgucgguuacagcguaaucgacgucgacaccgguaaaguccuugaacuaggcagccgacucauuaacggcaaaaucgguacggagaaccaagcgcgccgcgaaaugcgaggcacccgccgacucaucaaccguaaaaagcagcgacgaaaagacaccguaaaauuauuuaacgaguucaaacucaucgacagcaagaaagacgagcacuacuucgaccacuucgccaacaacucagaccccuacgaacuacgcgucaaaggccugagcgaaaaacuaagccucuccgaaauagccgacggucucuaccacauugucaaacgccgaggcauauccuacgaccugaaggaugccgacgaggaaucagaaggcagcgaauacgaaaacgggcucaagauaaacaacucagaauuaaagaaccagacccccgcucagauccagcugaaacgccucaacgaauacggggccauacgcggcaagguagucaucgaugaggagaaaauacuccuuaacguauucccaaccaaagcauaccuggacgaggcaaaaaggauaauagagaagcaacgcgaauuuuaucccggaauacucaccgaagaauuugaggagaaauacugccaaauacucacccgaaagagagacuacuucguugggcccggcagcgagaaaagccgcaccgacuauggcaucuacaaagaagacggccggacacuuaacaaccucuucgaggagcucauaggccacgacaagaucuacccagaggagcuccgcgccaguggugcuucauucacagcucaacucuucaacguccuaaacgaccucaacaacuuacacaucagcucauacgaagaccaaaaacugacgaccgaaaacaaggagcaaaucauaucggaacucaagucaaccacgucaaauguaaacaugaugaaacuaauccagaaaaucgccgggugcgaggaauccgacaucucgggcuaccguacagacaaaaacuauaaaccagaaaucaguagcaugcgaauauaucggaagguccacaagaagcuacucgaaucagaaauagacauaacaaacuggccagacgacuucauuaacaaacucagcuucauccucacccuaaauaccgaaaacggggaaauacguaaccaacucaaaaaccgucuccagccagaauacgacuuccucacagaugaacuaauucaaacgauuauagauaacaaagaauccuucgacauaaagaguaacaacaaauggcacagguucuccaucaagacgauggagcugcucauacccgaaaugaucaaacggcccguggaacaaaugacacucaucaacgagaugggccuaaucaaaaacuccggcaagaaauucucaaacuauaaauaccucccguacaagaaaauagcggaagauauauacaacccgguagccucgaaauccgugcgagaagcacuaaaaauagugaacgcgauccucaaagaauaugggcacauagaauacauaguggucgagaugccgagggacaaaaacgaggacgaagcuaaagaucagaucgaaaaguuucagaaggccaauggacgccucaaagaugccgcccucgaggaauuuaccgaggccauuggcgacaaaucaaccguggacaagaaacuaggaguacaccgaagcaaacuacuauuuaagauaaggcucugguaccaacaacgcgggauggaccuauacgagggcaagccuaucucggccguugaccuccucaacaacccagacuccuuccaaauagaccauauaaucccccaauccgucagcuucgaugacaguuucaacaacaaaacccucugcaacagcggccucaaccaaaucaaagacaagaaaaccccuuucgaauacaugaacgaaggguacggacagggauucgacagcaugaaggccaugguaaugaaaaacccccgcauugaccacaacaaaaggaaaaacuaccucuucagugaaaaugucagugacauagagaccagaaaacgcuucauaagccggaaucucguggauacccgcuacgcaucgaggguagugcuaaauaaccuccaagaauuuuucaaagaaaaagaaagcgacacaaagaucagcaucauacgcggaaaauucaccuccaaucuacgcaagcacuggaaaauuaacaaaaacagagacaccuaccaccaccacgccaucgaugccacgauaauagcagcgacccccuuccuaaacaucuggaagaaaggcuccagcaucuuccccagcaacgucgaaagcgaagacuucuucgacaucaaaaccggcaaaauaaucgguaacgacgaguucaacaaauacgcauacgacgaacccuacaacggauucuacaaugaacugcggaacgccacagacagaauaaaauucucgcaccagaucgacaagaaaaugaaccgaaaaguaucagacucgacaaucuacuccacucgcguagcuaaaagccccaaaaacaagaaagaaagcgaauacaucguggccaaaaucaaaaauauauacgacgcagacgaauacgcaaaauucaaacgaaucuacgacaaagacaaaaccaaauuccuccuaaacaaauacgacccacgcucauucaaccaccuagaaaagaucaugaacacauauccagacucaaucgaacgaacgaugucaaacaacaaagugaaggucguacgcaucuccccauucgaacucuaucgccaagaccacggccccgugaagaaauacagcaagaaaaacaacggccccgaaauaaaacaacugaaauaccuggacaagaaagucggcagcagcauugacguaaccccggacaacgcgaaaaauaaacacguaauccuuaaaucccuaaaacccuggcgaaccgacaucuaccucaaccacgaaaccggcgaguacgaaaucaugggcauaaaauacuccgaccugaaauucaacaaaggcgaaggguacgggaucaaaaaggccaaauaccuagaaauaaaacaccgggaaaagguaagcgacgacuccgaguucauguucacauuguacaagaaaaacaggaucaaagucgaaaacauggagacagaugaaagcgucgagaugcuuuucuggucucgaacaauggacucucaaaaaggcuaugcagagcucaaaccaauauacaaauacaagaccgaagacgacaauuggccgauuuacggaaacgcuaagaaacagauuaucaagaagcucauccccaaaaacuguaaaauauggaagguaaacaccgacguacugggaaauccauucuacguagagaaggaaggcgaguaccccaaggacguccuagacuga

SEQ ID NO: 6311 - RNA, 3405 nt, Artificial Sequence
  Cas9 variant
augaacggccuaguccuuggacuggacauaggaaucgcauccgucggaguaggcauccuggagaaaaacagcggcaaaaucgugcaugccucaucgcggaucuucccggcggcaaccgcggacaacaacguagaaaggcgaaagaacagacaagcacgacgacuccaucgccgaaagaaacaucgcggcgcacguuuaaaagacuuguucgaguacuauggacuccuaacagacuucagcaaaguaagcauaaauuuaaacccauaccgacuccgagucgacggccuagaccagcaacugaccaacgaagaacucuucaucgcccucaaaaacaucguaaagaggcguggcauuagcuaucuagacgacgcaucugaagacggagggacagugagcucagacuauggaaaagcaguggaagaaaaccgcaaacuccuggcugaacagacacccgggcaaauccaacuagaacgcuuugaaaaguacggccaacuucgaggagacuucacggucgucgaaaacucugaaaaaugccgccugaucaacgucuucagcacgagcgcguacaagaaagaggcggagcguauacugcgaaaacaacaagaguuuaacaaccaaauaaccgacgaguucaucgaagauuaccucaaaauccugacggggaagcgaaaauauuaccacggaccagggaacgagaaaagccggaccgacuacggccgcuuccgcaccgacggagcgacccuagacaacauauucgguauacucauaggaaaaugcacguucuaccccaaugaguaccgagcgagcaaggccucuuacaccgcacaagaguucaaccugcucaacgaccuaaacaaccucacggucccaaccgaaaccaagaagcucuccgaagaacagaagaaaaccaucaucgaauacgcgaaaucagccaaaacacucggagccuccacacugcuaaaauacaucgccaaaaugaucgacgccuccgucgaccaaauccguggcuaccgagucgacgucaacaacaaaccagaaaugcacaccuucgaaguguaccgaaagaugcagagccuugagaccauauccgucggcgaacuaucccgcaacauccuagacgaacucgcgcauauacuaacacucaacaccgagagagagggcauagaggaagccauaaauacaaaacuacgcgauaguuucucgcaagaccaaguuuuagagcucguccaauuucgaaagaacaacuccagccuguucagcaaaggcuggcacaacuucagccuaaaacuaaugauggagcucauccccgagcucuacgagacguccgaggaacagaugacgauccuaacgcgacucgguaagcagaaaagcaaggagaccucgaaaagaaccaaauauaucgacgaaaaagaggucaccgaagaaauuuacaaccccguagucgcaaagagcguccggcaagcgauaaaaaucaucaaugaagcaaccaagaaacacggcaucuucgacaacaucguaaucgaaauggccagagaaaacaacgaagaagacgcgaagaaagacuacauaaaacggcagaaagccaaccaagacgagaaauacgccgcaauggagaaagcagcauuccaauacaacggcaaaaaggagcuccccgacaacaucuuccacggacacaaggagcuugccacaaagauacgccucuggcaccaacagggagaaaaaugccuauauacaggcaagagcauaccgaucagcgaccuaauacacaaccaguauaaauacgagauagaccacauccugccacuaucccuauccuuugacgacucccugucgaacaagguacucguccucgccacugcaaaccaagaaaaagggcaaaggacaccuuuccaagcacuagacagcauggacgacgccuggaguuacagagaguucaaaagcuacgugaaggaauccaaacuccucgggaauaaaaagaaagaauaccuccucacagaagaggauaucagcaagaucgagguaaaacagaaauucauagagcgcaaccuaguggacacacgguacuccucccgcgucguccucaacgcccuccaggacuucuacaaaaaucacaacuucgacacgacgaucagcguaguccgcggccaauucacgucucagcuccgccgcaagugggggcuagagaaaagccgagaaacauaccaccaccacgcagucgacgcccuaaucaucgccgcaagcucccaacugcgauuauggaagaagcagaacaacccccugauagcauacaaagaggggcaauucgucgacucacagacaggcgaaauaaucucgcuaaccgacgacgaauacaaggaacugguauuuaaggccccauacgaccacuucguagacacccucuccucaaagacuuucgaagacucaaucuuauuuucauaccaaguagacuccaaguucaaccgaaagaucuccgacgcaaccauauacgccacgagaaaagccaaacuagacaaagaaaagaaagaauacacguacacgcucgguaaaauaaaagacaucuacucccucggcaccaaaacucccagcaagacgggguucuacaaguuccuugaccucuauaacaaagacaaaucgcaguuccugauguuucagaaagaccgaaaaaccugggacgagguaaucgagaagaucauggaacaauaccgccccuucaaagaguaugacaaagccggcaaacucguagacuucaauccauucgaaaaauacagacaagaaaacggaccgauacgcaaauauagcaagaaaggaaacggaccagaaaucaaaucccugaaauacuacgacauccugcuaggcaaacacaaaaacaucacgcccgaaggaagccguaacaccgucgcacuccugucccugaacccauggcggacagacguauauuacaacauggagacaaagaaauacgaguuccugggccucaaauacgccgaucucccauucgaagaagggggugccuacgggaucuccaccgaaacauacaacgaacuucgggaaaaagaagggauuggcaaaaacucagaguucaaauucacucucuacaaaaacgaucucauacugauuaaagacacagaaacgaacugccaacaguucuuccgauucuggagccggaccggaaaagacaacccuaagagcuucgaaaaacacaaaaucgaacuuaagccuuacgaaaaggccaaguucgaaaagggcgaagaacuagaaguacuaggcaaagucccaccguccagcaaccaauuccagaaaaacaugcaaaucgagaaccuaucaaucuacaaagucaaaaccgauguacuugggaacaaacacuuuauaaagaaagagggagacaagccaaaacuuaaguucuga

SEQ ID NO: 6312 - RNA, 3405 nt, Artificial Sequence
  Cas9 variant
augaacggccuuguccuaggccuagacauagggaucgccuccgugggcgucggcauccucgaaaagaacucaggcaaaauaauacacgcaaacagccgacuguucccagcggccaccgcagacaacaacguagaacgcagaaagaaccggcaggcgcgacgccuaaauaggagaaagaaacaccgcggcguacgcuuccaagaccucuucgaagacuacggacuccucacggacuucucgaaagugagcauaaaccucaacccauacagacuccgagucgacggucugaaccaacagcucaccaacgaagaacucuucauugcacugaaaaacauagucaaaagacgagggauaagcuaccucgacgacgccagugaggacggaggagccgucuccagcgauuacgggaaagcaguggaagagaacagaaagcuacuugccgaacagacgccgggccaaauccaacucgaacgguucgaaaaauacggccagguacgcggugacuucacgguaguggaaaacggagaaaagcugagacuaauaaauguuuuuagcaccagugcauacaaaaaggaagcggaacgcauccucaggaagcaacaagaguucaacaaccagauaacggacgaguucauagaagacuacuuaaaaauccucaccggcaaacgaaaauacuaucacggaccaggcaacgagaaaagccgaaccgacuacggaagauuccgcaccgacggcacgacccucgacaauauauucggaauccuaauuggcaaaugcacauucuaucccgaagaauaccgcgcaaguaaagcgucauacacagcgcaggaguucaaccuccuaaaugaccucaacaaccuaaccgucccaacagaaacaaagaaacuaagcgaggagcaaaagaaaguaaucguagaauacgccaaagaagcaaaaacccucggcgcuuccacgcuccuaaaauacauagccaaaaugaucgacgcgagcgucgaucaaauccgugguuacagagucgauguuaacaacaaaccagaaaugcacacauucgagguguaccggaaaaugcaaucacuagagacuauuucggucggcgaacuaagcagaaacguccuagacgaacucgcccacauacugacccuaaacacggagagagaggguauggaagaagccauaaacaccaagcuaaaggacagcuucagccaagaccaaguccucgaacugguccaauuucggaaaaacaacuccucccucuucucgaaaggguggcacaacuucagcuugaaacugaugauggagcucauccccgaacucuacgaaaccucagaggagcaaaugacuauacuaacgcgacuaggcaaacaaaagagcaaagagacuagcaaacgcacgaaguacaucgaugagaaagaacucacagaagagauauauaaucccguagucgcaaaaagcguucggcaagccauaaaaaucaucaacgaggcgaccaaaaagcauggaauauucgacaacaucguaaucgaaauggcacgcgaaaacaaugaagaagacgcgaagaaagacuacauuaaaagacaaaaagcgaaccaggacgagaaaaacgcagccauggaaaaagcagccuuccaguacaacggaaagaaagaacucccagacaacauauuccacggccacaaagaacucgccacaaaaauccgccucuggcaccagcaaggcgaaaaaugccuguauaccggaaaaaccaucccaaucuccgaccucauacacaaucaguacaaauacgagaucgaccacauacuaccccuaaguuuguccuucgacgacagucuaagcaacaaagugcuaguucucgcuacugccaaccaggagaagggccaacgcacuccguuccaagcacuggauagcauggaugacgccuggucauaccgggaguucaaaaguuacguaaaggaguccaaacuacucggcaacaaaaagaaagaguaucuccugacagaagaagauaucucaaaaauugaagucaaacaaaaauucaucgaaagaaaccucauagacacccgauacagcucacgcguaguacuuaacgcccuacaagacuucuacaaagcacacaaguucgacacaaccauuuccgugguccgcggccaguucacaucccagcugcgccgaaaguggggauuggaaaaaucucgcgaaaccuaucaccaccacgcgguagacgcacuaauaauagcagcaaguucacaacuaaggcuguggaagaaacaaaacaacagccucauauccuacaaagaaggccaauucgucgacagugagacaggcgagaucauaucacuaaccgacgacgaauacaaagaacucguuuucaaagcaccguacgaccacuucgucgacacccugcgaucgaagaaguucgaagacucgauacucuucuccuaccaagucgacuccaaguucaaccguaagaucagcgacgccaccauauacgcaacacgaaaagcaaaauuagacaaagaaaagaaggaauacaccuacacacuuggcaagauuaaagauaucuauucccuaggcacgaaagcccccucaaaaaccggcuucuacaaguuccuugaccuguacaacaaagacaaaucacaguuccuaauguuccagaaagaccgcaagaccugggacgaagucaucgagaaaaucauggaacaauaccggccauucaaggaauacgacaagaccggaaaacuggucgacuucaaccccuucgaaaaguaccgccaagaaaacgggccuauacgaaaauacagcaagaaaggcaauggacccgaaauaaagagcuuaaaauacuacgacauccuacucgguaaacacaaaaacauaacacccgaagggucaagaaacacggucgcccugcucucccugaacccauggcgcacagacgucuacuauaacauggaaacaaagaaauacgaauuucugggacuaaaauacgcagaccuacccuuugaagaagggggcgcauacggcaucagcaccgaaacauacaacgaacuccgggagaaagaaggcaucggcaaaaacuccgaguucaaauucacacuauacaaaaacgaccuaauccugauaaaagacacugagaccaacugucaacagaucuuccgcuuuuggucuaggacgggaaaagacaaccccaagagcuucgaaaaacacaaaaucgaguuaaaacccuacgaaaaagcacgguucgaaaaaggagaggaacucaagguccucggcaagguuccuccaagcuccaaucagcuacaaaagaacaugcagaucgaaaaccuguccauuuacaaagucaaaacagacguccugggaaacaagcacuuuauaaagaaagagggggaugaacccaaacucaaguucuga

SEQ ID NO: 6313 - RNA, 3405 nt, Artificial Sequence
  Cas9 variant
augaacggccucguacucggccuagacaucggcauugccucaguuggcgucggaaucuuggagaaaaacagcggcaaaaucauccacgagaacagccgccucuuccccgcugcaacagcagacaacaacgucgaacgaaggaaaaaccgacaggcccgcaggcucaaccgacguaagaaacaccguggcguaagguuccaagauuuauucgaggacuacggacuucuaaccgacuucucaaaagucucaauaaaccuaaacccauaccgccuccgcguagacggucugaaccagcaacugaccaacgaggaacuauuuauugcccucaaaaacaucguuaagagacgcggcaucuccuaccuagacgacgcaagcgaagacggcgguacagucccgagcgauuacgggaaagccguuaaggagaaccgcaaauuacucgcagagaaaacaccaggacaaauccagcucgaacgauucgaaaaauacggacaacugcggggagauuucacagucgaagagaacggggaaaagugccgccugauaaacgucuucagcacgucagccuacaagaaagaagccgagcgaauacuacgcaaacagcaagaguucaacaaccagaucaccaacgaguucaucgaagauuauuuaaaaauacuaacagguaaacgcaaauacuaccacggcccagggaacgaaaagagccgaaccgacuacggccgcuuuaggaccgaugggacaacacucgacaacaucuucggcauccugauaggaaagugcacauucuacccggaagaauaccgagugagcaaagccucguauacagcccaggaguucaacauucuuaacgaccucaacaaccucaccgucccaacagaaaccaagaaacucagcgaagaacaaaagaaagacauugucgaauacgccaaggaaacaaaaacccuaggagccuccacacugcuaaaauacaucgcgaaaaugauagacgcaucaguagaucaaauccgcggauacagagucgacgucaauaacaaaccggaaaugcacaccuucgaaguauaccgaaaaaugcaaucgcucgagaccauauccgugggcgagcuaagccgaaacguccuagacgaacuugcgcacauacugacccuaaauaccgagagagaaggaauagaagaggcaauaaacaccaaacuaaugggcgucuucucccaggaccaaguccuggagcuagugcaguucaggaaaaacaauuccucccuauucucaaagggcuggcacaacuucagucugaagcucaugauggaacuaauaccggaacuguacgagacgucugaggagcagaugaccauccuaacccgccuaggaaagcagaagucuaaagaaaccuccaagagaaccaaguacaucgacgaaaaggaagugaccgaggaaauauacaaccccgucgucgcaaaguccgucagacaggcgaucaaaaucaucaacgaggccacaaagaaauaugggauauucgacaacaucguuauagaaauggcccgcgaaaacaacgaagaggacgccaagaaagauuacaucaaacgccaaaaagccaaccaagacgagaaaaacgcggcaauggagaaagccgccuuccaauacaacgguaagaaagaacuccccgacuccauauuccacggccacaaagagcucgccaccaaaauacggcuauggcaucaacaaggggaaaaaugccucuacacaggcaaaaacauccccauaagcgaccucauccacaaucaguacaaauaugagauagaccacauacucccgcuaucacugagcuuugacgacucucucucaaacaaaguccuaguccuggccaccgcaaaccaagaaaaaggccagcgcacgcccuuccaagcccuagacagcauggacgaugccugguccuaccgugaguucaaauccuacgucaaggauucgaagcuccuaucgaacaaaaagaaggacuaccuccugaccgaagaagacaucagcaaaauagaaguaaaacaaaaauucauagaacgaaaccuagucgacacccgguacagcucacgcguaguccucaacgcccuccaagauuucuacaaggcucacaaguucgacacaacaaucuccgugguccguggacaguucaccagccaacucagaagaaaauggggacuagaaaagucgcgcgaaacguaccaccaccacgccguagacgcccuaaucauagcagcaaguucacaacuacgucuuuggaagaagcaaaacaauccgcugaucacauacaaagaggggcaguuuguagacuccgaaacuggagaaaucaucucgcugaccgacgacgaauacaaggagcuagucuucaaagcgccauaugaccacuucguggacacccuccgcagcaaaacguucgaagacucgauacucuucuccuaccaggucgacagcaaauucaaccgcaaaauaagcgacgccacgauauacgcaacgaggaaggcaaaauuagacaaagaaaagaaagaauauaccuacacccuugggaaaauaaaagacauauacucccucgggaccaaaaccccaagcaaaacgggcuucuacaaauuccuagaccucuacaacaaggauaaaagccaauuccucauguuucaaaaagaccgcaagaccugggacgaagucauagagaaaaucauggaacaguauagacccuucaaagaauacgacaaaacaggcaagcuaguagacuucaacccuuucgaaaaauaccgccaggaaaacggccccaucugcaaguacagcaagaaaggaaacggcccagagauaaaaagccugaaguauuacgacauccuccugggaaaacacaaaaauauaacacccgaaggaagccggaacaccgucgcacuucucagccuaaacccauggcgcacggaugucuacuauaauauggaaaccaagaaauacgaguuccuugggcuaaaauacgccgaccugccauucgaaaaaggcggggccuacgggaucagcaccgaaacauacaacaaacucagggaaaaagaggggaucgguaagaacagcgaguucaaguucacucucuacaaaaacgaccuaauccuaaucaaagacacugaaacgaacugccagcagaucuuccguuucuggucccggaccggaaaagacaaucccaaaucuuucgaaaaacauaaaaucgaacugaaaccguacgaaaaagcgcgauucgagaaaggcgaagaacucgaaguacuaggcaaaguuccgccaagcucaaaucaauuccaaaagaacaugcaaaucgagaaccucucgauuuacaaagucaagaccgacguacugggcaagaaacacaucaucaagaaagaaggcgacgagccaaaacucaaauucuga

SEQ ID NO: 6314 - RNA, 3405 nt, Artificial Sequence
  Cas9 variant
augaaguacaucgaaucagucagcauaggcuuugacaucggagucggcucggucggcuacgcaguaaucaacuccaagaccaagcaaauacucgaaucuggcguuucgaucuuccccgccgcaguagcccaaaagaaugucgaacgcagggaaagccgccaaucgcgacgacuacgccggcgccgcgugaaccgcuuaaaugaccucaaaaaacuacucaagaaaaacggcuucauaccauccccgaauaaaaacccauaugaaauccggguaagggggcuagaacaccaacucucgcgagacgagaucgcgauagcaguccuacacauagccaaacgacgcggcaucucuuacucccuugacgacguuguugacgaaaacguaaccgacuucaaggggaaaaucgcaaaaaaccaagaagcccucaaaaauaaaacgccgggcgaaauacaauacgaacgacuccucaaauacggcaagguaagaggcacggucacaaacuacguagaauaugacgaacaacccgaauacuuccuaaacgucuuccccaauagugcauacgucgaugaggcuaaacgaauccuaacgugccagaaacaauacuaccccgaaaucaccgacgaccucaucgagaacaucgucaaaaucauuagccgcaagagagcauacuacauaggaccaggaaacgagaagucacgcacagacuacggaauauacaggacuaauggagagacccuagagaacauauucgaaauucuuauagguaaggacagcgucaaucccgacgagcuaagagcccccgccaacagccuuacagcgcaaguauacaaucuucucaacgacuuaacaaacauccguuacaacggcagcgagcgacucacccccgaacagaaacaggacauccuuucagaacugcuaaccaccgagaaaacuguccagaugcucaacgugaucgccaaaaaagucaacgugaaaaaagaggaaaucuccggauuccgaaccaagaaggaugacaaacccgauuuccacacucucgaaguguaccggaaaguccgaaaacacaugcugaacaagggaaucgacaucaacgaguggccaaccgaaugcuucgacgaacucgccuucaucuuuaaucucaacacagaaauaggcgaaauacgaaaccgcaucucugagaaaguggucccgaaauacgacuucaucacaaaccagaucguagacgaccuccuagaggaccccaaaaucuuugccauaaguaccucgcaaaaguggcaccgcuucucgaucaaaacaaugaacguccuaauccccgagcuccucaacggguacaacgaacagaugaccauccucaccagaaugggacuccucgaggacucuaaaaacgacuacuccaacauagacaaaaucgacaucaaaaacgucacagaaaacauauacaacccagucguucgaaaguccaucaaaaagugccucaaaauauucaacgagcuguacaagaaguaccccaacaucucagacguagucaucgagcuaccaagagaagacaacccggaagacgcccguaaacucauaaaaaaaaugcaaaaagaaaacuuagucgaaaaagacacgucccuagaagcuuuccgaaaggaggcaaauuugagcgagaacgggcucaucgacuuucuccgcaaagguaaaaaccgcgcucuaaagauccgccuaugguaccaacaagaaggcaaaugccuauacacgggcgaaccaauucuagccgaagaccugugcaaaaacgaagccaacuacgacaucgaccacauaauccccaucucagucucuuuugacgacuccaucaauaauaagguacucuguagcucucacuucaacagauucgaaaaggaaaaaaaaaccccauuugaguacuucucaaacaagagcucacaccucggccgcuauuccaacuucgacgaauuccgcgccagcgugaacgccaacaaacgcauuucagacguaaaacgaaaaaaccuucuaucaaaagagcuccuuuccgaccucgacacaagaaagaaauucaucgcccgaaaccuggucgacacuagguacgccagcagggugguuuuuaacgagcucacccaauucuucgccuccaaaaaggcugacaccaaagucgccgucauccgaggcaaauucaccucacaacuccgccgcgcguggcaacucaacaagagccgagacacauaccaccaucaugcaguagacgcagcccuaauaggcgucacgccauuccucaaaaucuggagauccggcaaaaccaucuaccccagaaagaugaccgaagcccagacggacuucgaacuaaacgaaaucacuacaaaugacgaauucaaagagagcuacuaucagcuacccugcccccaauuccuugacuaccuaacccaaaugcaagagaaccucaaaauaaacuuugaggucgauaagaaaaugaaccggaaaaucagcgacgcgaugaucuacuccagccgaaagaaaaagcucaguaaggauaaaaaagaaaaagaguacucucuaggcaccauaaacgacauuuacagcgacgccggcuacagcaaauucaaaaacauauauaaaaaagacaaggaaaaauuccuaauguaccaccucgaccacaaaucuuucgaaauacuggaggacauaauaucacaauaccccgacaaagaggaauauauugacucggagggcaaagucaagcaacgugcugucagccccuucgaaaucuaccgacgcaaauacggauauauccgcaaauacagcaaaaagaacaacggcccaauaaucaaaaacaugaaauacuauaacgaaaaccucccaaagaucuacauagacaucacccccaaacaauccauagacaagaaagucuaccuaacaaacaucucgcccuggcgcaccgacgucuauuacaaccgcucacaaaacuccuaccacaucaugggcauaaaauacucggaccuccguuacauagacggcaaauacggaaucccgaaaaacguauacgaaaagaucaaauuacgagaaaaaauccccagugaauccgaguucugcuucucccuauacaaaaacgacagagucaaaaucauugaccccaacaaaaaugaggaaaucgaguuacgguucaacucgcgcacacuucccagcguccucaacuaugucgaauucaagccacucuuccaggagucauacaacagccugacgcuguugcccguuuucagcaaaaccaccuccgaagggcgcaucauaaaaaaauucaccagagaagacaacauaguauacaaagugaacaccgaugaacuagguaaccccuacuacauucuaaaagaaucccaaaaccccaaaaauauaauagacaauucaaauaaaacagaguga

SEQ ID NO: 6315 - RNA, 3405 nt, Artificial Sequence
  Cas9 variant
augaacggccugguucuaggucucgacaucggaauagccucggaaggcgugggcauccuagagaaaaacagcggaaaaauaauccacgcaaacagccggcuguuccccgccgccaccgcagacaacaacgucgaacgacggaaaaacagacaggcaagacgacucaaccgcagaaagaaacaccgcggcguacgcuuccaggaccuauucgaagacuacggccuccugaccgacuucagcaaagucagcauaaaccucaacccauauaggcuccgcguugacggacuuaaccaacaacucacaaacgaagaacuauucauagcacucaaaaacaucguuaaacgccgcggaauaucguaucuagacgacgccagcgaagacggcggcgccguaaguagcgauuacggcaaagcagucgaagagaaccgaaaacucuuagcagagcaaacacccgggcagauccaacucgaacgauuugaaaaguacgggcaagugcgcggcgacuucacggugguagaaaacggggaaaaacugcggcugaucaacguuuucucaacaucagccuacaagaaagaggcagagcgaauccugagaaaacaacaagaguuuaacaaucaaauaaccgacgaguucauagaagacuaccucaaaauacugaccggaaaaagaaaauacuaccacgggcccggcaacgaaaagagcagaacggacuacgggagguucaggacagauggaaccaccuuggacaacaucuucggaauccucaucgggaaaugcaccuucuaccccgaagaauaccgcgccagcaaagccucauacaccgcucaagaguucaaccuacuaaacgaucugaacaaccucacaguacccacggaaaccaaaaagcuaagugaagaacaaaagaaaguaauaguagaauacgcgaaagaggcuaaaacccucggcgcaagcacgcuguuaaaguacauagcgaaaaugauugaugccucaguagaccaaauacgcggcuacagaguagacgucaacaacaagccagaaaugcauacauuugaagucuaccgcaaaaugcaaucccuugaaaccaucuccguaggagaacugagucgaaacguucuagacgaacuagcccacauacugacccuuaacaccgaacgcgaaggaauggaggaggccaucaacacaaagcuaaaggacucguucagccaagaccagguacucgagcuaguccaguuccggaaaaacaacucaucgcuauucagcaaaggcuggcacaauuuuucacugaaacucaugauggaacugauaccagaacucuacgagacuucagaggagcaaaugacgauccuaacacgacucggcaaacagaagucaaaagaaacaaguaaacgcaccaaauacaucgacgagaaagaacuaaccgaagaaauauacaacccagucguagccaaaagcguacgucaagccauuaaaaucaucaaugaggccacaaagaaacauggcauuuucgacaacaucgucauagagauggcuagggaaaacaaugaagaagacgccaagaaagacuacauaaaacgccaaaaagccaaccaagacgagaaaaacgccgcaauggaaaaagcggcuuuccaauacaacggaaagaaagaacugcccgacaacauauuccacggccacaaagaacucgccacaaaaauacggcuauggcaccagcagggagaaaaaugccucuacacgggcaagacuauccccaucuccgaccucauauacaaccaauacaaauacgaaaucgaccacauccucccccucucucucagcuuugacgacucccucuccaacaaaguccucgcccuagcaacagcgaaucaggaaaaaggccaacgaacgccauuccaagcucucgacuccauggacgaugccuggucauaccgagaguucaagagcuacgugaaagaccucaaaagccuaagcaauaaaaagaaagacuaccuccugacagaggaagacauaucgaaaaucgagguuaaacaaaaauucaucgagagaaaccuagucgauacccgcuacagcucccgcgucguccuaaacgcccuacaagacuucuauaaaagccaccaguucgacaccacgauuagcgucguccgcggccaguucacaagccaacuucgccgcaaauggggccuggagaaaagccgagaaacuuaccaccaccacgccguggacgcgcugauaaucgccgcauccucacaacugcgacuguggaaaaagcagaacaacccacucaucaccuacaaggaaggacaguucguagacucccaaaccggggaaaucauaucacugaccgacgacgaauacaaagagcuaguauuuaaagcccccuacgaccacuucgucgacacccuaucaucaaaaaccuucgaagacuccauccuuuucagcuaccaaguagacagcaaguucaaucgcaagaucagcgacgccacaauauacgcaacaagaaaggccaaacuagacaaagaaaagaaagaauacaccuacacgcugggcaaaaucaaagacauauauucccuaggcacaaaaacgcccucaaaaaccgguuucuacaaauuccucgaccuguacaacaaggacaagucccaauuucucauguuccaaaaagaccgcaaaacgugggacgaagucauugaaaagaucauggagcaauaccggccauucaaagaguacgacaaaaccggaaaacucguugacuucaacccauucgaaaaguaccgacaagaaaaugagccaauccgaaaauacagcaagaaaggcaacggccccgaaaucaaaucccucaaguauuacgacauccuccucggcaaacacaaaaauaucacccccgaaggcucccgaaauacaguagcucugcucagccucaacccauggcgaacagacguauacuacaacauggaaaccaaaaaguacgaauuucucggacucaaauacgcggaccuaccauucgaagaaggaggagcauaugguaucagcacggaaacguacaacgagcuccgagaaaaggaaggaauaggaaagaacagcgaguucaaauucacccucuauaaaaacgaccucauccuaaucaaagauacggaaaccaacugccagcagauuuuccgguucuggagccggacuggcaaagacaacccaaaauccuucgaaaaacacaaaauagaacuaaaacccuacgaaaaagcgcgguucgagaaaggagaggaacucgaaguccuagguaaagucccgcccucguccaaccaacuccagaaaaacaugcagaucgaaaaccugucaaucuacaaggucaagacugacguacucggaaacaagcacuucaucaagaaagagggagacaaacccaaacucaaauucuga

SEQ ID NO: 6316 - RNA, 3408 nt, Artificial Sequence
  Cas9 variant
augucagacuuagugcucggucuagacaucgggaucggauccguaggaguaggcaucuuaaacaaaguaaccggagaaauaauacacaaaaacagcagaaucuuccccgcggcccaagcagagaacaaccuagagcgccggaccaaccgccaaggacgccgccucacacgccggaagaaacaccgccgcguccgccucaaccaccucuucgaagaauccggucucauaacagacuucaccaaaguguccaucaaucugaacccauaccaacugcgggucaaaggacuaaccgccgagcucucgaacgaagaacuauucaucgcacucaaaaacaugguaaagcacagagggaucucguaccuggacgacgccucggacgacgggaacagcucaguaggcgacuacgcccagauaguaaaggaaaacagcaaacaacucgagacaaaaacccccggacagauccaacucgaacgguaucaaaaguacgggcaacucaggggagacuucacaguagaagaagacggacgcaaacaccgcuuaauuaacguguucccgacaagcgccuaccacgccgaggcccuccgcauacuacaaacccaacaagaguucaauccucaaauaacugacgaguucaucaauuccuaccucgaaauacuuaccggaaagcgaaaauauuaccacgguccagguaacgagaaaaguagaaccgacuacggaaaauacaccacaaagaaagacgcccaagggcaauacaucacguuaaauaacaucuucgguauccugauaggcaaaugcaccuucuaccccgaagaauaccgggcagcuaaagcaucauacaccgcgcaagaguucaaccuccugaacgaccuaaacaaccugaccguuccaacagaaacgaagaaauuaagcgaagaacaaaaauaccaaauaaucacguacguaaagaacgagaaagcgaugggcccugcgaaacucuucaaauacauugcaaagcuccucgccugcgacauagcggacaucaaaggcuacaggaucgacaaauccgacaaagccgagauacacaccuucgaagcauaccgcaaaaugaaaacgcuggaaaccaucgacaucgaacagaucgagcgcgaaaaacuagauaaacuagccuacguacuuacgcucaacacagagagagagggcauacaagaggcgcuagaccacgaguucgcagacggcacauuuucgcaagaacaagucgaugaauuagugcaauuccgcaaagccaacagcuccaucuucggaaagggcuggcauuccuucucgguaaaacuaaugauggaacuaauccccgaacuauacgccaccagcgaggagcaaaugaccauacucacgcgccuaggcaaacagaaaacuaccuccucuucaaacaagacaaaguacauagacgagaaacaacucacggaagaaauauacaaccccguaguagcaaaaagcguacgacaagccauaaaaauaguaaacgcagccauuaaaaaguacggagacuucgauaacauaguaaucgaaauggcaagggaaacgaacgaagacgacgaaaagaaagccauccagaaaauacaaaaggcuaacaaagcagaaaaagaugccgcgaugaggaaagcggcaaaccaauacaacggaaaggcagagcuaccccacuccgucuuccacggccacaaacaacucgcaaccaaaauacgccucuggcaccaacaaggagagcgcugccucuacacaggcaaaacaaucucaauacacgaccugaucaauaauccaaaccaauucgagauugaccacauacuuccccuaagcauaacuuucgacgacucucuggcaaacaaaguacuggucuacgccacagccaaccaggaaaaaggccaacggacaccauaccaggcacucgacuccauggacgacgcguggagcuuucgugagcuaaaagcauucgucagagaguccaaagcccuuagcaacaaaaagaaagaauaucucuuaacggaagaggacaucuccaaguucgauguacggaagaaauucauagagagaaaccuugucgacacgcgauacgccucgcgcgugguccucaacgcccugcaagaacacuucaaagcccacaagaucgacacaaaaguaagcgucguaagaggacaauucacaagccagcugagaaggcacuggggcauagacaagacccgcgacacguaccaccaccacgccgucgacgcucucauaauagccgcauccagccagcuaaaccuauggaagaaacagaaaaauacccucgucuccuacucagaggaccaacuacuugacauagagaccggcgagcuaaucucagacgacgaguacaaagaauccgucuucaaagccccauaccaacacuucguggauacgcuaaaaaguaaagaguuugaagacagcauacuguucagcuaccaaguagauaguaaauucaacaggaaaauaucagacgcuacgaucuaugcgacgcgacaagcgaagguaggcaaggacaagaaagaugaaacauacguacuaggaaaaaucaaagacauauacgcacucggaacuaaaacgccgucaaaaacgggcuucuacaaauuccuggaccucuacaacaaagacaaaucacaauuccucguauaccaaaaagaccggaaaacgugggacgaagugaucgagaagaucauggaacaauaccgccccuucaaggagagugacaaaaacggcaaagaggucgacuucaacccguucgaaaaauacagaaucgaaaacggcccgauaagaaaauacucccgcaagggcaacggcccagaaaucaaaucacucaaguacuacgcaagcaaacugggaaaccacaucgacaucacccccaaagacaguaacaacaaagucguccuccaauccgucuccccauggcgcgcugacgucuacuucaacaaaacaacuggcagcuacgaaauacugggccucaaauacgcggaccuccaauucgaaaaaggcaccggcacauacagaaucuccgaagagaaauauaacgacauaaagaagaaagagggagucgacuccgacagcgaguucaaauucacccucuacaaaaacgaccuauuacuuaucaaagacaccgagaccaaagaacagagacuguucagguuucucuccagauccaugcccaacaagaaacacuacguugaacuaaaacccuacagcaaagacaaauucgagaaaaacgaaucgcugauagaaauucuaggcagcgccgacaaauccggacgguguaucaaaggacucgccaaguccaaccuuucaaucuucaaagucagaacagacguacucggaaaccaacacaucaucaagaacgaaggcgacaagcccaagcuagauuucuga

SEQ ID NO: 6317 - RNA, 3408 nt, Artificial Sequence
  Cas9 variant
augggcgucauauuccuauacgagaacaucguaaaaccauucccaagcagauacgacaaggcuauaaugaaacgucuaaaggggcgccaaaccaugggguacauccugucccuagauauaggcauagccucauguggcuacucaguccuagaaacagacgcccucggaguccccuacaagaucaaaacacuaaacagcauuaucuucacacgcgccgaaaaccccaaaaccggagcaucacuagcagaaccacgaaggaaauaucgcggcgcccgccgucggaaacgacgaacuuccuuccgaaagcacagaacgcgacaacuauucaucacaagcggccuccucuccaaacaagacauagcuagauaccuaaaccagcaagaaccccacgaugacauaugggaacuccgagucaaaggccuagacgaaccacucacgaaccugcaacuguuccaaguccucuacuacuucgugacacaccgaggguucaaauccaaccgaaaagccgaacucaaggacaaagacauagggcccguccugaacuccaucaacgcguucaaggaggaaaugcaaucacacgacuaccgcaccaucggagagcuauacgccaaugacccacgauuucgcgaccgaaaacacaacaaagacuacaccaacggauuccuaggcaccauacagcguuccuggcuggucgacgaaaucaaaaugcuccugaccaaccaacagucauucggcaacacccagcugacauccgaguucaucgaacuauaccucaacauauucaccucccaacggaacuucgacgacggccccgcaucaggacccuacagcggcgaccucauagacaaaauggucgggccagauacguucaaccggucacgcaaacgggcaccccgagccacauacacauuccaguauuucagcuuucuguccaaauuaaacagucuccggauugccccaaguauuuccgcaccuuucgaaacccuuacagucgaccaacgcgcucucauaacuaagaggcucuggggacccgaugucaaaagcgcagaccucaaauucaaacagaucaggaugguacucucacuuccugagacagcccgcuucaaccucguuaacuacggcaacacgccagagaaagcgcucgaaauagaggacaaaaccaccuucaucucgaucaaaccccuuagagaaauagaaaaagcccucacaggaaccacccuccccgucagccacgaccaacuagacgccaucgccaggauccugacagucuacaaaagugacuccaaucgaaagacagcuuuccacaaccaaacagugcugucagacgaaguuaucgaacaacuucugccgcucaauuuuuccaaauucggccaccuauccgucgagacaaugcaagagaucauccccuaucuagaacaaggcaugguuuacucggaugcagcaacggccgcaggguacgacuuccggaauaaucaaaucgacauggaauacauucgcgauaacguaacaaacccggucguacgcagggcaguuucagucgcgaacaagcucguaaaagcugucguacgccgauacggaaaaccggacucaauacacauagagcuagcccgagauuuaucccagaacuuccaggaacgucgccaagacgaagucaggcaacagaagaacgcccgggacaacgagaaaauagccaagcgccuagaagaacugggcauaccugucaacggagucaacaucacgaagaugaaguuauacgacgaacaacacggcauugaccuauacgaccuuucgaccaacgcauccauggccguaaccgacaucuucagcgacgacagguacgaaaucgaccacaucaucccauacuccgugaguuucgacgacaguuacacuaacaaaguucucguauccgccaaagcaaaccgagaaaagagagaccguauuccaauggagguguucgguaacgacagcgaacgacggagacaauucgaaaaccgcgucaacacaaacaucacaaaccuaagaaagaaacgcaaccuacugaaagaaaccuucucagaugaagacaaggccaaguggaaaagccgaaacauaaacgacacccgcuaccucaaccgaauccuaaugaacuaccucagccaaaacgucgaguucaccgacgugcugucagacgccaaacacguaaucgcccugaacggagccgucacagccaagauacgcucacgcuggggaaucacaaaagucagagcagccggggaccuccaccacgcuguagacgccguaguuauaggcugcgucaccgacgcccucauccaagccgucacccgcuacgcaaaguaccaagagcgccgcgacaauaaagccgcagcagaacaagaccuagccgaaaacaacccagaagaacuggaugcuaaacaauuccgaaaagucuucaaugacuacccccuccccuggcccgaguucagagaagaacuaaugggacgcguaucaucugacccaagucaaauuauggccggacgucaguggucccacuauacugccgaagaaaucuccgagcucaaacaaccguucguaguccggguaccaaaccacagaaucgucggcccagccacccuagacacgguauacggccaacccaacccagaugacgggcucaucacacagcgaguccgaauaacggaccuaaagccacagaaaaacaaggacggggaagacauuaucaaggcgggcgcaaacgucuacgaacuagccgccgauggcggcaacaaacucguauacgaaagcauacuggaugcgcuccaagucgcgggcggagacgggaagaaagccuucccuacaggccgacuucuaguacguucccccauacaagacaucccggucgagcgaguacgggucaccucaaaagcaacgcuagucguaccagucggacccaaaucagucgccgcaaacggauccauggugagaauagacguauacaaaacacccaagaaauacguauuugucccaauauauguccgagacaccgucaaagcagaacuccccgaccgcgcagucgcaccagucaaaccuuacucacaaugguaccaacuacaaccaaaagaccaauuccucuucagccuuuucgcgaacgaucugauacgguucaagcacccaagaggcgucuccaccaaggagauccucaccgacggcagccaagaaaaaggcaagagaacagacguagucggcuacuuuaccggagccgacaucgcaacagcaagcaucgccaucgaagggccagacaggucuuucucagcccgcggaaucggcuucgcuucccucaaaaaugucgaaaaacuaaccguaaauuacuucggcgaacuccacuccguacacgagacacaaccaaugcaauuccgcggccaacgaggauga

SEQ ID NO: 6318 - RNA, 3411 nt, Artificial Sequence
  Cas9 variant
augaacggucuagugcucggccuagacauuggcaucgccuccguagggguaggcauccucgaaaaagauaccggaaagauaauccacgcauccucccgacuauuccccgcagcaaccgcugacaacaacguagaaagacgcagcaaccgacagggccggaggcucaaccgccgaaagaaacacagaucggucagacuccaggaccucuucgaaucauacgggcuguuaacggacuucucaaagcuaagcauuaaccugaaccccuaccaacuacgaguacagggaauggagaaccaauuaacaaacgaggaacucuuuauugcccugaaaaacaucgugaagcgacgcggaaucagcuaccuagacgacgccucagaagacggcggcaccgucucgagugacuacggcaaagcggucgaagagaaccgaagacuccuaacggagaaaacgccagggcaaauacagcuggagcgauucgaaaaguauggacaacuacggggagacuucacaguagaagagaacggcgagaagagacgguugauaaacgucuucuccaccuccgcguauaggaaagaagccgaacgcauucugcggaaacaacaagaguucaauaacaagaucacggacgaguucauagaagauuaccucaccauacuaacaggcaaaagaaaguacuaccacgggcccgggaacgaaaaaucucggaccgacuacgggagauucagaacggacggcacgacacuggacaacaucuucggcaucuuaauaggcaaaugcacauucuacccagaagaauaccgagccaguaaagcuagcuacacggcccaagaguucaaccuacucaacgaccuaaacaaccucacaguacccacggaaaccaagaaacuauccgaagaacagaagaaaacaauaaucgaauacgcaaaaagcgccaaaacccuaggugcaagcacacuccucaaauacaucgcgaagaugaucgacgccucggucgaccaaauacgcggcuaucgcgucgacgucaacaacaaacccgaaaugcacaccuucgagguauaccggaaaaugcagucacuagaaaccaucaaaguagaagaacucccgcgaaagguacuggaugaacuagcacacauacuuacacuaaacaccgaacgugaaggaaucgaggaagccaucaauaguaaacucaaagacaccuucaacagagaccagguccuggaacugguccaauuccgcaagaacaacaguucccucuucuccaaaggauggcacaacuucagccucaagcucaugauggaacugauccccgaacuauacgagaccagcgaagaacagaugaccauccuaacacgccuuggaaaacaacggagcaaggaaaccagcaaacgcaccaaauauaucgacgaaaaagaacucaccgaagaaaucuacaaccccgucguagcgaaaucagugcgacaagccaucaagaucaucaacgaggccaccaaaaaguacgggaucuuugacaacaucguaauagaaauggcucgcgaaaacaaugaggaagacgccaagaaaaacuacaucaaacaacagaaagcaaaccaggacgagaaaaacgcagcaauggaaaaggcagccuuccaauauaacggaaagaaagaacucccagacaauauauuccacgggcacauggaacuagcgacaaaaauaagacucuggcaccaacaaggggagaagugucucuauacaggcaagaacauacaaaucucagaccugauacacaaccaguacaaauaugaaaucgaccacauacugcccuuaucccuguccuucgacgacagccucagcaacaaaguacuggugcuagccaccgcaaaccaggaaaaaggacagcgcacucccuuccaagcgcucgauagcauggacgacgccuggucauaccgcgaguucaaguccuacgugaaagaguccaagcuacuuggcaauaagaagaaagacuaucugcuaacugaagaagacaucagcaaaaucgaaguaaaacagaaauucaucgagaaaaaccucguagacacccgguacuccucccgcguaguucuaaacgcccuccaagacuuuuauaagaaacaccaauucgacaccacaauuagcguaguccggggccaguuuacgucucaacucagacgcaaauggaaacucgaaaagagccgcgacacauaccaccaccacgcgguagacgcacuaauaaucgccgccagcucccaacugcgucuguggaagaaacacaacaauccccuaaucagcuacaaggacggccaauucguagauucagaaaccggcgaaaucguaagccuguccaacgaggaauacaaagagcucgucuuuaaggcaccuuacgaccacuucguugacacgcuaagauccaaaaaguucgaagacucaauccuuuucagcuaccagguagacagcaaauacaaccgcaaaaucagcgaugcgacaaucuacgcuacccggaaggcgaaacuagauaaggacaagaaagaguacacauacacacugggcaaaauaaaagacaucuacgcccuagggaccaaaacacccucgaaaacaggcuucuacaaauuccucgaccucuacaaaaccgacaaaagccaguuccugauguaccagaaggaccggaaaacaugggacgagguaauagagaaaaucaucgaacaauaccgcccauucaaagaauacgacaaaaacggcaaagaaguagacuucaacccauuugaaaaauaccgaaucgaaaacggcccgauccguaaauacucuagaaaaggaaacggcagcguaaucaagagcaugaaauacuacgauaaccuccuagggaaauucgucgacaucacccccucggaaagcaaaaacccaguagcacuccuaucacucaacccguggcgaacagacguauacuacaacccagaaacccgaaaauacgaauuucuaggacuaaaauacgccgacuugugcuucgggaagggcgguagcuacggcauaucagaaguaaaguacaacaagauccgggagaaagagggcauugggaaagaauccgaguucaaauucacccuauacaaaaacgaccuaaucuuaaucaaggacaccgaaaccaacugccaacaguucuuccgcuucugguccagaacgggcaaagacaacccaaaauccuucgaaaaacacaaaaucgaacuaaaaccguacgaaaaagccaaauucgaaaagggggaggaacucgagguacugggcaaggugccaccaagcagcaaccaauuccagaagaacaugcaaauagaaaaccucucaaucuacaaagugaaaacagacguucuagggaacaaacacuucauaaagaaagagggggacgagccaaaacuaaaauuuaaaaaguga

SEQ ID NO: 6319 - RNA, 3411 nt, Artificial Sequence
  Cas9 variant
augaacgggcuagucuuaggacuggacaucggaauagccuccgucggcgucgggauccucaagaaagacaccggggagauuauccacaccaacagccgacuauucucagccgcuaccgccgacuccaacauagaaaggagacgucaucggggagggaaaaggcucaccagacggaagaaacaccgcagcauccguuuacacgaccuuuucgaggauagcgggcuccucaccgacuucucgaaaguaagcauaaacuugaacccguaucaguuacgcguacagggucuagacaaccagcuaacuaaugaggaacuauucaucgcacucaaaaacaucgugaaacgccgaggaauauccuaccuagacgacgcauccgaagacgggggcaccguaagcuccgacuauggcaaagcggucgaagaaaaccgcaaacuccuagccgagcagacaccaggacagauacagcuagaccgcuucgaaaaguauggccaaguccgcggcgauuucacaguuguagagaacggcgaaaaacgaagacuaauaaacguguuuacaacauccgcuuacucuaaagaagccgaacgcauccugcgaaaacaacaagaguucaacaagaaaauaaccgacgaguucauagaaaauuaccuaaccauccucaccggaaaacgcaaauacuaccacggccccgggaacgaaaaaucacgaaccgacuacggccgcuauacgaccaagaaagacccagaggggaaauacaucacccuagacaacaucuuuggcauacugaucggaaaaugcacguucuauccggacgaauaccgggcgucuaaagccucauacacagcacaagaguucaacuuacuuaacgaccuaaacaaccucaccguccccacagaaaccaagaaacugagcgaagaacaaaagaaaaccauaaucaaauacgccaaaacugcaaaaacacugggcgccagcacacugcucaaauacaucgcaaaacucauuggggcaucagucgaccaaauacacggauaccgcaucgaccccaacaagaaaccugaaaugcacaccuucgaaaccuacagaaaaaugcagucccuagaaacaaucagcguagaagaaauaccacgcaaaguacuagacgagcucgcccacauacuuacccucaacaccgaaagagaaggaaucgaagaagcaauaaacgccacccucaaagauaccuucucccaagaccaaguacuggagcuaguucaauuucgcaaaaacaacaguagccuauucagcaaaggcuggcacaacuucucucugaaacuuaugauggaacugauccccgaacuguacgaaaccucggaagaacaaaugacuauccucacucgccuaggaaaacagaaaagcaaagaaacguccaaacgcaccaaauacaucgacgaaaaagaguuaacagaggaaauuuacaacccaguaguagcgaaaucgguccgacaagccaucaagauuaucaacgaagcgaccaaaaaguacgguauauucgacaacaucguuauagaaauggcacgcgaaaacaacgaggaagacgccaagaaaggauacaacgaacgccaaaaagcaaaccuagacgaaaagaaaucggcaauggagaaagcagccuuccaauacaacggcaagaaagagcuaccagacaacguuuuccacgggcacaaagagcuggccaccaagauccgucucuggcaccaacaaggggagaaaugccuauacacggggaagaacauccccaucagugaucucauacaaaaccaauauaaauacgagaucgaccacauacucccccucagccugagcuucgacgacucacuauccaacaagguucugguccuugcaacggccaaccaagaaaaaggccagagaacccccuuccaagccuuagauuccauggacgacgcauggagcuaccgagaguucaaguccuaugucaaagaccuaaagcuacucucaaacaagaagaaggacuaccuacugaccgaggaggacauaucaaagauugaggucaaacagaaguucaucgaacgcaaccuggucgauaccagauacagcucgcgcgucguacucaacgcccuccaagacuucuacaaagaacaccaauuugacaccaccaucuccgucguccggggccaauucacgucacaacucagacgcaaguggggccucgaaaaaucgcgcgaaaccuaccaccaccacgcaguagacgcccuaaucaucgcagccucaucacaacuacgucucuggaagaaacaaaacaacccccuaaucaguuacaaagaaggucaauucguagaccaagagacuggggaaaucauuagccuaagugacgacgaauacaaagaacuggucuucaaagcaccguacgaccacuucguggacacacuaaaauccaagaaguuugaggacagcauccucuucuccuaccaagucgacuccaaauacaaccgaaaaauauccgacgcgacuauauacgccacuagaaaggcgaaacuagacaaagaaaagaaggaauacacguacacccucgggaagauaaaagacauauacgcauuggggucagagaaacucaagacaggauucuacaaauuucuacaccucuacaagaaagacaaaagccaguuccucauguaccagaaagacagaaaaaccugggacgaagucauagagaaaauccuggaacaguaccguccauuuaaagaaaaagacaaaaacggaaaagaaguagacuucaacccuuucgaaaaauaccggaucgaaaacggccccauccacaaauacucccggaaaggaaacggcccggugauaaaaucacuaaaguauuacgacaaaaauauaccggaauccuucaucaacaucacacccuccaacuccaaaaauaaagucauccuaagacagcucaacccguggcgaacagacgucuacuucaaccaccaaacagaaaaguacgagcuguuaggccucaaauacgcccaucugcaauucgagaagaaaaccggcaacuauagcauaaccaucgacaaauacaacgagaucaaggaaaaagagggagucagcgaacaaagcgaguuuaaauuuacucugcacaagaacgaccuacuccucauaaaagacacagagaccaaggagcaacaacuguuucgcuuccucagcagaaccaagcccaacgucaagcacuacgucgagcucaaacccuacagcagagacgaguucgaaaagaacgaacgccucauagaaauacuaggcagcgucgacaaaagcgggagauucguaaaaggguugggcaaaaguaaccuauccauauacaagguccgcacagacguacucgguaaccaacacaucauaaagaaagaaggcgaggaaccuaaacuuaaauucuga

SEQ ID NO: 6320 - RNA, 3411 nt, Artificial Sequence
  Cas9 variant
augaacggacucgucuuaggccucgauaucggcaucgccagcgucggagugggcauccuggagaaagacacgggcaaaauaauccacgccucaucccgccuauuccccgccgccaccgcggacaacaacgucgaaaggcgcagcaacaggcaggggcgccgacugaaccggcgaaagaagcaccgcagcguccgacuccaggaccuguucgagggguacgggcugcugacagacuucagcaaaguauccaugaacuuaaaccccuaccagcucagggugcagggcauggaaaaucaacugaccaacgaagaauuauuugucgcacuuaaaaacaucgucaagcgaaggggaauaucauaccuugacgaugccagcgaggauggcggcacagucuccagcgacuacggaaaagccgucgaagaaaaccgcaaacuacuggccgagaaaacacccggacagauacaacuggaacgguucgaaaaguacggacaacucaggggagacuucaccguagaagaaaacggggaaaaacaccgacuaauaaacgucuucagcaccagcgcauaccggaaggaagcagaacguauccucagaaagcaacaagaguucaauagcaaaaucacggacgaauuuauagaggauuacuugauaauccucacggguaagcgcaaguacuaccacgggcccggcaaugagaaaagccgcacagacuacggccgauuccgaaccgacggcacaacccuggacaacauauucgggauccugauaggaaagugcacauucuacaccgaagaauauagagcgaguaaggccucguacacggcgcaagaguucaaucugcucaacgaccuaaacaaccuuacaguaccaacagaaaccaaaaagcuauccgaagaacaaaagaaacuuaucaucgaauaugccaaaagcgccaaaacccuuggcgcaucaacccuacugaaauacaucgcgaaaaugaucgacgccagcguugaucaaauuagaggcuaucgggucgaugucaacaacaagccagagaugcacaccuucgagguauacaggaagaugcagagccucgagaccauuaaaguugaggaacuuccccgaaaaguacucgacgagcuagcccauauacugacgcuaaacaccgaacgugaggggaucgaagaggcaauaaacucuaaacucaaagacaucuuuaaccgagaccaaguacucgaacucguccaauuccgcaaaaacaacagcagccucuucucuaaagguuggcauaacuucuccaucaaauugaugauggaacuaaucccagagcuguacgagaccuccgaagaacaaaugaccaucuuaacccgacucggaaagcaacgaucaaaggagacgagcaaacgaacaaaauacaucgaugagaaggagcugacagaggaaauuuacaacccgguaguagcgaaaaguguacggcaagcgaucaaaauaaucaacgaggcaacgaaaaaguacggaaucuucgacaacauagugauagaaauggcccgagaaaacaacgaggaagacgcaaagaaagacuauaucaaacgacagaaagcaaaccaagacgaaaagaacgcugcgauggaaaaagcagcauuccaauacaacggcaagaaagagcugccagacaacauuuuccacggucauaaagaacugacaaccaaaauccgccuauggcaccaacagggagagaagugucuauacacaggcaagaacauaccaaucagcgaccucauacacaaccaauacaaauacgagaucgaccacauccuccccuuaagccucagcuucgacgacucauuauccaacaagguuuuaguacuagccaccgcgaaccaggaaaagggacagcggacgcccuuccaggcacuagacagcauggaugacgccuggagcuaccgagaguucaaauccuacguaaaggacagcaaacugcucagcaacaaaaagaaagacuaccugcucacugaagaagacauaucaaaaauagaagucaaacaaaaauucaucgaacggaaccuaguagacacccgauacucuucccgcguggucuugaacgcccuccaggacuucuacaaaucccaccaacuggacacgacaauaagcguagucagaggacaauucaccagccagcuacgacgaaaaugggggaucgagaagagucgcgagacuuaccaccaccacgccguagacgcccugaucauagccgccuccagccaacuccgacuauggaagaaacacuccaacccguugauagcauacaaagaagggcaauucgucgacagcgaaacgggagagauaguaucacuaagcgaugaggaauacaaagagcuugucuucaaagccccauacgaccacuucguagauacccugcgcuccaagaaauuugaggacuccauacuguucagcuaccagguagacucgaaauacaaccguaaaaucuccgacgccaccaucuacgccacgcggaaagcgaaacuagacaaagaaaagaaagaguacacauacacccuagguaaaaucaaagacaucuacgcccucggcaccaagacccccuccaaaaccggcuucuacaaauuccucgaccuauacaaaacggacaagagccaauuccucauguaccaaaaagacaggaagaccugggacgaagucaucgagaaaaucauagaacaguacagacccuucaaagaauacgacaaaaacggcaaagaaguagacuucaaccccuucgaaaaauacagaauaggcaacggcccaauacgcaaguauuccaagaaaggaaacggccccgagaucaaaagucugaaauacuacgacauccuccuuggaaaacacaagaacauaacccccgacggcagccgcaauacgguggcccuccucucccuaaauccauggagaacagacguguacuacaacuccgaaaccaaaaaguacgaguuccucggacuaaaauacgcagaccucugcuucgaggaagggggcgcauacgggaucucagaagugaaguacaagaaaauaagggaaaaagagggaaucggcaaaaacagcgaguucaaguucacgcuguacaaaaaugacuuaauccuuaucaaggacacagaaaccaauugccaacaguucuuccgcuucuggucccgcacaggaaaagacaacccuaagucauucgaaaaacacaaaaucgaguuaaaaccauacgaaaaggccaaguucgagaaaggcgaggaacucaaaguccugggcaaaguuccgcccucguccaaccaauuucagaaaaacaugcaaauagaaaaccucuccauauacaaaguaaaaacggacauccucggcaacaagcacuucaucaagaaagagggagacgaacccaaacugaaauucaagaaauga

SEQ ID NO: 6321 - RNA, 3420 nt, Artificial Sequence
  Cas9 variant
auguccgaccucguccucggacuagacaucgguaucggaucggugggcgucggaauccuaaacaaaguaacaggugagauaauacacaaaaacagccgcaucuucccggccgcucaagcagaaaacaaccuagaacgacgcacuaaccgccaagggcgacggcucacacguaggaagaaacacagacgcgucagacuaaaccaucuuuucgaagaguccggacuaaucaccgacuucacuaaggucagcauaaaucucaacccauaccaacuacgcgucaaaggucuaaccgccgagcucucaaacgaagaacuauucaucgcacucaaaaacauggugaaacaccgaggaauaucauaccuagaugacgccuccgacgacggcaacucgucagucggcgacuacgcccaaaucgucaaagaaaacucaaaacaacucgaaaccaagaccccaggccagauccaacucgaaagauaccaaaaauacggacaacuccgaggcgacuucacagucgaagaagacggacgaaaacacagacugaucaacgucuucccgacgagcgccuaucacgcagaagcgcuccgcauacuacaaacacaacaagaguuuaacccccagaucacugacgaguucauaaacucauaucuggaaauccucaccggcaaacgcaaauacuaucacggccccggcaacgaaaaaucccgaacugacuacgggaaauacaccacaaagaaagacgcacagggacaauacaucacccugaacaacaucuucggaauauugaucggcaaaugcaccuucuaccccgaagaauaccgcgcugcaaaggccagcuacacagcccaagaguucaaccuccuaaacgaccuuaauaaccucaccguaccaacagaaaccaaaaagcuaagcgaagaacaaaaauaccagaucauuaccuacgucaagaacgaaaaagccaugggaccggcuaaacucuucaaauacaucgccaaacuucucuccugugacguagccgacauaaaaggguacaggaucgacaagagcgacaaggccgagauccacaccuucgaagcauaccgaaaaaugaaaacccuagaaacauuggacguaaagaaaauggcgagagaggaacuggacaaacuugccuacguucuaacccucaacacggagcgcgagggaauacaggaagcccuagaccacgaguucgccgacgggacuuucagccaggaacaagucgacgagcuaguccaauuccgcaaggccaacucauccaucuucggcaagggauggcacuccuucucggucaaacucaugauggagcugauaccagaauuauacgccacauccgaggagcagaugacaaucuuaacacggcuaggcaaacagaaaacaaccaguucuaguaacaaaaccaaauauaucgacgaaaaacaacuaaccgaagaaaucuacaaccccgucguagcgaagucgguacgccaagccaucaagauaguuaacgccgccauuaagaaauacggugacuucgacaacaucguaauagaaauggccagggagacuaacgaagacgacgaaaagaaagccauccagaaaauucaaaaagccaacaaagccgaaaaagacgccgccaugcgcaaagccgcgaaccaauauaacggaaaagccgaacuaccacacucagucuuccacggacauaaacaacucgcuaccaaaauacgacuguggcaucaacaaggcgaacgaugccuauauacaggaaaaaccauauccauccacgaccuaaucaacaaccccaaccaauucgaaaucgaccacauccuaccacuuucgaucacuuucgacgacucccuagcgaacaagguccuagucuaugccacagcaaaccaagagaagggacaacgcacgccauaccaagcccucgacuccauggacgacgcguggucauuccgcgaauuaaaagcguucguacgcgaauccaaggcccucagcaauaagaaaaaggaauaccuccuaaccgaagaggacaucucaaaauucgacgugcgaaagaaauucaucgagcguaaccucguagacaccagauacgccuccagaguggugcucaacgcccuccaagaacacuuccgcacacauaaaauugacaccaaagucuccgucguccgcggccaauucaccucccaacuacggcgacacuggggaaucgagaaaacccgcgacaccuaccaccaucacgcagucgacgcccugauaaucgcagccuccagucagcuaaaccuauggaaaaagcagaagaacacccuagucucauauucggaagaucaacuccucgacaucgaaacaggggaacugaucucugacgacgaauacaaagaguccgucuucaaagccccuuaccagcacuucguagacacccuuaaaucaaaagaguucgaggacagcauacucuucucuuaccagguugacucaaaauucaaucgaaagaucucagacgccacuauauacgcaacgcgcaaagccaagcuagacaaggagaaaaaggaguacaccuacacguuaggcaaaaucaaggacauauacgcccucggcaccaaaacucccucaaaaaccggauucuacaaauuucuggaccuguauaagaaagacaaaagccaauuccuuauguaccagaaagaccgacgaacaugggacgaagugaucgagaaaauccucgaacaguaccgccccuucaaagaaaaagacaaaaacgguaaagaggucgacuucaacccguucgagaaauaccggaucgaaaacggcccgauccgaaaauacucaagaaaaggcaacggcccagaaauaaaaagccuuaaguacuacgacaacuugcuagggcgguucguggacaucacucccucagaaucuaagaacccgguagcccugcugucccuaaacccauggcgaacugacgucuauuacaacacagaaacccgcaaauacgaguuccuaggucucaaauacgccgaccucugcuucgaaaaaggcgggucauacggcaucagcaaagugaaauacaacaagaucagggagaaagaggguaucggcaaaaacuccgaguucaaauuuacccuauacaagaacgaccugauacucauuaaagauacggaaacaaaccgccagcagaucuucagauucuggucccgcacuggaaaggacaacccaaaguccuucgagaaacacaaacucgaacuuaaacccuacgagaagacacgcuucgaaaagggagaggaacucaaaguucuagggaaaguacccccauccucaaaccgccuacagaagaacaugcaaaucgagaaccugagcaucuacaaaguccgcaccgauguccucggcaaccaacacaucaucaaaaacgaaggggacaagccgaaguuagacuucuga

SEQ ID NO: 6322 - RNA, 3420 nt, Artificial Sequence
  Cas9 variant
augaacuacuacaacggauucaucauaaccgagaacgcaauggccagcaaacacgaaaacuuaggagcucuaaccuucggacuagacaucggcauagccuccgucggcugggcugucuuaggcgaaaaccgcauaaucgaccucggaguacggugcuucgacaaagcagaaaccgccaaagaaggagagagccucaaucuagccagacguacagcacgcuuacugagaagaagacuccggcgccgugccuggcgacugacaaaacuugcccgacugcucaaacgagagggacucauagccgacacuaacguguuccaaaagccauucaaccugaaagacgcaaacgaaaaaggccuaucuuucuggcaacugcgcguggaugcucuagacagaaaacuaagcgcagaggaaugggcccgagucaucuaccaccugugcaagcaccgcggauuccacuggaucucuagggcggaagaaaaggccgcggaaggggacagcaaaagcgagggaggaaaagucaaacaaggccucgccggcacaaagaaacugaugcaggaaaagaauuaccgcacggcagcagaaaugguccuaacagaguuccccgaagcccaacgcaacaaacaaggugacuacucaaaagcccucucacguauccugcuaggcgacgaaaugacgcaacuauucaagcaccagcgagagcuaggcaacccgcaugcgaccgagaaguuagaggcggcaauccucgggaacggagaccacaagagcggccuguucugggcccaaaaccccgcgcuggccgguaacgaccugcucaaaaugcuggggcacugcacauucgaaaaagcugaauacagaguccccaaagcuagcuucacagccgaaaggcacgucuggcugacacggcuaaacaaccugcgaaucgucguggacggcacaacacguccccucaacgaggccgaacgccaccuagcccugcuaaugcccuaccaacaggcaggagaucuaaccuacaaacaguuacgcacagcgcucacaaaagccggauaccuaccagaaucauucagauacacaggccuagcauacgccagcggccaaaaagcagacgagaaggccaaagacccagaaucagcgccgcucgucaaacugccggcauggcacgaacuucgaaaaaccuuggaaaagaaagaacucgccucagaguggcagaaaauaagcucggacgcgcucgacggaaaaccccaacugcucgaccaaauugcuuggguacuuagcgucuacaaggacgacaccgaggucgaagcggaacucugcaaauuaaaccuacccaacgcggagaaaaugauagacgcacuacuagacauccgcuucgacaaguucucaaaucucagccuaaaagcacuccgccaaaucguaccccucauggaacaaggacaacgauacgacgaagcaguagcaaacauaccugaauacggucaccacucacaacuccacgaagucggcgcgggcgaacauaaguauuuaccacccuucuacaaagagcgcgacaaaaccgguagaaugguauucaaugacgacauggacauaccccgcaacccaguaguacuaagggcccuaaaccaagcgaggaaagucguaaacgcccucauuaaagaauacggaucaccacacgaaguacacauagaaauggcuagagaccuuucaaggccccucgacgagagacgcgacguggaaaaacuucaaaaagaauuuagagaucguaacgaaaaagacaaggcccuauucgcccaggauuucaacaucgucggugccgucaaaggaaaagaguucgagaaauaccaacuguaccgggagcaacagggcaagugcgcauauucaaucgagccaauggacauccauaggcuuuucgaacaaggauacgucgaaauagaccacgcguugccguauucaagauccuucgacgacucaaagaauaacagaguccucguccuagccaaagaaaacagagacaaagguaacagaaccccauucgaauaccucggaggcaaagauaacucagagcgauggcgccaauucgucgccuucguugaaggcaacaaguccuaccgcuuggcgaaacgaagucgccuacuacggaaggacuucgggaaagacgaagcuaaaggauuccgcgaacgcaaccucaacgauacccgcuacaucugccgauucuuuaaaaacuacguagaacaauaccuccaacuccacgaagacuccgacgccaagcgcugcgucguacuaagcggccaaaugaccagcuuccuacgagcgagguggggcuuaguaaaaguacgaggcgacagugaucgccaccacgcccucgacggcgccaucgucgcagccugcagccacagcauggucaaacgucucagcgacuacaguagaagaaaagagcuagaacaagugcgcgccggcuucguggacgucgacaccggcgaaaucgucaauccagccauguuccaacaaguucaagaacacuuccccaacccguggccacacuuucgagaugaggugaaacucagacugaauguagacgacccagcacuccugcacuccgaaaugaaccgcuucggaaccuacucccccgaagcucuaaaagcccuccgcccccucuucaucucacgagcuccgcaaagacguaacagcggagccgcgcacaaagacacaaucuacgcgcagccagagagacuugucgcccaaggcggcguaacccagaaaguccccuuaaccucccucacacuaaaagaccuagacaaacuaauagacccacacagaaacgaaaaacuuuacagugcaauccguauucgacucgagcaacacggaggcaagggggacaaagccuucccggccagcaacccacuaaggaaacccgacagcgaaggcaacccgacagguccaauaguaagaggcgugaccauggucaucgacaaauugucaggcauccccauucgaggagggauagcaaagaacgauagcauggucagagucgauguauucacgaaagccgggaaauuccaccucgucccaguguacguccaccacgccgucgcgaaaguacuacccaaccgcgccguaguggcauacaaagacgaaacagaauggacacuuaucgacgacggauucgacuuuugcuucucaauguacccaaacgaccuccugcggaucaaacuacgcaaugcaucgcaucuaggauacuacgccucgugcaaccgaagcacaggggcgauaaaccuguggucgcacgaccgcaaccaacaggucggcaaagaugggaugauugagucaauaggcgucaaaaccgccuuaaacguugaaaaacucaacaucgacguacuaggaaaccgcuacccugcaccaccagaaaaacggcgcgaccucgcauga

SEQ ID NO: 6323 - RNA, 3423 nt, Artificial Sequence
  Cas9 variant
augaaaaauaugacgaaagucaacgucggccuugauguggguaucucauccgcaggcuggaguguaaucaacgccgaaaccaaccaaauacucgaauccggagugcgccucuucaguggcucugacgcggacgaaaacgugaaucggcggaaccaacggcaaggccgaagacuguuccgacgccgcaagcuccgcauacaagaagcgaagaaauaccucgaaaacguguuccagcuuaaagauauagaacccaaagacgaauggaaccccuacgaaauacguguccgagcccucaacgagaaagugagcaaagaagaacucucaauugcacugcuuaacaucgucaagcaccgaggcauaagcuacgaacuggaagacguaaccgacgaagaagguacaaacacacagagcuuccaaucuggccuggacuacaaucggcggcugcuaaagaccaaaacuguuggagaaauccaauacgaccgauugcaaaaguacggccaaguacgaggacagauccaaaccgaggacggacuacuaauaaacaucuuucccacaaagaacuacgucgaagaagucgaaaggauccuugaaacccaaaagaaauaccacccagagaucgacgacguauuuauagagaaaaucaucucauucguaaccagaaaacgcgaauacuucguagguccgggcaacgaaaagagccgcacggacuacggaauauaccgagaaaacggcgaaacgcucgacaacuuguuugagauccucaucggcaaagacaaauucuaccccgaagaauaccgugccgcgggcagcuccuauaccgcccagaucuucaaccugcucaacgaccuuaacaaccucaggauccccacgacugaagaucaccaccugaccaaagcacagaaagaggaaaucaucaccgagcugaaaaacacaucccgccugagcgggggaauguugaaacucaucagcaaaguuaccaaagcccccaaagaagagauuuccggguaccgcaaggacgagaaggacaaaccggaccuucacagccuggcauacuacaggaaacagaaaaacaugcucgagaaagaagguauccaaauagcagacuucucagaagaacuccuagacgaacuagccaccaugaugacacuaaauaccgagcccggagagauccggaagcaacuuaacaaaaucacgaaccaguacgacauacugacgccggaggugauagaaguccuagucaagaaccacaccgccuucguggcuaccagcaaccacaaauggcaucgauucagccuaaagcugaugaaagaguucaucccagaacuccuagaaacguccaaggaacagucgaccauacucugcgaacgaggauucauccaaaaccgggccagcuaccuggacgagaaccaccacuucaacuacgcugaacugagagagaaccuguacaacccaguaguccgcaaguccacgugcgaaaugcucaaaguauucaccgccauccaagaaaaauaccccaacauacaaaacguaauaguagaacucccacgagaaaccaacgaagaugagcaaaagcguaaaauaaagaaaauaaacgacaauaacgccaagcguaaaaaggaaauacuaaaagaagcacaagcacaaagcgggcucagcgaggaagcacuggaagaaaaacuccucaagaccaaaggccucuaccuaaaacugaugcugugguacgagcaggaaggcaaaugcgucuauagcggacaagagaucccccuaucagaccuacuacaaaacaaagggggcuacgaggucgaucacaucauucccauauccauauccuucgacgaccgucucugcaacaagguucugguccgacaacagcucaauagccagaaaagcaaucaaaccccauucgaauacaugaccacacacaccgacggacaccuauccuuccacgaauugaaagaacuggucggcaagaacaaaagauucuccaaagaaaaacgagaacuccuacucgccgaaauauacagcaacgacaucgaaaccaggaaacgcuucaucaacagaaaucuaguggauacauccuacaccgcacgcaucguacuaaacgcgcuccagcaguauaaaaaggaaaaccaacuauccaugaacguaagcgucgugagaggcgcgaugacgaacauccuccgcaagaaaguaaaacuggacaaaacacgagagacguuucaucaccaugcaauagacgcaagccucauggccgucauaccaaauauagaguuuuucaaagaacgcaaagaauggcuaccuaaguccgcgaaugaagaagucgucgaagucgaggucucggaggaggaaacgaugccggaaaaggaguucaagguaaaaaugcgucucccagaaucauucauccaagauguccagauccuccagcgaaacagcuucgcaaaggaagaaguauccggcccccagacacgagaacgcaaccugaaaaucaaguucucccaccaaguagaccagaaaaugaaccgaaaagucgcagacgacacaauuuacggaacacgccaagcacaacugggcaaagacaagaaagaagagaccuacguaaucggcaaaauaaaggauauuuacaacuacgaugaauacguacgcuucaagaaacgauacgacaaaaacaaagaaucauuccucauguaccaccacgacccccaaaccuucgaaaaauuggaagaaauacucgcccaauaccccgaguacauagaggacgaaaaaggcaaaaagaagaaaguaucacccuucgcucuuuaccgcgaagaaaacggacccguaaccaaauacgcaaagaaaaacaacggacccgucaucaaacaacugaaauacuacgacuccaaacucaaucgaaaaaucgacauaucccauaaauacucaaccaaaaacagacaggucguacuccaaucccuaaaaccguacagaacagacgucuaccggaaccaagacaccggagaauacacccucgucggcauagaccaaaaugacggcaaauucgucaacggacacuacggcauacccaaaagccgauacgaagaaaucaaagcaaauaauaaacucagcgaacacgaugaguucgucuuuucacuauacaaaaacagcaugguuaaagugauagacgaaaacggagaauccaucgucgugagauaccucuccaggucaaugcccaaccggaaaaacaaugcagaaauaaaacccguggagaaauaucaauucgaagauggcgaagugguaccagucuacggcaaaugcaggaaacagaugcagacaguauucgugaagaaaggcuggacacuacuaaaaggcaauacggacauccucggcaacacauacuucgucgaaaaagaaagcgaaaacccgaagaaaaugaucgacgacaaauga

SEQ ID NO: 6324 - RNA, 3423 nt, Artificial Sequence
  Cas9 variant
augcgcgagaacggaucagacgaacgccgacgcaacauggacgaaaagauggacuaccggaucgggcuagauauagggaucgcaagcguaggcugggcgguacuacaaaacaacuccgacgacgaacccguccggaucguagaccucgggguccggaucuucgacacagcugagauaccgaaaacaggagagucccuggccggacccagacgcgccgccagaacgacccggcgccgccuaagacggcgcaaacaucgccucgaccgcauaaaauggcuauucgagaaccaaggccucaucaacauagacgacuuucugaaacgguacaacauggcaggcuugccagacguguaucaacuacgauacgaagcacuagacagaaagcugacggacgaagaacuggcgcagguacuccuacacauagcaaaacaccgaggauucaggagcacucgcaaggcagagaccgcagccaaagagaacggagccguccuaaaagcaacagacgaaaaccagaagcgcaugcaagagaaaggauauaggacagucggcgagaugaucuaccuagaugaagccuuccgaaccggaugcagcuggagugagaaaggauacauacucacgccuagaaacaaagcggaaaacuaucaacacacaaugcugcgagccaugcucguagaggaggucaaggaaaucuucuccucacaacgacgacuaggaaacgaaaaagccacggaggagcuagaagaaaaauaucucgaaaucaugaccucucagaggagcuucgaccucggaccgggaaugcagccagacggcaaaccauccccauaugcaauggaaggauucuccgaccgagugggaaagugcacauuccuaggcgaccagggagaacuuagaggagccaaaggcacauacacugcagaauacuucguagcgcugcagaaaauaaaccacacgaagcucgucaaccaagacggggaaaccagaaacuucaccgaagaggagagacgcgcacuaacacuauugcucuuuacccaaaaggaaguaaaauacgccgcaguccgcaaaaagcugggucuccccgaagacauccucuucuacaaccuaaacuacaaaaaggcagcaacaaaggaggaacaacaaaaagaaaaccaaaacaccgaaaaagcaaaguucaucggaaugcccuacuaccacgacuacaagaaaugccuggaggaaagagugaaauaccuaacagagaacgagguuagagaccucuucgaugagaucggaaugauacucacgugcuacaaaaacgaugacucgcgcacggaacgacuagccaaguuaggucuaguccccaucgaaauggaaggacuacucgccuacacaccaacaaaauuccaacaccucucaaugaaagcaaugcgaaacauaauccccuuccucgagaaaggcaugaccuacgacaaggcgugcgaagaagccggcuacgacuucaaagcagacucaaaagggaccaagcaaaaacuccuaaccggggaaaacguuaaccaaacaauaaacgaaauaacaaacccagugguaaaaagaagcguaagucaaacgguaaagguaauaaacgccaucauaagaaccuacgggucaccgcaagcaauaaacaucgaauuagcucgcgagaugucgaagacauucgaagagaggcgcaagaucaagggcgauauggaaaaacgacaaaagaacaacgaagaugugaagaagcaaauccaggagcuagggaaacuaucccccacaggccaggacauccuaaaauaccggcuauggcaagaacaacaagggauaugcauguacucaggcaagaccauacccuuagaagaacuauucaaacccggauacgacaucgaccacauccuaccuuacagcauaacauucgaugacuccuuccggaacaagguccucgucaccagccaagaaaacagacaaaaaggcaaccgcaccccuuaugaauacaugggcaacgacgaacaacgguggaacgaguucgaaacgagagucaagacaaccauccgcgacuacaagaaacaacaaaaacugcuaaagaaacacuucagcgaagaggagaggagcgaguucaaagaacgcaaccuaaccgacaccaaauacauaacgacagucaucuacaacaugauaagacaaaacuuggagauggcuccccuaaacagaccagaaaagaagaaacaaguacgcgccguaaacggggccauaacggcauaccuccgcaaacguugggggcuaccacagaaaaaccgcgagaccgacacacaccacgcaauggacgcggucgugaucgcgugcugcacagacgggaugauccagaaaaucagcagguacacaaaaguacgagaacgcugcuacagcaaaggcacagaguucguagacgccgaaacaggagaaaucuuccguccagaagacuacucaagggccgaaugggacgaaaucuucggaguccacaucccaaaaccaugggaaacguucagagcagagcuggacgucagaaugggcgacgacccaaaaggcuuccuggacacacacagcgacguggcucucgaacuagacuacccggaauacaucuacgaaaaccucaggccaauauuugucagccgaaugcccaaccauaaggugacgggcgcagcccaugcagacacuauaagaucaccccgccacuucaaagacgagggcauaguccuaacaaaaaccgcccuaaccgaccucaagcucgacaaggauggagaaaucgacggguacuauaacccccaauccgaccugcuccucuacgaggcgcucaagaagcaacuccugcucuacggaaacgaugcuaaaaaggcauuugcacaagacuuccacaaaccaaaagcagacggaacggaaggaccgguagugcgaaagguaaagauacaaaagaagcaaacaaugggcgucuucgucgacagcgguaacggaaucgcggaaaacggcggcaugguccgcaucgacguauuccggguaaacgggaaguacuacuucgucccgguuuacacggcugaugucgucaagaaaguucugccaaaccgggcgagcacggcacacaaaccguacggcgaauggaaagucauggaagacaaagacuuccucuucucacucuacucgcgagaccuaauccacauuaaaagcaagaaagacaucccaauaaaaaugguaaacggaggaauggaggggauaaaagaaacauacgccuauuacauaggcgccgauaucuccgcagcuaacauccaaggcaucgcacaugacucacgcuauaaauuucgaggacugggcauccaaagccucgacgugcuagaaaagugccagauagauguccucggacacgucagcguaguacgcagugagaaaagaaugggauucucauga

SEQ ID NO: 6325 - RNA, 3423 nt, Artificial Sequence
  Cas9 variant
augaaugggcuaguccucgggcucgauauagguauagcguccgucggaguugggauccucgagaaaaacagcgguaaaauaguccacgcgucgucccguaucuucccggccgcgacggcagacaacaacgucgaacgccgaaagaacagacaagcccggcggcucaaccgccguaaaaagcaucgcgggguccgguuccaagaccuauucgaagacuacggacuccucaccgacuucucaaaggucagcaucaaccuuaaccccuaccgacuccgcgucgauggccugaaccaacagcucacuaacgaagaguuauucauagcacucaaaaacauagucaaacgccgcggaaucagcuaccuagaugacgccucugaagacgggggcacgguaucgagcgacuacggaaaggccguggaggaaaaccgaaaacuccucgcggaaaagacacccgggcagauacaacuggaacgauucgaaaaauacggccaacuccgaggggacuuuaccgucguugaaaacggagaaaaaugccgucugauaaauguauuuagcaccuccgccuacaagaaagaggcugagcgaauacuucgcaaacagcaagacuucaacaaucaaaucacagacgaguucauagaagacuaccucaaaauccucaccggcaaacgaaaguacuaccacgggccaggcaaugaaaagagccgcaccgacuacggccgcuacacgacccacaaagauagcaagggugaguacgucacgcuagacaacauauucggcguacuaauaggaaaaugcacguuuuaccccaacgaguacagggcguccaaagccuccuacacagcccaggaguucaaccuacucaaugaccuaaacaaccuaacgguacccacagagaccaagaaacuuuccgaagaacagaagaaaacgauaaucgaauacgcgaaauccgccaaaacccugggagccagcacacuccuuaaauacaucgcaaaaaugaucgacacuucggucgaucaaauacgcggauaccggguagacguuaacaacaaacccgagauccacacauucgaaguauaccgaaaaaugcaaagccucgagaccauaagcgucggagaacucagccgcaacguacuagacgagcuagcacacauccuaacacucaacaccgaacgcgaggguauagaggaggccauaaacacaaagcugaaagacuccuucucccaggaccaaguccuggaacucguccaauucaggaaaaacaacagcucucucuucagcaaaggguggcacaacuuuagccuaaaacuaaugauggaacucauaccggaauuguacgaaaccucagaggagcagaugaccauacugacccggcuggguaagcagaaaagcaaagaaacgucaaaacgaacaaaauacauugaugagaaggagcuaacugaggaaaucuacaaccccgucgucgcuaaaucagucagacaagccaucaagauaaucaacgaggcaaccaagaagcacgguauauucgacaacauaguuauugagauggcccgagaaaacaacgaagaggaugcaaagaaagacuacaucaaacggcaaaaagccaaccaagacgagaaauacgcagccauggagaaagcugccuuccaauacaacggcaagaaagaacugccagacaauauauuucacgggcauaaagagcucgcaaccaaaaucaggcuauggcaucaacaaggagagaaaugccuguacacaggcaaguccauaccaauaucugaccucauccauaaccaauacaaauaugagauagaccacauccuuccccucagccugagcuucgacgauucacugagcaauaaaguccuaguacuggccacugccaaccaggaaaagggacagcgaacccccuuccaagcucucgacagcauggacgacgccugguccuaccgcgaguucaagagcuacguaaaagaaucaaagcuacuaggaaacaaaaagaaggaauaccuccucaccgaagaagacaucuccaaaauugaagucaagcagaaauucaucgaacguaaccucgucgacacccgcuauucaucucgcguugugcugaacgcacuccaagacuucuacaaaaaccacaacuucgauacaacaaucagcgugguccggggccaguuuacgagccaacuccgacguaaauggggccucgaaaagucccgcgaaacguaccaccaccacgcgguugacgcccugaucaucgccgcgucgucgcaacuucggcucuggaagaaacaaaacaauccgcucaucgcauacaaagagggccaauucguggacucgcaaaccggagaaaucaucucccucaccgacgacgaauacaaagaacucgucuucaaggccccauacgaccauuucguagacacacucuccucgaaaaccuucgaagacuccauccuauucuccuaccaagucgacagcaaguucaaccgcaaaauaagcgacgccaccaucuacgccacacgcaaagccaaacuggacaaggagaagaaagaguacacauacacgcuaggaaaaauaaaagacaucuacagccuaggaacuaaaacuccaucuaaaacgggauucuacaaauuccuagaccucuacaacaaagacaaaucccaauuccucauguuccagaaggaccgaaagacaugggacgaaguuaucgagaaaaucauggaacaauacagacccuuuaaggaauacgacaaggcaggaaagcuagucgauuucaaccccuucgaaaaguacaggcaagaaaacggccccauccgaaaguacaguaagaaggguaacgguccggaaauaaaaagccuaaaguacuacgauauacuccuaggcaaacacaaaaacauaacuccagaagggucccgaaauacugucgcccuacucucacucaacccauggcgcacugacguguacuacaacauggaaacaaagaaauacgaguuccuaggccugaaauacgccgaccuuccauucgaagaagggggagccuacggcaucucuaccgaaaccuacaacgaacuucgcgaaaaagaaggaaucggaaagaacucagaguucaaguucacccuauacaaaaacgaccugauccuaaucaaggacacagaaacaaacugccaacaauucuuccgcuucuggagccgcacaggcaaggacaaccccaaauccuucgaaaaacacaagaucgaacugaagcccuacgaaaaggccaaauucgagaaaggcgaagaacucgaaguucucggaaaagugcccccaucauccaaucaauuccagaaaaacaugcaaaucgaaaaccugucgaucuacaaagugaaaaccgacguccuagggaacaaacacuucauaaagaaagaaggagacaaaccuaaacucaaauucuga

SEQ ID NO: 6326 - RNA, 3423 nt, Artificial Sequence
  Cas9 variant
augaacggucuuguccucggccucgauauuggaaucgcaaguguaggggucggcauucucaagaaagacaucggcgaaauaauacacacgaacucccgccucuucagcgccgcaaccgcggacucgaacauagaacgacgcgggcacagaggcggcaaacgccucacgagaagaaagaaacacagauccauccggcuccacgaccuauucgaggauuucgggcuacucacagacuucuccaaaguaucaauaaaccugaaccccuaucagcuucgcguucagggccucgacaaccaacugacaaacgaggaacuauucauagcccucaaaaacaucguaaaaaggcgagggaucucauaccuagacgaugccagcgaagacggcggaaccgucagcagcgacuacggaaaagccguugaagaaaaccgcaaacuccucgccgagcaaacccccggccagauucaacuagaccgcuucgaaaaguacggccaggugcggggugauuucaacgucguagaaaacggggaaaagagacgccugaucaacguauucaccaccucggccuacucgaaagaagcagagcgcauccuacgcaagcagcaggaguucaacaagaaaauaacagacgaguucaucgaagacuaucucaccauccuaaccggaaaacgaaaauacuaucacggccccgggaacgagaaaagccgaacagauuacggccgguacaccacaaagaaagacccagaagguaaauacaucacgcuagacaauauauucggaauacucaucggcaaaugcacguucuaccccgacgaauaccgagcaucgaaagcauccuacacggcccaagaguucaaccuccucaacgaccucaacaaucugacuguccccacagaaaccaagaaacuaagcgaagaacaaaagaagacaaucaucaaauacgccaaaaccgcgaagacccuuggagccuccacccuccucaaauacauagcgaaacuuauaggcgccuccgucgaccaaauccacgguuaccgaaucgauccaaacaagaaacccgagaugcacacguucgaaaccuaucgcaaaaugcaaagccucgaaaccaucuccgucgaagaacucccucggaaaguacucgacgaacuugcucauauacugacccucaacaccgaacgcgaagguaucgaagaagccaucaacgcuacccucaaagacacauucucccaggaccaggugcucgaacucgugcaauuucggaaaaacaacagcagcuuguucagcaaaggauggcacucauuuucacucaagcucaugauggaacuuauccccgaguuguacgaaaccagcgaggaacagaugaccauucucacgcgacuaggcaaacagaaguccaaggaaacauccaaacgcacgaaguacaucgacgagaaagaacucacugaagaaaucuacaaccccguaguggcaaaauccguaaggcaagcaaucaaaauaaucaaugaggccaccaagaaauacggcauauucgacaacauuguaaucgagauggcacgcgaaaacaaugaggaggaugccaagaaagaguauaucaaacgacagaaagccaaccucgacgagaaaaacgccgccauggaaaaagcggcauuccaauacaauggaaagaaagaacugccagacaacguauuucacggccacaaagagcucgcgaccaagauccgccucuggcaccaacagggagaaaagugccuguacaccgguaagaacaucccaauauccgaccuaauccaaaaccaauacaaauacgaaaucgaccacauacuaccgcucucacuuagcuucgacgacagccucagcaacaaaguccucguacucgcgacggcgaaccaagaaaaagggcaacgaaccccauuccaagcacuagacagcauggaugacgcaugguccuaccgcgaguucaaguccuacgucaaagacucgaaacuacucggaaacaagaagaaagaauaccuacucaccgaagaagacaucagcaaaauagaaguaaaacaaaaauucaucgaacgcaaccucguagacaccagauacagcucacgggucguccugaacgcacuacaagacuucuacaaagaacaccaauucgacaccacaaucucagucguuagaggacaauucacaucccaacugcggagaaaauggggacuggaaaaaucacgagaaacauaucaccaccacgcagucgacgcgcucauaauagcggcaagcagccagcugcgccuguggaagaaacaaaacaacccccucaucucauacacugaaggacaauucguugaucaagucacgggcgaaauaauaaguuuaagcgacgacgaauacaaagagcuaguguucaaagcacccuacgaccacuucguagacacauuaaagucgaagaaauucgaagacuccauacuguucucguaccaggucgacucuaaauauaaccgaaaaauuagcgacgccacgaucuacgccacacgaaaagccaagcucgacaaggagaacaaggaguacaccuauacccucggcaaaaucaaagacauauacgcgcuuggaacgaaguccccaucaaaaaccgguuucuacaaauuccuagaccuguacaacaaagacaaaucccaauuccuaauguuccagaaagaccgaaagacaugggacgaagugaucgagaaaauaauagaacaauaccgcccauuuaaagaauacgacgaaaacgggaaggaagucgacuucaacccauuugagaaauaccgcauugaaaacggaccaauccgaaaauacucgaagaaaggaaacggcccagagaucaaaucccugaaauacuacgacaaccugcuaggcaaguucguugacaucaccccuagcgaguccaagaacccgguagcucuccuaucacugaaccccuggcgcacagaugucuacuacaacacggagaccagcaaguacgaguuccuaggccuaaaauacgcagaccucugcuuugaaaagggcggagccuacggaaucuccgaaguaaaauacaacaaaaucagggaaaaagaggggaucgggaaagaguccgaguucaaguucacccucuacaaaaacgaccucauacuuaucaaagacaccgaaaccaauugccagcaaauauuccgauucuggagucgaacuggcaaagacaaccccaaguccuucgaaaaacacaagauagaacucaaaccauaugaaaaagccagauucgagaagggagaggaacucgaaguccuagggaaaguaccacccucaucgaaccaacuacagaaaaacaugcaaauagaaaaccugucgauauacaaagucaaaaccgacguccucggaaacaaacacuucauaaagaaagagggcgaggaacccaaacucaaauucuga

SEQ ID NO: 6327 - RNA, 3423 nt, Artificial Sequence
  Cas9 variant
auggaagaaaauuuccaguaccgcauaggacucgacauaggaaucacaagcgucggaugggcaguacuacaaaacaacagccaggacgagcccguaaggaucaccgaccugggcguaagaauauucgacgucgcggaaaaucccaagaacggcgaugcgcuagcagcacccagaagagaugcgcggacgacgagacgcagacuucgcagacggaggcauagauuggaacggaucaaauuccugcuccaggaaaacgggcuaauagaaauggacagcuucauggaacgauacuacaaaggcaaccugccggacguuuaccaacuccgcuacgaaggauuagaucggaaauuaaaggaugaagaacuggcucaagucuuaauccacauagcaaagcacagaggcuucagaagcacaagaaaagcggaaaccaagggcaaagagggaggcgcgguccuaaaagcgacaaccgaaaaccaaaagaucaugcaagaaaaaggauaccgcacggucggagaaaugcuauacuuagaugaagccuuccacacagaaugccuauggaacgagaaaggcuacguacuaacaccgcguaacagaccagacgacuacaaacacaccauacuacgcucgaugcuaguagaggaaguccacgcgauauucgccgcucaaagagcccuggggaacgaaaaggccacugaagaacuagaaaacgcguacguugagaucaugacaucacaacgaucauucgacauggguccaggacuccaaccggacggaaaacccagccccuacgcuauggagggcuuuggagaccgaguaggaaaaugcacguucgagaaagacgaguaccgcgcaccaaaagcaaccuacacagccgaacucuucgucgcccuacaaaagaucaaucauacaaaacucaucgacgaguucgggacuggacgcuucuucacggaagaagagaggaaaaccaucaucgaccuacuccuaagcggcaaagaacuaaaauacggcacaauccgaaagaaacugaacaucgaccccagccucaaauucaacagcuugaacuacucggcgaagaaagaaggcgaaacagaggaggagcgggugagagacaccgaaaaggcaaaguucgccaguauguucuggaccuacgaguacucaaaaugccucaaggacaggaacgaggagaugacagucggccagaaggcggaccuccucgaccggauaggcgaaauacuaacagcauauaagaacgacgacucaaggagcaguagacucgaggaccuaggccuaagucgcgaagaaauagacggccucuuagaacucagcccggcgaaauaccaacgagucuccuuaaaggcaaugcgaaaaaugcagccauaccuagaggacggccucaucuacgacaaggccugcgaggcagcgggcuacgacuucagagcgcucaacgacgggaacaagaaacaccuacugaaaggcgaggaaaucaaugcgauaguaaaugacauaaccaacccagucguaaaaagaagcguaucccaaaccaucaaagucauaaacgcgaucauacagaaauacggcagcccacaggcagucaacaucgagcuagcacgagaaaugagcaaaaacuuccaagauaggaccaaccuagaaaaagaaaugaagaaaagacaacaggaaaaugagcgggccaagcaacaaauaauagaacucgggaagcaaaaccccacaggacaagacauccucaaauacagacuguggaacgaccaagggggcuacugccucuacucaggcaagaaaauaccacucgaagaauuguucgguggcggauacgauaucgaccacauacucccguauuccaucaccuucgacgauuccuaccgcaauaaaguccucguaacggcccaagaaaaccgacaaaagggaaacagaacacccuacgaauacuucggcgcagacgagaaacacugggaggacuacgaggccagaguaagacuacucgucagggacuacaagaaacaacagaaacugcuaaagaaaaacuucaccgaggaagagagaaaagaguucaaagagagaaaccuaaacgacacaaaauacaucacaagagugguguauaacaugauccggcaaaaccuagaacucgagccguucaaccacccagaaaagaagaaacaggucugggcggucaacggagcgguuaccaguuaccuacgcaaaagguggggccucaugcagaaagaccgcagcaccgaccgacaucaugcgauggaugcagucgucauagcgugcugcaccgacggcaugauccacaaaaucagccgcuacaugcaaggcagggaacucgccuacagcaggaacuucaaauucccagacgaagaaaccggcgaaauacugaaccgcgacaacuuuacccgcgaacaaugggacgagaaauuuggagucaaaguaccgcuaccauggaacuccuucagggacgaacuggacauacgacuacuuaacgaagaccccaagaacuuucuucugacacacgcggacguccagagggaguuagauuacccuggcuggauguauggcgaagaagaaagcccaauagaagaaggccgcuacauaaacuacauaaggccacuguucgucagcaggaugccaaaccacaaggucaccggaagcgcgcacgacgccacaauaagauccgcaagagauuacgaaacuaggggagucguaaucaccaaaguaccacuaacagaccuaaagcugaacaaagacaacgaaauagaaggcuacuacgacaaagacucagaccggcuacucuaccaagcacucguccgccagcuacugcuccacgggaacgacggcaaaaaggcguucgcagaagacuuccacaaaccgaaagccgacggaacggaaggacccguggugcgcaaagugaaaauagagaagaaacaaacaucagggguaaugguccgcgggggcaccgguauagcagcaaacggggaaaugguccgaauagacguauucagagaaaacggaaaauacuacuucgucccggucuacaccgccgacguggugcgaaaaguccucccgaacagggccgcaaugaauggcaaaaucgcaagugacuggaaaaccauggaagacaacaacuucgucuucucccuauacagccgggaccuaauccacgugaaaaggaaaaaggccauaccgaccauccugucuaguggcgcaacuuucgaacaggaagaguucuacgccuacuucacaggagccgacaucagcacagucagcaucgccggaauaaguaacgacaacuccuucaaauuccggggccugggcauccagggccuggaaauauuugaaaaaugccaggucgacauccucggcaacauaagcgucguccggcacgagaaccgucaaggcuuccacuga

SEQ ID NO: 6328 - RNA, 3426 nt, Artificial Sequence
  Cas9 variant
auguacuccaucggacucgacauaggaauagcguccguaggcuacucggugaucgagaccaauagcggcagaaucgucgaacuaggggcacgcauauucgaagcacggaacagcgacaacaacaaagaccgacgugacuuccggggaggcagaagacucauacgacgccgcaaaacgcgacuagacgacgccaagcgcuacuuagacgaccaaggauucaaaaacgacaagagccuaaucaauguaugccccuacagccuccgagucaaaggcuugacagaggaacucuccaagagcgaaauccgcaaagucauacuccacauccucaaaaagcggggaguguccuaccuaagcucggaagacuuagacaccuccagcgucgacaacaaagacagcuuuaagcaagccguuaccaaaaaccugagacaacuggacgacaagacgccgggccaaauccaauacgaacgccuccaggagucggggcgcgugagaaccggaauaaaccaaaacgggcaauaccaacugaacgucuucgacgucgccuccuacgcaaaagaacucaaacuuauacucgaaacacaacagcaauaccaucaagaaaucgacgaccacuuccucgacuucuucacgaaagacggauaccgugaagacgcgggacucauauaccguaaacgaccguauuacgacggcccagggaaugcagcacaaaacaguucguacggccgcugggccaacuaccaagucgacggcaaaccagccgaaaacauuuucgaccaacuaauaggcaaagacuucacgggaaaaauucgagcaagcaaccucggaccaagugcccagaaauucaaccuacuaaaugaucuaaacaaucuaagaauuaccacccgcgaggaagaaaaacuuaccuucgaagaaaaacaggaaauccucgagguccucgaaaaugaccgcccaaaaaccuucggccccagaaacauagccaaaauguuaaaaguagauauggacgacaucaaaggguggcgccucaacuccagcgacaaaccggaaauccacacaaugaaggaguacaacgacaugcgccucgucuuggaagccggggguuucgacauaaaagccauagaccuugaccacauagaagagauagccagccucaucacccuaaacaccgagagggaagcauucgagcucagcuuaucaaacgaaauagacaacaaccugaaacaauuucugguagagaacuucaacgcccuccgcaagugcaaacccaacaacuccuggcacagcuucagcaaggaaaaccuucaaagacugaucaccgagcuggagcauacaucugaugaacaaaacacaauccuggagcgacugggccugaaauucgaccuaagaagcaaguacagcgaccgagacacccugccaauccacgaaguccucgaagaaauauacaaccccaccgucaguaaaagcguccgacagacguuccgaguacugaacgcccucguuaagaaauacggcaaagaaaacaucgacuacguaaccauugagaugccccgagacaaaaaugaagacgaccaaaagaagaccauccgggaaauccaaaaaguuaacaaaaaccgcaaggacaagucgaaagaguacuuccucaaaaaguccgguugguccgaagagaaguucgaagaaaaguuaagaaccagcaggagauucgcaagcaaacuauacuacuuuuacgaacaagacggacugugcgcauauacaggccagcagauucaaccagaagaucuacuaacugagcgaguagaggucgaccacauaauuccgcuaucggugucauuggacgacagcaucaacaauaagguacucgugaccucagaggcaaaccaaaagaaaggccaacguucaccguacgaugccuucaugucgggagacuucagcaaauaccgcacauacgacgaauacaaagccugggugcuauccaacaaauacaagaaauacaaaaaggcgcuacuccucgaggaacgaaacaucuucgaucccgaacucgccaaaaaguuccgucagcguaaccuuaacgacaccagauacgcaagccgcaucgugcucaacgccguucagagcuuuuucuacaaaaccgauacaaaaacacgggucguaaacggagcguucacucacacccuacgcaaaaaguggaaccuggccgacaaggaccgcgaaacacaccaccaccacgccauagacgcaacccuagucgcgguaacaccauucgugaaagcagagagguacgaauauuacaaagacagcgagggcaaagccagcaugguggacacugugacgggaacaaucaucccauacuccgaauacaaaaagaaaaaccuauacgaccgaucaaacuaccuccucauguucggcaaugaauccaccauaaaccaagaaaaagaggacaaaucagccgaauuuaucagaaaccucauaccggccaagaucuaccccgagaucaaguucucccaccaaguagaccguaaauccaaccgaaggcucucugacgcgacgaucuacaguacccggucauacacgguagagaaaggacgagguaagaacaaacgugaggucaucgagcgagacaucaucggcaagauuaaggauauauacaccgccgacggauacgcagaauaugucaaguacaaagacagccuccuggucaaagaaaucgacgaaaagacguucgagaaacuagaagccauaaucgaagaguucagcgauacgguagaagucaccgaccaacaagggaaagucaagaaagucuccaaaagccccuuccuccaauacugcgaaaaauacgacgucccaggcguaacaaaauacagcaagaaaaacaacggccccguaauccgcagccugaaauaccgcuauacgaaacugcggucccacaucgauauuucccccaaaaacagcaaaaacaccguugcccuacucacacuugcgccguggcggacggacgucuacuacucacaggaaaccgcaucauaccaucugcuuggccucaaauacauagaccuaucguuccgagacggcggauaugggguaucccguaaacgguacgaagaaaucaaaaagaaugaacgaauccccgaggacggcgaguucaaauucucgcuguacaaaaaggauuacauagaaauagaguucgauaagaaaauacucccaggacuguaccaaagucgagacgugucggcacgcaacaaauucucgaugaaacccaucgacaaagcacaauggacaagcaaagaagauguccuaauguucgggaaugucaaagcgucaggcgucuuugagaaaacccucaagaaaaacuacguccugagaaaauaccacgucgacguccuagggaacaaauucgaagucaaagacgaaauccuaaaagacauacuagaauga

SEQ ID NO: 6329 - RNA, 3429 nt, Artificial Sequence
  Cas9 variant
auguauucaguaggccucgacaucggaaucgcgagcuguggguacucuauaaucaacgacguuaacgggaacaucgucgaacuaggcacccuccucuucaaaagccgcaacucagacaacaacgaggaacgacgcacaaacaggggcagccgacgccuaauaaauaggagaagaacgcgacuagacgacggaaagaaacuccuagcagagaagggguucaagcaagauuccaaauugaagcacgugugcccguaugaacuccgcgugaaaggcuugcacgagaagcucacccagggggaaaucuacaaagucguccuccacauccugaagaaacgaggaaucucauaccuggaugaaagcgaugagaacucaucuggcauugauggcgcaagcuacaaagaccaaguaaaucucaaucuaaaccuacaaaaagagcuaacaccaggacaaauccagcuaaaacgccugaaagaaaacggacgaaucaaauccggagucaccuuugagaacggcuaccaacuuaacgucuucucagucuccgccuacgccaacgagcucaacaaaauacucacaaaacaaagcgaguacuacagcgaaaucgaccagaucuggaucgaccgguucacgaaaaauggcuaccgcaaagaagcuggacucgucuauaggaaacgcccauacuacgauggccccggaaacgaaaagaauaacuccauauacggccggugggcgaacuucaaagaagacggccaccccaaagaaaacauauucgaccaacugaucggccuugacagugucgacucgacccaaguccgagccuccgcaaguacacuaacagcacaaaaauacaaccugcuaaacgacuuaaacaaccuaacgaucauagaggacgaccgaaaauuuaccaccgacgagaaaguauccaucaucaacuaucuuaugacacaagacauaacccgguucggacccaaagaacucgcaaaauuuuaccaacucgagguagaucaaauccgcggcuggcgcauagacaacaaaggcaacccugagauccacucacucaaagucuaccgcgacuggaagaaaaucuucaacaccuccuccauagaccuaaccagcauccaaaccugggucgucgacgaacuugcgaacguaaucacacucaacacugaaauccccaguacccucgccacccugaagauaaagauccccgacauugaccaacaaauacucaacuucgucgaaaacaacuuuuacgaacuaaagaagaaaaccagcaaaaacagcuggcacuccuucucccucaaaacccuaaacauccuaauaccggaacuccuaaacaccucggaagaacagaacacaauccucgagcgccucaacuuaaaauucgaccucaagaacaaauacgcggagaagaaucagauccccgucaaggaacuacucgaacaaauauacaaucccaccgugaccaaaagcguacaccaaucaaucaaacucuucaacgaaaucauugaaaaauacggcaaaaacaauaucuccuacguuacuaucgaaaugccuagagacaaaaaugaccaagaccagaaagacacuaucaaacgcauuaauaaacucaacuccgaacgcaaaaacgacagcgaaaaauacuuccucgaaagauccggaugggacaccauacgcuucgaaucagcccucaagaagccccguuuugcagaaaagcuacuguucuacuacgagcaaaaaggaaagugugccuacucaggacaggacaucuuagcagagucgcuucucaacgagagcugcgaagucgaccauaucauaccgcuaagcauauccuucgacgacucaauccacaacaaaguacucguaacggcauccagcaaccaggagaaaggacaacgaaccccuuauauggccuucauagacggcgcgaaacuuggacaaucaugggacgauuucguggccuggguaaacucaugcggguuccaccggaagaaaguccaaaaucuacucuaugaggagaacauauucaaccccgacgugcagcgaggauucgugucucgcaacuugaacgacacacgcuacgccagccgcaucguacuaaacgccauccaauccuucuucuacaaacaaaaagaccucaccaaggucaaggucgucaacggaucguucacccacacccuacguaagaaauggggcuccucacucgacaaaaaccgagacaccuaccaccaccacgccguagacgcuacccuaugcgccgucacccccuucaucaacaucgucaaguacgaguucuucgaagaagacggaaucaaauauauggucgaccuaaccaccggagaaaaaguagcguacagcgacuacaaaaagaugaaauucuacgacaaacgagcguacguccccaucugggacggcuucaucaaacagcucacacccgcgaaccucuaccccaagaucaaauucucgcaccaaguggacaguaaguggaaccgaaaaaucucagacgcuacaaucuacuccacccguaaaauagucgaaacgaaaauaaacaagaaaggcguggccaaagaaaccgucaaagacauugucauagacaaaauaaaagacaucuauacgccggagggcuggcguaaauucaaagagaaacaggacaaacuccuaaugaaaaacuuugacgagaagacguacaacaaacucaucaaaauugcaaaagaauacccggaaaagaaagaaguccaaaccagcaacggcaaaguaagccuaguugaaguaagccccuucaagauguacugugaggagcaaaacgugcccgcaauacgaaaguauagcaagaaaggcaacggucccuacauucgauccuugaaauucuacgauaaggaacuaggcaaacacauaaacaucaccaaggacuccuacggcaacgacauugagcggaccauccgaaacaagaagaucauccucaaaaaccaaaacuccuggcgcaccgacgucuauuacaauucggucaacaacugcuacgagcuacucggcaucaaguacugccaccucaaauucuaccggggaaaauacggaaucccaaaauccauauacgacgaacucaagaaagaggacgaaauaucaucagagucagucuucaaauuuucccuauaccggcaugaccgcguacgcuucgaaaaagauggggaauauaucgaagcacuauucggauccaaaaacgaaagcaacaaaaacuaccucgagcugagccccaucgacaaaaacaaauggcugagcaaagaaaaugucaaauucuucggcgaggucgccgccucaggacgcuucauaaaaggccucaaaccaggcaucaagguaauaaagcaauccaccgauuacaugggccacgucuacgcaauacaccaggaaaagcucaaauucguccucucggacgcuuga

SEQ ID NO: 6330 - RNA, 3435 nt, Artificial Sequence
  Cas9 variant
augacaaguaaacaagaaaaacauggagcacucaccuucggccuagacauaggcaucgccagcgugggcugggccguccuaggcgaaucacggaucguagaccugggcguucgcugcuucgacaaggcagaaaccgcgaaagaaggagaaagccugaaccuaacacggcgaauggcgcgccuacugcgacgccgcuuacgaaggcgcgcguggagacucacaaaacuagcaagacuccuaaaaagggaagggcucauagccgacgccaaucucuuuaaacacaaaauugaaaagaacacgcccguacccaaguccaguuggcagcucaggguagacggccucgauaggcagcugaacgcagaagagugggccagaguaauauaccaccuguguaaacaccggggguuucacuggauaucacgcgcagaagaaaaggccgcagagggcgacaguaaaggagagggagggaaaguaaaacaggggcuagcugggacgaaaaaguuaaugcaggaaaagagcuaucgaacagcagcggaaauggugcuggcagaguucccagacgcacaaagaaacaaacaaggcgacuacaguaaagcccuaagcagaauacuacuaggagacgaacuuaaagcacuguucgaacaccagcgcaaacugggaaacccgguagcaaccgaaaaauuagaagccgcaauacucggcaacggggauaagaaaugcggucuauucugggcccaaaaccccgcucuagcaggcaacaaacuccuagaaaugcuaggccgcugcaccuucgagaaaaccggcggcgacgacggcaaaggcgaauaccgcgcacccaaggcauccuucagugccgaacgccacgucuggcuaacgcaccucaacaaccugagaauaguagucgacggcaccaccaggccgcuaaacgaagcagagcgaagagucgcccugccgaugccauaccaacaggccggcgaccucagcuacaaacagcuuggcggggcgcucaucaaagaaggcuuccuacagaaagacggauucaaauucgcaggcuuaccauaccccacgaaacaggccucugaagaaaaggccaaagaccccgaaacaucgguccugugcaaacuaccagccuggcacacccuuaggaagacuuuagaaaagcacggacuagaauccgaauggcaaaaacucucaaccgaugcgcuggacgggaaaccccagcuucucgacaacauagcaugggucuuguccguguacaaggacgacgaugaagugaaaaccgaacugggaaaacucaaccugccgaacacagaaaagaugauagacgccuuacucgacauccgguucgauaaauucagcaaccuaagccucaaggcacuaaguaaaaucgugccauucauggagcagggccaaagauacgacgaggcaguagccaacauacccgaauacggacaccacagccaacugcacaaagucggagccggagagcacaaauaccucccacccuucuacaaagaacgcgacaagacaggccggaugguguucaacgacgacauggacaucccacgcaacccgguaguucuacgggcacugaaccaagcacggaagguagugaaugcgcuuauuaaagaguacggcagcccacacgaaguccauaucgagauggcucgcgaccucucacgcccgcuagacgaaaggcgagacaucgaaaaauuacaaaaagaguucggcgagcgcaauaaaaaggacaaagaacuguucgcacaagacuucaacauaguuggcaccgucaaagggaaacaauucgaaaaauaccaacuauaccgcgagcaacaaggcaaaugcaucuaccccagcauggaugaaaaacaaggaauaugcuguuacagucuaaaaccacuggacuuacaccggguacucuacgaagaaggguacgcagagauagaccacgcccugccauacagccggagcuucgacgacaguaagaacaaccgcguauuggugcucgccaaggagaaccgggacaagggaaaccgaacccccuucgaauaccugggggacaaggacaacucagagccauggcgccaauucguagcguucguagaaggcaacaaggcauaccggcuagccaaacggagcagacuacuacgaaaagacuuuggcgacaaagaagccaaggaguuccgagaacgcaaucucaacgacacgcgcuacaucugcaaguucuuuaaaaacuacguggaacaauaccuccaacugcaugaagacagugaagccaaaagaugcgucguucucaguggacagaugaccagcuuccucagggccagauggggacucgucaaaguaaggggagacucagacagacaccacgcacuagacgcagcggucguagcagccugcagccacggcaugguaaagcgcuugucagauuacucgaggcgaaaagaacucgaacaaguaagagaaggcuuugucgacgucgacaccggcgaaaucguaaaucccgccauguuccagcaaguucaagaacauuuucccaacccguggccacacuuccgcgaugaagucaaacuacggcuaucaauagaugacccaacauuacugcgcucagaaauggagaaauucgggacauacaccccagaaagucucgaagcccuacgaccucucuuuguuucgagagcaccccagcguagaaacucaggcgccgcccacaaggacacaauauacgcccaaccaaagaggcuaguagcccaaggcggcgucacacagaaagucgcucuaagcucacugaccuuaaaagaccucgacaaacugaucgacccacaccgaaacgagcgauuauacgccgccaucagagccagauuggaacagcacggcggaaaaggcgauaaagccuuccccgccuccaacccacuacgcaagcccgacagcgaaggaaaccccacaggacccauagugcgcgggguaacaaugguaaucgacaaacuaagugguauccccaucagaggagggauagccaaaaaugacucaaugguacgcgucgacguuuucacgaaggcaaacaaauuccaccucguaccaguauacguacaccacagcgugcugggccuaccgaaccaagccauaguaggcgggaaggaagaaagcgaauggacgcaaauagacgacagcuucgacuggcacuucagcaucuacccgaaugaccucauacgcguuacccugaaacaagaaggccgcuucggauacuaugcaggaugugaccgauccacggccgcaauacauuuaugggcccacgaccgcaaccaacagguugguaaggacggauugauccguuccauuggagugaagaccgcacucaguaucgaaaaauucaacguggauguguuaggaaacagauaccccgcaccaccagagaagcgcagagaucuagccuga

SEQ ID NO: 6331 - RNA, 3435 nt, Artificial Sequence
  Cas9 variant
augacgucaaaacaggaaaacuuaggcgcacuaaccuucggacuugacauagggauagccucagugggcugggcaguguuaggagagaacagaauuaucgaccucgguguccgcugcuucgacaaagccgaaaccgcgaaagagggagagucacuuaaccuaacuagaagaauggcccgccuccuaaggcggcgccuccgccgacgagcauggcgacucacgaaacuagcaaggcuccuuaaaagagaagggcucauagcagacgcaaaccuauucaaacacaaaauugagaaaaauacaccggugcccaaaagcagcuggcaguugcgcguagacgggcucgacagacaauuaaacgcagaagaaugggcucgcgucauauaccaccuuugcaaacacaggggauuucacuggaucagccgcgcagaagaaaaagcggccgaaggcgacagcaaaggggaagguggcaaggucaagcaaggacuggcaggaacgaagaaauugaugcaggaaaagucauaccgcaccgccgcagaaaugguacuugccgaguucccugacgcccaaagaaauaaacaaggggacuacuccaaagcacucagccgaauauuacucggagacgaacugaaagcacuguucgaacaucaaaggaaacuaggaaaccccgucgcaacagagaaacucgaagcagcaauacucggaaacggggacaagaaaugcggccuauucugggcacaaaaccccgcacucgcgggcaacaaacuacuagaaaugcucggcagaugcaccuucgagaaaaccggaggagacgacggaaaaggagaauaccgugcgccaaaggcaucauucucggccgaaaggcacgucuggcuaacccaccuaaacaaccucagaauagugguagacggaacgacacgaccgcuaaacgaagcagaacgccgcguugcgcucccuaugccauaccaacaagcaggcgaccuaagcuauaagcagcuaggaggagcccucaucaaagaaggcuuccuacaaaaagacggcuucaaguuugcgggguugcccuaccccacaaagcaagccagcgaagaaaaggcgaaagaccccgaaacaucaguauuaugcaaacuuccagcguggcacacccuaagaaagacacucgaaaaacacggccuagaaagcgaauggcaaaaacucucaacagacgcauuagacgguaaaccacaacuacuagacaacaucgccuggguccuaaguguauacaaagaugacgacgaagugaaaacagaacucgggaaacucaaccuuccuaacacggaaaagaugaucgacgcauuauuagacaucagauucgacaaauucagcaacuuaucgcuaaaggcccucucgaaaauuguaccuuucauggaacaaggacaaagguacgacgaagccgucgcuaacauacccgaauacggccaccacagccaacugcacaaggucggcgcgggagaacacaaauaccugcccccguucuacaaagaacgcgacaagacaggccggaugguguucaacgacgacauggacauccccaggaacccgguaguccuacgcgcccuaaaccaagcccgcaaagucgucaacgcgcuuauuaaagaauacggcucaccccaugaaguccacaucgaaauggcccgcgaccuaagccgcccccucgacgagcgccgagacaucgaaaaacugcagaaagaguucggggaacgaaacaagaaagauaaagaacuauucgcccaagacuucaacauaguaggaacagugaagggcaaacaguucgaaaaauaccaacucuaccgcgaacaacaaggaaagugcauauacccgagcauggacgaaaaacagggaauaugcugcuacucccucaagccccuggaucuccaccgcguccuauacgaagaaggauaugccgaaauagaucacgcacugccauacagucggagcuucgacgauagcaaaaacaaccgaguccuaguccuggccaaagaaaaccgcgacaaaggaaacagaacgccguucgaauaccugggagacaaagacaacuccgaacccuggcgccaauucgucgccuucguagaaggcaacaaagcauaccgccucgcaaaacgaagcagacuccucaggaaagauuuuggcgacaaagaagcaaaagaguuccgagaacgaaaccugaaugacacacgauacaucuguaaguucuuuaagaacuacgucgaacaauaccuccaacuacaugaagacuccgaggccaagcgcugcgucguucuuucuggacagaugaccaguuuccucagagcaagauggggacugguaaaagugcgcggagauuccgacaggcaccaugcgcucgacgcagcaguaguggcagcguguucacacgggaugguaaagcgccuaagcgacuacagccgacgaaaagaacuagaacaaguacgcgaaggguucgucgauguagacacaggagaaauuguuaacccggcaauguuccaacaagugcaagaacacuucccuaaccccuggccacacuuccgagacgaagugaagcuaaggcuaucuaucgacgacccaacccuauugcgaagcgaaauggaaaaauucgggaccuacaccccagaaucccucgaagcucuccgcccucucuuugucucacgcgcgccacagagaagaaacagcggcgccgcgcacaaggacacgaucuacgcucaacccaagcggcucgucgcccaaggcggaguaacacagaagguagcacucucgagccucacccucaaagaccucgacaagcuaauagacccacacaggaacgaaagacuauaugcagcaauccgggcgaggcuagaacaacacggagggaaaggggacaaagcauucccugcgucaaacccauuacgcaaacccgacagcgagggaaaccccacaggccccaucguccgaggagucacgaugguaaucgacaaacucucaggaaucccaauacgaggcggcauagccaaaaacgacucaaugguccgcguagacguguucaccaaggcaaacaaauuccaccuagugcccgucuacgugcaccacucaguacuaggacuccccaaccaagcaauugucgggggaaaagaagaauccgaauggacccagauagacgacagcuucgauuggcacuucucuaucuacccaaacgaccucauaagagucacccuaaaacaagaaggccgauucgguuacuacgccggcugcgacagguccacggcggcuauccaccuaugggcccacgaccgaaaccaacagguaggaaaggauggacuaauccgcagcauuggggugaagacggcacuaucaaucgaaaaauucaacgucgacguucuaggcaacagguacccagcgccgccagagaaaagacgcgaccuggcauga

SEQ ID NO: 6332 - RNA, 3438 nt, Artificial Sequence
  Cas9 variant
augaaaaccauccugggacuagacuuaggaacaaacagcaucggcugggcccucguaaaggaaacagaaaacucaaacgagaagagugagaucauaaaacucggggugcgcguuaacccccucaccgucgacgagaaaacaaacuucgaagccggacgaccauuaagcacgaacgccgaccgcacagcgaaaagaagcgcacgucgcaacuuacaacgguacaagcuacgccgcaaaaaccucauagaccuacuaaucaaacacagacuaaucgacaaagacacaccccugaccgaaaucggcaaaaauaccacccaccaaacccuagaacuccgagcaaaggcagcucgggaacgcauugaacuagaggaucucgcccgagucuuccuagcaauaaacaagaagcgggguuaccgcucaucacguaaaguaaacaacgaagaggagggccaagucgucgacggaauggcaguagccaaaaagcucuaugacgagaaccuaaccccgggacaauacgcauacgaacuccucagcaaaggaaagaaguacguuccugacuucuacaggucagaccuacaggcggaguucgacagcaucugggaauaccagaaacaauucuacgccgacauucucgaugacgaacuauauaacgcccuaaaaggacaagggcagcagaacucacgcaaacgcuuccuagcaauaaaaggcgucuacacagcagaaaacaaaggaaaacgcgacgagguaaaauuacaacacuacaaauggaggucggaggcgauaacacaaaagcucagcaucgaagagguagccuacgugcuagucgagaucaacaacgaccuaaacaaaagcagcggcuaccuaggcgcaauaagcgacagaucaaaggaacucuacuucaacaaagaaacggucggcgagaaccuauggaagcaaauacaaaagaauccccacacuucccucaaaaaccagguauucuaccgccaggacuaccucgacgaguucgaacagaucugggaaacacaggcccaauuccacccccaacuaacccucgcccucaaagaacaaauccgagacguuguaauauucuaccagcgaaaacucaagagccagaagggccuacucagcuucugccaguucgaauccugggaaaucgaacggaaggaugaaaacgguaacguaauacuaaauaaaacgacgcaacuaccgaagaggcaaacagucggaagacggguugccccaaaaagcucaccacucuuccaagaguucaaaaucuggcaaaacauaaacaaccuagaaauagccaagaucagcgacggaaacuccaagaacaaaaaggaaaccgaggcacuaucagacgacgagagaaaauuacuauucgaagaacucaaucuccgcgggaaccugucccaaaaggaagugcugcagauacucggacucaaagacaaggaguacaagacuaacuuccccgagggccuggaaggaaaccgcacaaacgcugcccucuucaacauauaccagcaaauagcagagaacgagggauacggggacuggacuaagaaaagcgcgcaagaaaucaaagaggagcuaaaagccguauucccacaaaucggaauccaagcggacauccucgacuuuaacgcggaacucgacgggaaagaguucgagaaucaagccagcuaccagcuauggcaccuacuauacuccgccgaagaggacgacaaaauaaacgaggaggaccaaaucauauauggcaauagcgccguuucacucaaaaagaaacuaugcgaaaaauucggcuucacaccggaauacgccaaauggaucgccaacguaucucuccaagacgacuacggcaaccuguccacaaaagccaugcgaaaaauaauaccauaccucaucgacggcaacgacuacucugaggccugcgccuuagcaggauacaaccacucgaacagccucaccaaagaagagaacgacaaccgagaacggcucaacaaacucgaacuccuacccaaaaacagccugagaaacccagugguggagaaaauacuaaaccagauggucaacguaguaaaucaaguaauagaaacauacggcaagcccgacgaggucagaauagagcuggccagagaacucaaaaagucagcggaagaacgggcggaaaugacaaaggggauuaacgaggcaacgcgccgaaacgaggacaucaagaaacuaauaaccaaaaacuucggaauaccaaacccaacaaagaaugacgucguacgcuaucgccucugggaggaacuagcuccccuggcguacaaagacguguucacaggucgccaaaucaagaaagaagaccuguucucaucgaaaaucgacauagaacacaucauccccaaagcucuccuauucgacgacaguuuuucgaacaaaacgcucgccuuccgugagacuaaccucaagaaagccgauagaacggcauacggcuucauagaauccgauuacaacgccacccuagacgacuacauacagagagucgagacacuguacaacaacgcaaaaggaaccaucucgaaaggcaaaagaaacaagcuacuaauggcccagaaaaaccucccagacggcuucaucgagcgagaccuacgaaacagccaauacauagcaaagaaagcaaaaagcaugauugagaaggucuuuaacgacgugaacgucacgucgggaucaauaaccgaucgacugagggaggacugggauuuaauaaacgucaugaaagagcuaaacuuccccaaguacaaagcgcucggccugaccgaaauagaggaaagauacgacauuggacaagagaaaaccaagaaaguagaagugaucacagacuggacaaaacgaaacgaccaccgccaccacgccauggacgcacucacaguagccuucacaacaaaaagccacgugcaauaccucaacaaccuaaacacaauccacagucuaaaaggagacgaagucgaccucgagcucucgaaacucuacgggcucaaaaacaccauaacggaaguagucaacaagaaaaggaaauuuauuccacccaugcccaauuucagagaggaagccaagaaacacaucgaaacuauccuugucagcaucaaaaauaaaaacaaagucuacaccaaaaacauaaacaaaaccaaaaaggaguccggauaccacacaaaggaacaacucacaccccgaggacaacugcacaaagaaaccguauauggcaagagcaaaagacccaugaacaagcccaccaaaauaaacaaaaacuucucccuagaacaagcacagcugaucauaaacguacaggaaaaagagcucguccugcgccaccuugcgcaguucgacaacaacccugcgguagcauuugacacaaagacucuaaagaaaugccacuaccucaaaauggucaaccucuga

SEQ ID NO: 6333 - RNA, 3441 nt, Artificial Sequence
  Cas9 variant
augucaggaaacacacacgguccccucacauucggcuucgacaucgggaucgccucagucggcuggugcguccucggcgaaaaccgaauagucaaccucggagucagaugcuucgacaaagcagaaaccgcaaaagaaggcgaaucucuaaaccuagcccgccggaccgccagacucaugagaagacgccuccggcgacgcgccuggagacucacaaagcuagcccgccuccuuaaaagagaaggacucaucgccgaggcaucacgaauacacauccccagccccguaagcccguggcgucucagagucgaagguauagaccgccgccuaacagacgacgaaugggcgcgaguuauauaccaccuaugcaaacaucgaggcuuucacuggauaucacgagcagaggaacgcaaagcagaauccgaugccaaagaaggcggucgggugaagaaaggccugagugacacccaacgccgaaugacggaaaaaggauacagauccgcagccgagaugguacuugccgaguucccggacgcccagcgaaacaaacaaggugacuacggaaaagcacucucgcgcauccuccucagcgacgaacucgccuuacuuuucagacgacaaagagaacucggaaaccccaacgcaggcaacgaacuugaagcuacgauccugggaaacggcaaccguaaauccggauuauucugggaacaaaagcccccgcuagccggagcggaccuccuaaaaaugcugggcagauguacauuugagaaaaacgaauaccgcgcacccaaagcauccuucacugccgaacgccacguauggcucaccagacugaacaaccuaagaguagugguagacgguacaacccgcucccucgacgacgccgaacaccgacucguacuaccccuaccauacaagcaggcaggagauuucaccuacaagcaacuaagaacagcccugacaaaggcaggacuccugcccgaaggcuucaaguuugcaggccuaagcuacccuaccggccgccaacucgacgacccgaaggcaaaagaccccgaaucagaaaaacucguccgucugccagccuggcaagaacucagaaaaacgcucaaagacaaaaacuuagagacagaaugggagggcauggccggcgcggccaccggcggaaaccccgaacuccucgacgaaauugcacggguccuauccguguucaaagacggagacgaaguaaccgccgagcuauggaaacugccccuaccaggaggaaaggcgaugauagaugcccugucggaaaucuccuucgauaaauuccacgcccuaagccucaaagcccugcgcaaaauaguaccgcacauggagagcggacucagguacgacgaagccugcgcggucgccggcuaucaccauucccaacuccacgcugcgggagcuggugaacacaaauuccuucccccguucuacucccggcgagauaaagacggccgcaugguguucaacgaagaacuagacguccccagaaacccugucguccuucgagcccucaaccaagcgcgaaagguacucaacgcccucguacgcacauauggaucaccuacggccguccauauagaaauggcgagagaccugagcagaccccuagacgaacgaaacaaaguuaagaaagcccaggacgaguaucgagaaagaaacgaaaaagacaaagcagccuucgccgccgaguacggcaucgcacccaagucacgagaauuugaaaaauuucaacucuaccgcgaacaacaaggaaagugcgcuuacagucuaaaaagccucgaccuucaucgcguccuacacgacaucggguacgccgaagucgaccacgcgcugcccuauagucgcagcuaugacgauagcaaaaacaauaaaguacucgcccuaaccgaagaaaaccguaacaaaggaaaccgaacagcauacgaauacuugaccagcuucccgggcggcgagaacggagaaagguggcgcaauuucuccgucgcagucgaaacaaacaaagcauaccgacucgccaaacgcacacgacuccuacggaaagacuucucuggccgcgcagcugaagaauuucgcgaacgcaaccugaacgacacucgcuacaucugccgcuucuucaagaacaccgucgagcgauuucuaaaauuagacgccaaagucggcgccggagacacggccgaaauaagcgcaaaacgaugcgugguacucuccggacaaaccaccgcauucuugcgcgcgagauggggccuacucaaaguccgugguaauagcgaucgacaccacgcccucgacgccgcugugguagccgccugcagccauggaauggucaaaagacucggagauuacuccagaaccaaagaacuggccaagguccaugacggauuccccgacccggaaacaggcgaaaucauagaucccguaauguuccaacaacuacacgcacacuucccugacccuuggccccacuuuagagcggaacucgaggcccgacuaaacguagaugacaccgcggaccuacgcgcgcggauggaacuauucggaacauaugccccagaggcgcucgaaacacucagaccauuauucgugucaagggcaccgcaaaggagaaacagcggagccgcacacaaagacacaaucuacgcacaaccggaacgucucaaagaacaaggcggugucacacaaaaggucccgcugacaucauuaacccucaaagaccucgacaaacuaauagacccccaucgaaacgaaaaacuauacgcggccauccgagccagacuggaagcccacggagguaaagcagauaaagcguucccggcaggcaacccccuuagaaaacccgaccgcgaaggaaaccccacaggcccagucgucagaacaguaacaauggucauugacaaacuaucgggcauucccgugcgcggugguaucgcgaaaaaugacacaaugcuccgaguugacauauuucgccauaagaaagaugguaaauuccaccuaguacccguuuacgucuaccacgccguggcaaaagaauuuccaaaccgggccaucguccaagcaaaagacgaagacgaauggacacucauugacgacaaauucgacuucugcuucuccgcacacccaaacgaccuacucaaaauaacacagaaauccggugaaacaaucuucggcuacuaccguggcugccacagcggaacugcagcaauaaacaucgcgcuccacgacagauacgcauaugcagagaaaacaaccucacuagccuucucgaagaagaaccccggcaaaccaaucccuaacgacaaacucgggcucauagaaggcauaggcguaaaaauggcagccaacauggaaaaguuccacgucgacacccucggaaacauauacccggcacccccagaacaacgacguggacucgcguga

SEQ ID NO: 6334 - RNA, 3441 nt, Artificial Sequence
  Cas9 variant
auggcauaccgccuaggauuagacauuggcaucaccuccgucgggugggccgucgucgcccuagaaaaagacgaguccggacuaaagccaguacgcauacaagaccucggcguacggauauucgacaaagccgaagauagcaaaacaggcgcgucguuagcccuaccccgaagggaggcacgaagcgcccgaagacgcacacgccggcgcagacaccggcucuggcgcguaaaaagacuauuagaacaacacggaauccucagcauggaacaaauagaagcacuuuacgcacaacgaacguccagccccgacgucuacgcccuccgaguagccggacuagaccgaugccucauagcggaagagaucgcacgcguguuaauacacaucgcccaccgacgggguuuccagaguaaccgaaaaagcgagauaaaagacagcgaugcggggaaacuauuaaaagccgugcaggagaacgagaaccucaugcagaguaaaggcuaccgaacggucgccgaaaugcucguuagcgaagcgaccaagaccgacgcagagggaaagcuaguacacgggaagaaacacggauacgucucuaacguacggaacaaagcaggggaguaccggcacacagucucgagacaagccaucguagacgaagugaggaagauauucgccgcacaacgagcacuuggaaaugauguaauguccgaagaacucgaggacucauaucuaaaaauucucugcagccagagaaauuucgacgacggccccgggggagacuccccauacggccacgggagcguaagcccggacgggguaagacaaagcaucuaugaaaggaugguggguagcugcaccuucgaaaccggagagaaaagggcaccucgaagcagcuacucguucgaacgcuuccaacuccucaccaaggucgucaaccucagaauauauagacaacaagaagacggaggaagguaccccugcgaacucacccagacagaacgagcccgagucauagacugcgcauacgaacaaacaaagauaaccuacgggaaacugcggaaacuccuagacaugaaagacacagaaaguuucgcgggccucaccuacgggcuaaaccgaucccgcaacaagacggaagacacaguguucgucgaaaugaaauuuuaucacgaagugcgcaaagcacugcaaagagccggaguguucauccaagaccuaagcauagaaacacucgaccaaaucggauggauacucagcguauggaaaagcgaugacaaccggcggaaaaagcuaucaacccuaggccuauccgacaacgucauugaagaacugcugccgcucaaugggagcaaauucggacaccugucccucaaagccauacgaaagauacuaccguuccuggaagacggcuacagcuacgauguugccugcgaacuagcaggguaccaguuccaagguaagacggaguauguaaagcaaagacugcucccaccccuuggcgagggagaaguaacgaaucccgucgugcgacgggcccucagccaagcaauuaagguaguaaacgcugucaucaggaagcacgggagcccagaauccauacauauagagcuggcgcgggaguuaagcaaaaaccucgacgaaagacgaaaaauagaaaaggcgcaaaaagaaaaccaaaagaacaacgagcaaauaaaggacgagauaagagagauacucgggagcgcccacgugaccgggcgcgacauagugaaauacaaacuuuucaagcaacagcaagaguucugcauguauagcggagaaaaacuagacgugaccagacuauucgaacccggcuacgccgaagucgaccacauaauacccuacggaaucagcuuugacgacagcuacgauaacaaaguacucguaaaaaccgaacaaaaccgacagaaaggaaaccgcacaccacucgaguaucucagagacaagccagagcaaaaggccaaauucauagcccuaguagaguccauaccgcuaucacaaaagaaaaagaaucaccuccucauggacaaacgagccauagaccucgaacaagaaggguucagagaacggaaccucagugacacgcgguauaucacgcgagcgcuaaugaaccacauccaagcguggcuccuauucgacgaaacagcgucaacaaggucaaaaagagucgugugcgucaacggcgccguaacggcauacaugagagcacgguggggacuaaccaaggaccgugacgcaggagacaaacaccacgcagccgacgccgucguaguugcgugcaucggcgacucacuuauccaacgcgugacaaaguaugauaaauucaaaaggaacgcucuagcugaccgcaaccgauacguccagcaagucagcaaaagcgaagggauaacccaauacgucgacaaagaaacgggggaaguauucacaugggaaucauucgaugaaaggaaauuccuacccaacgaacccuuagaaccauggccauucuuccgggacgaacuccucgcaaggcuaucggacgacccauccaaaaauaucagagccaucggauuacugacauacucagagaccgaacaaauagacccaauauucgucuccaggaugccaacgcgaaaggucaccggggccgcccacaaagagacaauaaggagcccccgcauagucaaaguagacgacaacaaaggaacggagauacaagucguaguaucaaaagucgcccucacagaacucaaacucaccaaggacggcgaaaucaaggacuauuucagaccagaagacgacccccgccucuacaacacccuccgagagcggcuaguccaauucggaggcgacgcgaaagcagccuucaaagagcccguguacaagaucagcaaagacggcuccgucagaacgccagugcgaaaagugaagauccaagagaaacucacgcucggcgugcccguccacggcggcagaggaaucgcggaaaacggcggcauggugcgcauagacguauucgcuaaaggagggaaauauuacuucgucccgauauauguagcggaugucuugaagcgcgaacucccuaauagacucgcgacagcucacaaacccuacagugaauggcgggugguugacgacucguaccaauucaaguucagcuuguacccgaacgacgcagucaugauuaaaccaucacgggaaguagacauaacauacaaagaccgcaaagaacccgugggaugucggauaauguacuucgucagugccaacauagcaagcgcaagcauaagccucagaacccacgacaauagcggagagcuagaaggccugggcauccaaggccuagaggucuucgaaaaauacgucgugggcccccuaggagacacacaccccguuuacaaggagagaagaaugccauucaggguagaaagaaaaaugaauuga

SEQ ID NO: 6335 - RNA, 3441 nt, Artificial Sequence
  Cas9 variant
auggcauaucgacugggccuggacaucggcaucaccagcguaggaugggccguaguagcccuugagaaagacgaaucuggacuaaaacccgucagaauacaagaccugggaguacgaauauucgauaaagccgaagacucgaaaacuggcgccagccuggcgcugcccagacgcgaagccaggucagcgagaaggcgaacacgacggcgacgccauaggcuauggagaguaaagagacuacuagaacaacacggcauacucuccauggaacagaucgaggcacuauacgcccaaaggacgagcaguccagacgucuacgcacuaagaguggccgggcuagacaggugccuaaucgccgaagaaauagcucgaguacuaauccacauagcacaccgccguggcuuccaauccaaccgaaagagcgaaauaaaagacucagacgcaggaaaacugcucaaagccgugcaagaaaacgaaaacuugaugcaaagcaaaggcuauaggacagucgcagagaugcuagucagugaagccaccaaaaccgacgccgaaggaaagcuaguacacggcaagaaacacgguuacguaagcaacguaagaaacaaggcuggagaauaccgacacacggugucaagacaggcaaucguagacgaaguacgcaaaauuuuugcggcgcagcgagcccucggaaaugacgucaugucagaagaacuugaagacuccuaucugaaaauacuauguucgcaaagaaacuucgacgacggaccaggcggcgacuccccauauggccacggcagcgucucaccagacggaguacgccaaucgauauacgaacgcaugguaggcagcugcaccuucgaaacaggagagaagagagcaccaagaagcagcuacucauucgagagauuccaacuauuaacaaaagucgugaaccuccgaauauaccgacaacaagaagacggaggcagauauccgugcgagcucacgcaaacagaaagggcaaggguaauagacugugcauacgaacaaaccaaaaucacauacggcaagcuacggaagcuccuggacaugaaggacaccgaaucauucgcuggacucacguacggacuaaaccgaagccgcaacaaaacagaggacacaguauucguagaaaugaaguucuaccacgagguccggaaagcgcuacaaagagcagggguauucauacaagaccugagcauagaaacccucgaccaaauaggauggaucuugagcguauggaaauccgaugacaaucgccggaagaaacucucaacacuaggacuauccgacaacgucaucgaggagcuacuaccacucaacgggagcaaauucggccaccugagccuaaaagcuauccgcaaaauacuucccuuccuagaggauggauacagcuaugacguagcaugcgagcuagcgggauaucaguuccaaggaaagacggaauacguaaaacaaaggcuccugccaccacuaggagaaggagaaguaacaaacccagucgugcgccgagcgcucucgcaggcgaucaaaguaguaaacgcgguaauacgaaagcacggaucgcccgaguccauccacauagagcucgcacgcgaacucaguaaaaaccucgaugagagacgaaaaaucgaaaaagcacaaaaagaaaaccagaaaaacaaugaacaaauaaaagacgagauccgcgaaauacugggaucagcucaugucacaggacgagacauaguaaaguacaaacucuucaaacaacaacaagaguucugcauguacucgggcgaaaagcuagacgucacacguuuauucgaaccaggauacgcagaaguagaccacaucauaccauacgggauauccuucgacgacucguacgacaacaaagugcuugucaagacagaacaaaacaggcaaaaaggaaaccggacaccacuagaauaccuccgcgacaaaccggaacagaaggccaaauucauugcacucguagagagcauaccacucagccaaaagaagaagaaccaucuacugauggacaagagggcaauagaccuagagcaagagggcuuccgcgaacgaaaccuaucagacacccgauauaucacccgcgcgcuaaugaaccacauccaggcauggcuacucuucgaugaaacggcaagcaccagauccaaaaggguagucugcgucaacggagcaguaacggccuauaugcgagcccgaugggggcuaacuaaagaccguaacgcaggagacaagcaccaugccgcggacgcaguaguuguugcaugcauaggagacagccugauacagcgaguaacaaaguacgacaaauucaaacgaaaugcccuggcagacaggaaucguuacguacaacagguuucaaagagcgaggggauaacgcaauacguagacaaagaaacgggcgaaguguucacaugggagaguuucgacgagcgcaaauuucuacccaacgagccgcucgagccauggccauucuucagagacgaacugcucgcgcggcugucagacgacccgucuaaaaacauacgagcgauaggccuacucacauacagcgaaacggaacagaucgaccccauauucguuagcaggaugccgacacggaaaguaacaggcgccgcgcacaaagaaacaauccggaguccccgaauagucaagguugacgacaacaaaggaacagagauucaaguggucguaaguaaaguggcccuaacagagcucaaacucaccaaagacggcgaaauaaaagacuacuuccgacccgaagacgacccuagacucuacaacacgcuaagggaacgccuaguccaauucgggggagacgcuaaagcagcauucaaggaaccaguguacaaaauaucaaaagauggauccguccgcacaccaguaagaaaaguaaaaauucaagagaagcucacgcugggcguacccguacacggaggaagggggaucgccgagaacgggggcaugguucgcaucgacguuuucgcaaaggauggcaaauacuacuucgugcccaucuacgucgcggacguacucaaaagagagcucccaaaccggcucgcgacggcacacaaaccuuacucggaauggcgggucguggacgacagcuaucaauuuaaauucagccuauaccccaacgacgccguaaugaucaagccaagcagagagguagacauaaccuauaaagaccgaaaagaaccaguaggacuacgucuaauguacuucgcaggcgcagauaucuccggggccacgcucacgcuacgaacccacgacaacagcggagaacucaagggccuaggcauacagggacuagaaguguucgagaaguacgucguaggaccccucggcgacacacacccaguguacaaggaaagacguaugccguucagagucgaaagaaaaaugaacuga

SEQ ID NO: 6336 - RNA, 3447 nt, Artificial Sequence
  Cas9 variant
augacgaaacuaaaccaacccuacggcauaggccucgacaucggcucaaacuccauaggauucgcaguugucgacgccaacagucaccuccuccgccuaaaaggugaaacggccaucggagcccggcuguuccgcgagggacaaagcgccgcugaccgccgcggaucgagaacaacacgacgccggcucagccguacacgcuggagguuguccuuccuccgagacuucuucgcaccccacaucacuaaaaucgacccagacuucuuccugcgacaaaaauauagcgagaucucacccaaagacaaagaccgauucaaguacgagaagcgacucuucaacgaccggacggacgccgaguucuaugaggcuuaucccucgauguaucacuuacgacucaggcucaugaccgaugcaagccaggccgaccccagagaaauauuccuugccauccaccacauccucaaaucacgugggcacuuccucacccccggggcagcaaaagacuucaauaccgacaagguagaucucgaagauaucuuccccgcccucaccgaagcguaugcgcaaguauauccagaccucgaacucacuuucgaucuagccaaggccgacgauuuuaaggcgaaacuacucgacgaacaagccacccccucagauacacagaaggcacuggucaaccuacuccuauccucagacggagagaaagaaauuguuaagaaacgaaaacagguccucacugaauuugccaaagccauaaccggccucaaaaccaaauucaaccucgccuuaggaaccgaagucgaugaagcagacgcuuccaacuggcaauucucaaugggccagcuugacgacaaauggucgaacaucgagaccagcaugaccgaccaaggcaccgaaaucuucgaacaaauccaagaacucuaccgugcucgacuccucaacggaaucguaccagcaggcaugucgcucagucaagccaaagucgcggacuacggacagcacaaugaagaccuugaacucuucaagacauaccucaagaaacucaacgaccaugaauuagcaaaaaccauccgcgucauauaugaccgauacauaaacggagacgacgcaaaacccuuucuaagagaagacuuugucaaggcacucacuaaggaagugacagcccaccccaacgaggugucagaacaacuccuaaaucgcaugggccaagcuaacuucaugcucaaacagcgcacuaaagccaacggugcaauccccguccaacuccaacaacgcgagcucgaccaaauaauagccaaucaaagcaaguacuacgacuggcucgccaaaccaaacccugucgaaaaacaccgugcuucgaaacccuaccaacuugacgaacuccuuacguuccgcauccccuacuacgucggcccccucaucacccccaaagaacaagcaaaauccggcgaaaacguguucgcuuggaugguccgaaaagaccccuccggaaacaucacucccuacaacuucgacgaaaaaguagaccgagaagccuccgcaaacguuuucauacaacgaaugaagacaacggacaccuaccuaaucggggaggauguccuaccuaagcagucacucuuauaucagaaauacgaaguccuaaaugagcucaacaauguccgcguaaacaacgaagcccucggcacggaccaaaaacaacgucucauccgcgaaguauucgaacgacacagcuccgugaccaucaaacaggucgcagacaaccugguagcgcacggcgacuucgcccaacgcccagaaauccgcggacuagcggacgagaaaagguuccucagcucuuugagcacauaccaccaacucaaagaaaucuuacacggcgccaucgacgacucgaccaaacuacacgacaucgaaaacaucauuacguggagcaccgucuucgaagacgccgcaaucuucaagaccaaacucgcggagaucgacuggcuagaugcagccacgaucaagaagcucucuaacauccgcuaccguggcuggggucaauucucucgcaaguugcuagacggacucaaacucggcaacggccagacaguaauccaggaacucaugcuaucaaaccacaacuuaaugcaaauccuaacagaugaaacccucaaaaccacaauggccgaacucaaucaagacaaacucaaggcggacgacaucgaagacguaaucaacgacgccuacaccucccccuccaacaagaaagcccuccggcagguccuucgagucguggaagacaucaaacacgcggcaaacggccaagacccgagcuggcucuauauagaaacagcugacggcccaggcaccgcgggcaaacggacucaaucacggcaaaaacaaauacagaccgucuacgcgaacgcagcccaagaacucauagacucagcaguccgcggcgagcucgaggacaaaauagccgacaaagccagcuucacagaccgguuaguacucuacuucaugcagggaggccgcgacauauacacuggagcgccccucaacaucgaccaacuaucgcacuacgacauagaccacauccuuccgcaaucacugaucaaggacgauagucuagacaaccgcguccuggucaaugccaccaucaaucgcgaaaagaacaacgucuucaccucgacccucuucgcaagcaaaauggcagcaaccuggagaaaauggcacgaagccggucucaucuccggucgcaaacucagaaaccucaugcugcgaccagaugaaauagacaaguuugcccacggcuucgucgcacgacagcucguagaaacacgucaaaucauaaaacuuacugaacaaaucgccgccgcccaauacccgaacaccaaaaucauagcuguaaaagccggucuuucccaccaacuacgggaagaacuugacuuuccgaagaaccgugacguuaaucacuaccaccaugcguucgacgcauuccuagccgcucgaauaggcaccuaccuccuuaaaagauacgcuaaacucgcuccuuucuuuaccuacggcgaauuugcaaaaguggacgugaagaaauuccgagaguucaacuucaucggcgcccugaaacacgcaaagaaaaauaucguugccaaagacaccggcgagaucgucugggacaaagaacgugacauacaagagcuagaccguaucuacaacuucaaacgcaugcuuaucacacacgaaguuuacuucgaaaccgccgaucuguucaaacaaaccaucuacgccgcaaaagacucgaaagaacgaggagggagcaagcaacuaauacccaagaaacggggguaccccacacaggucuacggcggcauucacggcaagauccgacucaccuggcgcuggcucaagcuacuuagaagaaagaagauguccaucgaacuaucagagcuucaacucuuaaaguga

SEQ ID NO: 6337 - RNA, 3450 nt, Artificial Sequence
  Cas9 variant
auggaaagauaccacauaggacuagacauaggaacaagcagcaucggaugggcugugauaggggacgacuucaaaaucaaacgaaagaaagggaaaaaccuaaucggcgugcgucucuucaaagaaggcgacacagcagccgaaagaagggguuuucgcacccaacggcguagacucaaccgaagaaaauggcgucucaaacuacuagaagaaaucuucgaccccuacauggccgagguggacaaauacuucuuugcgcggcuaaaagaaaguaaccucuccccaaaggacaguaacaagaaauaccuggguucccuacucuucccagacauaagcgacucaaauuucuaugacaaauacccaacgauauaccaccuacgccgggaucucauggaaaaagacaagaaauucgaccuacgugaaauauaucuagccauccaccauaucgucaaauaccgcggcaacuuuuuggaaaaagugcccgccaaaaacuacaaaaacucaggcgcaagcauaggcuuccuccuugaagaaguuaacgaccuauauggcaacaucaucggaaacgaggacguagcaauccucgacaacgacaaguuugaagacgucgagaagaucauacugaaugacgagauacgcaacaucgacaaacaaaagaacgucgggcggcuccuaguuaaagacaagaaagagaaaaacauagucacagcauucaguaaagccauauuuggguacaaguucaaccuagaagaccugcuucuaaucgaaagugacgagaaaaacaaacuuacuuucaacgaugaaaacaucgacgacauauucaacgaacucucccacagccuaaacgacaaccagauggaccuccucacgaaaacccgagagaucuacuucaaauuuaagcucaacaugauaguacccacaggauacacaauaucagaauccaugauagagaaguacgagaugcacaaagcacaccucaagauguacaaggaguucauaaacacccugaacgcuaaggaccgcaaaauccucaagaaugccuacagcgacuacaucaacaacgaaaaagcaaaagccgcuaacgcacaagagaacuuuuacaagaccgucaagaaaacaaucaaagaaaacgacucagacaccgccaagaaaaucaucggccucauagacgaaggcaacuuuaugccaaaacagcgaaccggcgaaaacggcguuauuccccaccaguuacaucagaucgagcuugaccgcauaauagagaaccaggccaaauacuacccguggcuggcagaggaaaacccaguggaaaagaaccgaaaauuugcgaaauacaaacucgacgagcuagucaccuuccggguucccuacuacgucggaccccucaucgauaaaaccgaauccaacaaaaacgaaaaagaaaccaaauucgccuggaugguccgcaaagcaaaagggacgaucacacccuggaacuucgaaaaccuggucgaccgcacagaaucagcgaaccgguucauaaagagaaugacuucuaaagacaccuacaucauaggagaagacgugcucccagccagcagccuucuuuacgagaaauacaagguacuaaacgagcugaacaacauuaagguaaacaaaaagaaauuggacgucgagcaaaaacaacacgucuaccucgaccucuucacaacccgcaaaaacgucaccaaggacgaccucgccacaagucuuaacugcgacgucgagucgaucaccggacugacagacaauaagaaauucaacagcagccucuccuccuauauagaccugaaagcaauacugggcaacaucguagacgacuacaguaaaaacgaggaccucgagaaaauaauugaauauuccaccaucuucgaagacgggaacaucuacaaagagaaacuuucggaaaucagcuggcuuacggacgaacaaauagaaaaacugagcaacauacacuucaaaggguggggccgacugucuaagaaacugcuaacccaaaucacaaaugaaaacggagaacgaaucaucgacacucucuggaacacguccaacaacuucauacaagucaucagcgacgaauccauccaagcaaaacucgccgaaaucaacggcgaauacgccaacaaauacaaccuagaagacauacuagacgaagcguacacaagcccccagaacaagaaagccauuagacagguaaugaaggucguagaggacaucgagaaagcaaugaagugugaaccgaccagcauagccaucgaguucacgcgcgagaaaagaaaaucgaaacugacuaacacuagauauaagaaaaucuccgaaaccuacgagaaaaucacagacgaacucaucagugaauacgagcuaggcaaauuacagagcgaacuugacucgaagguaaacaacaugcgcgaccgcuauuaucuauacuucaugcaacuaggccgcgacauguauaccggggagaaaaugaacaucgacgaacuucaccaaaaauacgauaucgaccauaucuugccccagucauucaucaaagacgacucacucaacaacagaguccucaccuccaaaagcgucaauaucaaggaaaaguccgacaaaacagcugccgaccuguacgcggcaaagaugggugacuucuggcgcaaguuacggaaacaaggccuaaugacagaacaaaaguacaagaaccuauuaacgcgcacggacagcauaaauaaauacaccaaacaguccuucaucaagagacaacucgucgagacgucgcaggucgucaaguuggcugccaacauucuccaagacaaauaucgcaacacgaaaauuaucgagaucagagcccgccugaacagcgaccuccgcaaaaaguacgagcuaaucaagaacagggaggucaacgacuaccaccacgcgauugacggauaccuaaccacauucgucggccaauaccuauacaaggucuauccaaagcugcgaagcuacuucguauacgacgacuucaagaaauuggacucgaacuaccucaaacacauggacaaauucaacuucaucuggaaacuugaggauaagaaagccgaagacguguacgacaaagucaacgacgaguucgugcugaacguccccgaaaugaaagaauacauccgcaaaaucuacaacuauaaguacauguuggucucgaaggaaguaaccacgaaaaacggcgcauucuacgaccaaacaaaauacaacgccaagacaaucaaccuaauaccaaucaagaaagacaaaccuaccaacaucuacggagguuacaagggcaaaguauccagcuacaugaugcucgucaagauccagaaaaagaaagaagucaucuacaaguucguaggagugccacgacucuggaccgacgaacuugaccgucugauagauacagacgaaaagaaggcccucuuaaagaaauga

SEQ ID NO: 6338 - RNA, 3459 nt, Artificial Sequence
  Cas9 variant
augaacgcggaacacggaaaagaaggucuccuaaucauggaagaaaauuuccaguaccggauaggccuagacaucgggauaacaagcgugggaugggcaguacuacagaacaacucucaagacgaaccaguacgaaucacggaccucgggguucguaucuucgacguagccgaaaaccccaaaaacggcgacgcgcuagccgcuccacggcgagacgcacgaacaacccggagacgacuuagaagaagacggcauagacuugaacgaauaaaauuccuacuccaggaaaacggccucauagagauggacuccuucauggagagguacuacaaaggcaaccugccugacguauaccaacucagguacgaagggcucgaccggaaacuaaaagacgaagaacucgcacaagugcuaauccacauagcuaaacaucggggcuucaggagcaccagaaaagcagaaaccaaagagaaggaagguggagccguacuaaaagcaacaaccgaaaaccagaaaaucaugcaggaaaaaggguaccgcacgguaggcgagaugcucuaccuugacgaagcguuccacacagagugccuuuggaacgaaaaaggcuacgugcuaacaccaaggaacagacccgacgacuacaaacacaccauacuaagaagcaugcuagucgaggagguucaugcgauauuugcagcgcaaagagcgcacggcaaccagaaagcaacggaaggccucgaagaagcguacguagaaaucaugaccucucagaggagcuucgauaugggacccggacugcaaccggacggaaagccaucacccuacgccauggaaggauucggggaccgagugggaaagugcacauucgaaaaagacgaguaccgcgcaccuaaggcaacguacacggccgaacucuucguagcacuccagaaaauaaaccacacaaaacuuauagacgaauuugggacaggccgauucuucagcgaagaggaaagaaagaccauaauaggccuucugcuuucgucaaaggagcuaaaguacggcacaauaaggaagaaacuaaauaucgacccaagccucaaauucaacagccucaacuacagcgccaagaaagagggcgaaacagaggaggaacgagugcuagacaccgaaaaagcaaaauucgcguccauguucuggaccuacgaguacagcaaaugccucaaagaccgcaccgaggaaaugccagucggagaaaaagcagaccucuucgaccgcaucggcgaaauccucaccgccuacaagaacgacgacagccgcagcucccgauugaaagaacuuggccucuccggcgaggagaucgacggcuugcuagaccucucaccggcgaaauaccaaagaguaagccuaaaggccaugcgcaagaugcaacccuaccuggaagacggacucaucuacgauaaggccugcgaagcggccggcuacgacuuccgcgcccucaacgacggcaacaagaaacaccucuugaaaggcgaagaaauaaacgcaauagugaacgacauaacaaacccggucgugaaacgaagcguaucacaaaccaucaaaguaauaaacgcaauaauacaaaaauacggaagcccgcaagccgugaauaucgaacuagcgcgagaaauguccaagaacuuccaagaccgcacuaacuuagaaaaggaaaugaaaaagaggcagcaagagaacgagcgcgcaaaacaacagauaaucgagcuaggcaaacagaauccaaccggccaagacauccucaaauacagacuguggaacgaccagggaggcuacugccuauacagcggcaagaaaaucccccuggaagaacucuucgacgggggauacgauauagaucacauccuaccauacaguauaacauucgaugacucguaccgaaacaaaguccuaguaacagcccaagaaaacaggcaaaaggggaacaggacccccuacgaauacuucggcgcggacgaaaaacgcugggaggacuacgaagcaucaguaagacuccugguucgggacuacaagaaacaacaaaaacugcucaagaaaaacuuuacagaggaggaacgcaaagaauuuaaagaacgaaaccuaaacgacacaaaauacauaacacgcgucguauacaacaugauucgccaaaaccuggaacuggaaccauucaaccacccagagaaaaagaaacaggucugggccguaaacggcgccguaacaagcuaccucagaaaacgcuggggccugaugcaaaaagaccgcuccaccgauagacaccacgccauggacgccguaguaauugcgugcugcacagacggcaugauacacaagaucagccgguauaugcaaggaagagaacuagcauacagucgcaacuucaaauucccagacgaggaaacgggggagauccucaaccgagacaacuucacccgagagcagugggaugaaaaguucggagucaaagucccacuaccguggaacagcuuccgggaugaacucgacauccgccuccuaaacgaggacccaaagaacuuccuccucacucacgcugacguccaaagggagcuggacuaccccggguggauguacggcgaagaggagucaccaauagaagagggacgauacauaaacuacauacgccccuuauucgucucaagaaugcccaaccacaaagucacggggucugcacacgaugcuaccauacgaucagcacgcgacuacgaaaccagaggggucguaauaacaaaagucccccuaaccgaccuaaagcucaacaaggacaacgaaaucgaaggauacuaugacaaggauucggacaggcugcuguaccaagcccuagugcgccaacuacugcuacacggaaacgacggaaagaaagcguucgcagaggacuuccacaaaccaaaagccgacggcaccgaagggccggucguuagaaaagugaaaauagagaagaaacaaacaaguggagucaugguccgcggagggacggguaucgccgccaacggcgaaaugguccgcauagacgucuuccgagagaacggcaaauacuacuucguacccguguacaccgcugacguaguaagaaaggugcuuccaaaccgcgccgccacacacacaaaacccuacagugaauggcgcgucauggacgaugcaaacuucguguucagcuuauacagcagagaccucauccacgucaaaagcaaaaaggacauaaagacaaaccuagucaacggcggccuccuacuacagaaggagaucuucgcguacuacacaggugccgacaucgcaacagccucaaucgcgggauucgcgaacgacucgaacuucaaauuccgaggccugggaauccaaucacuagaaaucuucgaaaagugccaaguagacauacuggggaacauaucaguaguccgccacgaaaaccgacaagaguuccauuga

SEQ ID NO: 6339 - RNA, 3462 nt, Artificial Sequence
  Cas9 variant
augaaaaacauacuagggcuagaccuaggacucaguagcaucggaugguccguaauuagggaaaacucggaggaacaggaacugguagcaaugggaagccgagucgucagccuaaccgccgcagagcugagcagcuucacccaaggaaacggggucagcauaaacucgcaacgaacccaaaaacggacacaacgaaagggauacgaccgcuaccaauuacgacgaacccugcuuagaaacaaauuagauacucucggcaugcuccccgacgacuccuugucauaccucccaaaacuccaguuaugggggcugcgggccaaggcggugacccaaaggaucgagcuuaacgaacucggacgcguccuccuccaccugaaccagaaacgaggcuacaaaagcaucaaaagcgacuucagcggugacaaaaagaucaccgauuacgugaaaaccguaaaaacccgauacgaugagcuaaaggagaugaggcucacgaucggagagcuauucuucagacgccuaacggagaacgcauucuucagaugcaaggaacaaguguaccccaggcaagccuacguagaggaguucgacugcauaaugaacugccagcguaaguucuaccccgacauccucaccgacgagacgauccgaugcauccgcgacgaaaucaucuacuaccaacguccccugaaaucguguaaauacuuggucucgcgaugcgaguucgaaaaacgcuucuaccucaacgcagcaggcaaaaagaccgaggccgggcccaaagucucaccuaggacuagcccccuguuccaaguaugccggcugugggagagcaucaacaacaucgugguaaaggacaggcgaaacgagauagucuucauaagcgcagagcaacgcgccgcccuauucgacuuucuaaacacacacgagaagcucaaaggauccgaucuccuaaagcugcucggccugagcaaaacauacggguacagacuaggugaacaguuuaagacgggaauccaagggaacaaaacgcgggucgaaaucgaaagagcacucgggaacuauccagacaagaaacggcugcuccaguucaaccuacaagaggagucuaguuccauggugaacacagaaacaggagaaaucauucccaugauaagucuauccuucgaacaggagccacuauacagacucuggcacguccuguacagcaucgacgaucgagaacaacuucagagcguucugcgacaaaaauucggcaucgacgacgacgaagugcuggaacgccuauccgcaaucgaccuuguaaaggcgggcuucgggaacaaaaguucgaaggcuauacgcaggauucugcccuuccugcaacuagguaugaacuacgcagaggcgugcgaagcagcaggauacaaccacucaaacaacuacaccaaagcggaaaacgaagcgcgagcgcuacucgaccgguugccggccauuaagaaaaaugaacuacggcagcccguagucgagaaaauauugaaccaaauggucaacgucgucaacgcccuaauggaaaaguacgggcgauucgacgaaauccgcguugaacuagccagggagcuaaaacaaaguaaagaagaacggagcaacaccuacaaguccaucaacaaaaaccaaagagaaaacgaacaaauugccaaacgcaucguggaauacggcguacccacgagaucacgcauccaaaaauacaaaaugugggaggaauccaagcacugcugcaucuacuguggccaacccguggacgucggcgacuuccuucgcggguucgacguagaagucgaacacauaauccccaaaagccucuacuuugacgacuccuucgccaacaaagucugcucgugccgaagcuguaacaaagagaaaaacaaccgcaccgcauaugacuacaugaaaucaaaaggggaaaaagcacucucagacuacguggaacgcgucaacaccauguacacgaacaaccaaauaagcaagaccaaauggcaaaaccuacuaacccccguugacaaaauaucgaucgacuucaucgaccgccaauugcgcgaaucgcaauacauagcccggaaagcgaaagaaauccucacaagcaucugcuacaacgucacagccaccagcgggagcguaacaucuuuccugcgacauguauggggcugggauaccguccuccacgaccuaaacuucgaccgauacaagaaaguaggacucaccgaaguaaucgaggucaaccacagaggcucagucaucagacgagaacaaaucaaagacuggagcaaaagauucgaccaccgacaccacgcaauagaugcccugacaauugcaugcaccaaacaagcauacauccagcgacuaaacaaccuacgcgccgaagagggaccagacuucaacaaaaugucgcuagaacgcuauauccaaucacaaccacacuuuagcgucgcacagguccgagaggccgucgaccggauccuggugagcuuccgcgcaggcaaacgcgccgugacaccaggaaagcguuacauacgcaaaaacagaaaacgaauaagcgugcaaucggugcucaucccccggggcgcccuuuccgaagaaucggucuacggggugauccacgucugggaaaaagacgaacaagggcacgucauccaaaaacaacgagccgucaugaaauaccccauaaccuccaucaacagagagaugcuagacaaagaaaaagucguagacaagcgcauacaccgcauccuauccggacgacuagcccaguacaacgacaaccccaaagaggcuuucgcgaaacccgucuacaucgacaaagaaugccggauucccauaagaaccgucagaugcuucgccaaaccggcgauaaacacacuuguaccccuuaagaaagacgacaaaggcaacccggucgcauggguaaacccagggaacaaccaccacgucgccauauauagagacgaagacgguaaauacaaagagaggacaguaaccuucugggaagcugucgaccgaugccggguaggaaucccagccaucgucacccaacccgacacaauaugggacaacauauuacagcggaacgacauuucggagaacguacuggagucccugccggacguaaaauggcaguuuguccuaagccuccagcaaaacgagauguucauccucggcaugaacgaagaggacuaccgauacgcuauggaccagcaagacuacgcccuacuuaacaaauaccucuaccgaguccagaagcugucaaaaucagacuacucguuucgcuaccauaccgaaaccagcguagaagacaaauaugacggcaaaccgaaucuaaagcucagcaugcaaaugggcaaacugaaaagggucucaauaaaaucccuacuuggacuaaacccacacaagguccacaucuccguacugggggaaauaaaagaaaucucauga

SEQ ID NO: 6340 - RNA, 3474 nt, Artificial Sequence
  Cas9 variant
augaacuacuacaacggguucaucauaacagagaacgcuaugacgucaaaacaagaaaaacacggcgcacuaacauucggacuagacauaggaauagcaucaguggggugggcuguacuaggggaaucgcgaaucgucgaccucggcguacgcugcuucgacaaagccgaaaccgccaaagaaggcgagagccugaaccucaccaggcgcauggccaggcuccuccgcaggcggcugcgccgacgagccuggcgucucacgaaauuagcaagguuacuaaaaagagaaggccucaucgcggaugccaaccucuucaaacacaagaucgaaaagaacacgccgguacccaaaucaagcuggcagcuucgcgucgacggccucgaccgacaacugaacgcggaagaaugggcccgagugaucuaccaccugugcaaacaccgcggcuuccacuggaucagccgggcugaagaaaaagcggccgaaggagacuccaaaggcgaaggcggaaaaguaaagcaggggcuugcaggcaccaagaaacuaaugcaggagaaaagcuaccgcacagcagcagaaaugguacuagccgaguucccggacgcccaacgcaacaaacagggggacuacagcaaagccuuaagccgcauccuacugggcgaugaacucaaagcccuauucgagcaccaacgcaaacuaggaaacccaguagccaccgaaaaacucgaagcggccauccucggcaacggggacaagaaaugcggacuguucugggcccaaaacccagcgcuagcgggaaacaaacugcucgaaaugcuugggcgcuguacguuugaaaagaccggcggagaugauggaaagggcgaauaccgagcccccaaagccucauucuccgcugagagacaugucuggcucacccaccucaauaaccuccguaucguaguagacggcaccacaagaccacuaaacgaagccgagcgcaggguagcacugccgaugccuuaccagcaagcaggagaccuaagcuauaaacagcuaggcggagcucugauaaaagaaggcuuccuacagaaagacggauucaaauucgcgggcuuacccuacccaacaaaacaagccagcgaagaaaaagccaaagacccagagacauccguccuuugcaaacucccagccuggcauacgcuaagaaaaacacuagaaaagcacggucucgagagcgaauggcagaagcuauccacagacgcccuggacggaaagccucaacugcucgauaacauagccugggugcucagcguguacaaagacgacgaugaaguuaaaaccgaacucggcaaauuaaaccucccgaacacagagaaaaugauagaugccuuacuagacauacgauucgacaaguucucaaaccuuucccucaaagcccuaagcaaaaucgugccauucauggaacaaggacagagauacgacgaagcgguagcgaacauaccugaauauggacaccacucacaacuccauaaaguuggcgcgggagaacacaaauaccuaccaccguuuuacaaagaacgggacaaaacaggacggauggucuucaacgacgacauggacaucccgagaaacccagucguucugcgagcccugaaccaagcacgcaaggucgugaaugcccucauaaaagaauacgggagcccacacgagguacacaucgaaauggcgcgagaccuaucaaggccgcuagacgaaagaagagauaucgaaaaacuacaaaaagaguucggagaacgaaacaaaaaggacaaggaacucuucgcgcaagacuucaacauagucgggacaguaaaggggaaacaauucgaaaaauaccaacuuuaccgcgaacaacaaggcaagugcauauacccauccauggacgagaagcagggcaucugcuguuacucgcugaaaccccucgaccuccaccgcguacucuacgaagagggauacgcggaaaucgaccacgcacuacccuacucgcgcagcuuugacgacuccaaaaacaaccgagugcuaguacuagccaaagaaaacagggacaaaggcaaccgcacacccuucgaauacuuaggagacaaggacaauucagaacccuggcgccaauucguagcguucguagaaggaaacaaggccuaccgccucgccaagagaagccgccugcuccgcaaggacuucggcgacaaagaagccaaggaguucagagaacgaaaccugaacgacacacgcuacaucuguaaguucuucaaaaacuacguagaacaauaccuccaacuucacgaagacagugaagccaaacggugcguagugcuaagcggacaaaugacguccuuccuccgcgcacgauggggccuagucaaagugcgcggagacuccgauagacaccacgcacucgacgcggccgugguggcggccugcagccacggaaugguaaaacgucuauccgauuacucccgucgaaaggaacucgagcaagugcgcgagggcuucguagacguggacacuggggaaauagucaaccccgccauguuccagcaagugcaggaacacuuccccaacccguggccacacuuccgcgacgaaguaaagcuccgacuaagcaucgacgaccccacccuacugagaucggaaauggaaaaguucggcacauacacuccggaaucacucgaagcucucagaccccuauucguaagcagggccccacaacgacgaaacagcggcgccgcacauaaagauacaauauaugcacaaccaaaacggcucguggcccagggcggagugacccaaaaagucgcacuuucaucgcucacacucaaagaccuagacaaacugauagauccacaccggaacgagcgccucuacgccgcaauccgagcacgccuugaacagcacggaggaaaaggagacaaggccuucccagcaucgaacccacuccgaaagccagacucagaaggaaaccccacaggaccaaucguacgaggcgugacgaugguuauagacaaacuguccggcauuccaauccguggaggaauugcuaaaaaugacucaauggucaggguggacguauucaccaaggcaaacaaauuccaccuaguacccgucuauguacaccacaguguccuaggacuccccaaucaagcaaucgucggcggcaaggaagaaagcgaauggacucaaauugacgauagcuuugacuggcacuucagcauauacccgaacgaccucauaagggucacccuaaagcaggagggccgcuucggauauuacgcgggcugcgacagaagcaccgccgccauacacuugugggcucaugacagaaaccagcaagugggcaaagacggacucauccguaguauaggggugaagaccgcguuaagcauugaaaaauucaacgucgacguccuagguaauagguacccugcaccacccgagaaaagacgagaccuagcauga

SEQ ID NO: 6341 - RNA, 3486 nt, Artificial Sequence
  Cas9 variant
augaagaaaauccuagggcucgaucucgggucggcaucgauuggcugggcacuuguagaagaaaccgagcagaugcaauacaacaucgugucccuagggagccgcaucaucccauacaauggaacggaaggccaagaguucgaaaaagggacaggcgaaucgagaaacagccuacggacgaaagcgcgcaccgcaagaaaaggauacgacagauaucaacuacgccgcaagaaccucgagaaaauccuacuacaaaauggcauguaccccaacgaacaagucagagcccuacagaagcuagaacucuggaagcugagggccgacgccccuaacguacaaauaucccucccggaacucgggcgacuacuguuuuggcuaaaucaaaagcgagguuacaaaaguagcagaagcgacgcaaaccucgacaagaaagacacggaauacguagcgaccguuaaaagccgacaccagaaaaucaaagacgcaggccaaacaguagggcaauacuuuuacggacaaauacuagaaaacgaauaucaccgaaucaaggaacaggucuucccccgcgaagcauacauugaagaauuugacgcgaucgucgcgcgccaaaaagaauacuacccaacaauccucaagcaggaacugauagacaaaauccgcaacgaagucaucuacuuucagcgaggccucaaaagccagaagggacucguauccgugugugaguucgaagggcgcgaguucaacggacacuucggaggaccuaaaguggcccccaaaagcucaccaaucuuccagcuaggcaaaauaugggaaaacaucaacaacaucaagauagcagacauagaauuaaccgcagaacagaagcuaguguucuucaacuaccucaauugccacgaaagaauaacagaagccaaaauccgagaacuccuaaaacucagcaaagacucacgacucaacggacaacugaaaaacggacuaaccgggaacaaaaccuacucccagaucgccagcugcuucggaaacaaaaucggagaauacgaacgccuauucaaauucgaauuagaagucauugaaagugaaaaacuagaguacaccuaucaucccaaaucacacauuccagugggcgagaaacgacgcaaauacaucagugaaaacgucgaaaaagagcccuacuaccggcuguggcacaccauauauagcauaaaagacaaagacgaaugccgagccgcucucaucaagaacuucggcaucgaagaggaaaucgcagaaaaacuggcaucacucgacuucuccgccgguggcuucggcaacaaaugcgcaaaggucauacgcaaaauccuaccguaccugauggaaggcgacaaauacaacguagcaauggacuacgccggcuauaaccacagcuucucucaaacaaaggacgaaaaccuccagcgcguauuauuggacagcaucaaccaccuucccaaaaauucacuccggcagccaauaguggagaaaauacucaaccaaaugauaaaccuggugaacgaaguaaucaagcaauggggacggccagacgaaauucgcgucgaacuagcccggaagcucaaacagucaaaaacugaacgcaacgacgacgauaacuucaugcgaaaacgcgaaagggaaaacgaaauaaucaaagccgaccuagcaaaguacggucuaaaggccacacgcaacaacguuauaaaauggagacuauaccacgaaauagacgacaaggacaagaaacucaacgcaaggugcauuuacugcggccaaccaaucucacuaaccgaagcaauccucggaaacaacgucgacgucgagcacauaauacccaaagacaaacucuuugacgacucccaaucuaacaaaacgcuagcccaccgcucgugcaacucuggaaaaggaaacaagacagcuuacgacuuuaugaaagacaaaccacaguucgaagaauaugucgcccgggucgaggaacucuacaaaaagcaccuaauaucucucacaaagaaacgcaaauuccucaugagcgaagauaaaaucccgucagacuucauagauagacagcuccgcgaaagccaauacauagccagaaaaagcagagaaauccuccagacaguaugccgcaacgucuggagcacagacggcggcguaacugcacaccuuagaaaacuauggggaugggacgacgucaccaugaaccuccaaaugcccaaauacaaaggaaucggcaugacagaaaucgucgagugggaaucgaaccacgggaaaaaccaacacacacaagaagugauaaaagacuggaguaagcgagacgaccaccgccaucacgccaucgacgcccucgucgucgcaugcacccgccagggguauauccagcgcaucaacacacuaaacagcagcgagaccaaggacgagaugcaccguaagguggcaggcagccuaguggaguuuaaccaaaagcacacucuucuaaacaaguaucugauaacagagaagccauucacaaccucggaagucgaagacguuguaagcaagauccuaguuagcuucaaggcuggcaaaaaggccgcaacgcccggaaaaagaaaaguugggaaacgaggaaacaagcaagucguccaagacgggauaaucauaccgcgaggcgcccuacacgccgacagcgucagcggcuccaucaaacaauacgaccccacgggcaacuucgagaaccacaacguaauaaaguauaaagucggaguagggaaagguuaccuuuucgacggcaaagacgacaaaaagaagauagacaagaccaucgacugcaucguagacaagaaaauccgagaccucaucaaacaaagagccgaagaaucuaacuacucacucaagaaaauguucgagaccccgauccucuucaaccaacgagccguauuuuccguucgcugcaaaacaggcaacaaagccguaguccccauucgaaacggauacgucguacccgacaacaaccaccauacggccaucuacaaauacgacggaggacucaaagagcaaugcguaucccuaaugcaggccauagaacgcaaacgcuacaaccuccccaucaucaucaagaaccccaaagaaauauacgacaagaucaccgagaucgcaaacaucaaccagcuacuauucgacucgcuacccaaacucgacugggaguucgucaccacacuccagaaaaaugacauguucauccuggggauggacuacucggcaacagaagaagcccuagcggacggcaacuaccggcuccuaagcgaguaccucuacaaaguacaaaacaucagcgacggaaucuacagacuuugccaccacacaauaacuaaauuugaccucucgaaggccaacaaaccagacaaacguuucuacaacauccagagccugaaagccuggaacacccuuaauccccaaaaagucaaaaucaacauccuaggacaaaucgaaaggcaauga

SEQ ID NO: 6342 - RNA, 3501 nt, Artificial Sequence
  Cas9 variant
augcacguagaaauagauuucccccacuuuucacgcggcgacagccaccuagcgaugaacaaaaacgagauauuacgcggaucaagcgugcucuaucgacucggccuggaucucggaucaaacagccuuggaugguucguaacucaccuagaaaagcgaggcgaccgccacgaaccagucgcacucggcccagggggcguccguauauuucccgacggccgcgauccccaauccgguacaagcaacgcagucgaccgcaggauggcaagaggcgccagaaaacggcgggaccgauucguagagagacgaaaagagcuaauagcggcacuaauaaaguacaacuuacuccccgaugaugccagagaaagacgagcccuagaggugcuagacccauacgcacuacggaaaaccgcacuaacagacacccuccccgcccaccacgucggccgggcgcuguuucaccucaaccaacgccgaggcuuccaauccaaccgaaaaacagacagcaaacagucggaagacggagcaauaaaacaggcugccagcaggcucgcgacggacaagggcaacgagaccuuagggguauucuuugcagacaugcaucugcgaaagagcuacgaggaccggcaaacugcaauaagagcggagcucgucaggcuaggaaaagaccaccuaaccggaaacgcccgaaagaaaauaugggcaaagguucgaaagcgacuuuucggcgacgaggucuuaccacgagcagacgccccacacggaguacgagcgcgagcaaccaucacaggaacaaaagccucguacgacuacuaccccacccgggacaugcucagagaugaguucaacgccauaugggcaggacaaagcgcgcaccacgcaacaaucaccgacgaagcgagaaccgaaauagaacacauaauuuucuaccaacgaccacugaaacccgcuaucguaggcaaaugcacacucgaccccgccacccgccccuuuaaagaggacccugaaggcuaccgcgcgcccuggagucacccccucgcgcagcgauucaggauacugucagaggcacgcaaccuagaaauaagagacacuggcaaaggguccagaaggcuaaccaaagaacaaagcgaccucgugguagccgcccuacucgcaaacagggagguaaaauucgacaaacuacgaacccuccuaaaacuccccgccgaggccagauucaaccucgaaucagacagaagggcugcgcuagacggcgaccaaacggcagcacgucuaagcgacaaaaagggcuuuaacaaggcauggcgcggcuucccgcccgaacgacaaaucgcaaucguagccaggcuagaggaaaccgaagacgaaaacgaacuaaucgcauggcucgagaaggaaugcgcccucgacggggcagcggcagcacgaguggcaaacacaacucugccagacggacauugccgacucggucucagagcaaucaaaaagauaguaccaaucaugcaggacggacuggacgaagauggcguagcgggcgcgggauaccacaucgccgccaaaagagcaggauacgaccacgccaagcugcccacgggggaacagcucggacgacuaccauacuacggacaauggcuacaagacgccgugguaggcagcggugacgcgcgagaccaaaaggaaaagcaauacggccaguucccaaaccccacaguacacaucggacucggccagcuacggagagucgucaacgaccucauagacaaauacggcccaccaacagaaaucucaauugaauuuacccgcgcccucaaacuuagcgagcaacaaaaagccgagcgccaaagggagcagcgccgaaaccaagacaaaaacaaggcaagagcagaagaacuggcaaaauucgggagacccgcgaacccgcguaaucuccuuaaaaugaggcucugggaggagcucgcacacgauccacucgaccggaaaugcguguacacaggagaacaaauaagcauagagagacugcucagcgacgaaguagauaucgaccacauccuaccagucgccaugacauuggacgacagccccgcgaacaaaauaaucuguaugcgguacgccaacagacacaaacgaaaacaaacccccagcgaagcauucggaagcuccccgacccuccagggacaccgauacaauugggacgacauagcugcccgagcaaccggacuaccgcgcaacaagcgcuggagauucgacgcaaaugcccgcgaagaguucgacaaaagagguggguuccuagcgcgacaacucaacgaaaccggauggcucgcccgacuagcaaaacaauaucuaggcgcagucacagaccccaaccaaauauggguaguccccggaagacuaacaagcaugcuucgaggaaaauggggucuaaacggacuccuuccaagcgacaacuacgccgggguacaagacaaggcagaagaguuccucgccucaacagacgacauggaauuuucaggcgucaagaaccgugcagaucaccgacaccacgcaaucgaugggcuaguaacagcccucacagacaggucccuccucuggaaaauggccaaugcauacgacgaggaacaugaaaaauucguaaucgaaccacccuggcccacgaugagagacgaccucaaagcagcccuagagaaaaugguagucagccacaaacccgaccacgggauagaaggcaagcuacacgaagacagcgccuacggcuucguaaaaccccuagacgcaaccggccucaaagaagaagaggcagggaaccucguauaccgaaaagccaucgaaagccuaaaugaaaacgagguggaucgcauaagagauauucaauuaagaacaauagugcgggaucacgucaacguagagaaaacaaaaggaguggcccuagccgacgcccuccgccagcuccaagccccauccgacgacuauccccaauucaagcaugggcugcgccauguccgaauacucaagaaagagaaaggagauuaccuagucccaauagcaaaccgagcauccggcgucgccuacaaagccuacagcgcaggagagaacuucugcguugaaguuuucgaaaccgcaggcggaaaaugggacggcgaagccgucaggcgcuucgacgccaacaagaaaaacgccgggccuaaaaucgcacacgcaccacaauggcgugaugcaaacgaaggugccaaacuggucaugcggauccacaaaggagaccuaauacggcucgaccaugaaggacgggcgcgcaucaugguaguacacagacuugacgcagcagccgggcgauucaaacuagccgaccacaacgaaacagguaaccuagacaaacgacacgcgacaaacaacgacaucgauccauuccgcuggcuaauggcgagcuacaauacccuuaagaaguuagccgcggucccagugcgcguagacgaacuagggagaguauggagagucaugccuaacuga

SEQ ID NO: 6343 - RNA, 3507 nt, Artificial Sequence
  Cas9 variant
auggcgcgcccagcguuccgcgccccgcgaagagagcacgucaauggcuggaccccugacccacaccgaauaagcaaacccuucuucaucuuagucagcuggcaccuacucaguagaguugucauagacagcagcucaggcugcuucccgggcacgucaagagaccacaccgacaaauucgccgaaugggaaugcgcaguacaacccuacagacucagcuucgaucuaggaacuaacagcauaggguggggauuauuaaaccuagaucggcaaggaaaaccacgcgaaaucagagcccuaggaucacgaauauucuccgauggaagagacccacaagacaaagcaagucuagccgucgcccggcgucuggcaaggcaaaugagacgaagacgcgacagauaccugacgaggcggacacgacuaaugggagcucuagugcgcuuugggcugaugccagccgacccagcagccagaaaaagacuagaagucgcaguugacccguaccuagcaagagaacgcgcaacaagagagcgccuagaaccauucgagaucgggagagcccuauuccaccugaaccagaggagaggauacaagccgguaagaacagcaaccaagcccgacgaagaggccggcaaagucaaagaggcgguagagagacuggaagcagcaauagcagccgcaggagcgccaacacugggggccugguucgccuggcgcaaaaccagaggugaaacccugcgcgcccgauuggcggggaaggggaaggaagcggcauacccauuuuauccagcaaggagaaugcuagaagccgaguucgacacucucugggccgaacaggccagacaccauccggaccuccugacagcagaagcccgggaaauacuaagacaccgaauauuccaccaaagaccacuaaaaccaccgccaguaggacguuguacacuguacccagacgauggccgcgcgccgagagcacucccaagcgcccagcgacuccgccuauuccaagaacuggcaagccucagagugauccaccuugaccuaagugaacgaccauuaacaccggccgaaagagacaggauaguagcguucguccaagggaggccacccaaagccggcaggaaacccggcaaaguccagaaguccgucccguuugaaaaauuaagaggacuccuagaauuaccaccgggaacaggcuucucacuggaaagcgacaagagaccggaacuacucggagacgaaaccggagcaagaaucgcccccgccuucggcccgggauggacagcgcugccgcuagaagaacaagacgcacucguagaauugcugcucacggaagcagaacccgaacgggccaucgcugcgcugacugcacgaugggcccuagaugaagccacagccgccaagcuagcaggggccacucuacccgacuuccacggacgauacggacgccgagcaguagccgaacugcuaccaguccucgaaagagaaacgagaggggaccccgacggccgggugcgccccauuagacuggacgaagcgguaaaacuccugcggggaggcaaagaccacagcgacuuuagcagggaaggggcccuacuagacgcucucccauacuacggagccguacucgaacgccacgucgcuuucggaacagggaauccagccgaccccgaagagaaaagaguaggacgagucgcaaacccgacaguccacauagcccugaaccaguuacgucaccuaguaaacgccauacuggcaaggcacggaagacccgaagaaaucguaaucgaacuggcaagagaccuaaaaagaagcgccgaagacagaagaagagaagacaagaggcaggcagacaaccagaaaagaaacgaagaacggaaacgacugauauuaagucuaggagaacgaccaacgccacgaaaccuauugaaacugcggcucugggaagaacagggccccguagagaaucgcagaugcccauauagcggagagacuauaucaaugcgaauguuacuuagcgaacaggucgacauagaccacauacucccauucagcguaucauuggaugauucagcagccaacaaaguagugugccucagagaagcaaaucgcaucaagcggaaccgaucgccaugggaggcuuuuggccacgacagcgaaagaugggcagggauacuagcaagagcagaagcccuaccgaagaacaaaagauggagauucgcaccagacgcgcuagaaaaacucgaaggcgaaggaggcuuacgagcccggcacuuaaacgacacgagacaccuaagccgccuagcaguggaauaccuccgcugcguaugcccaaaagugcgcgugaguccaggccgacucacagcgcuucuccgaaggagauggggcauagacgcgauccuagcagaagccgacggcccaccgccggaagugccggccgaaacccuagaccccagcccagccgaaaagaaccgcgccgaucacagacaccaugcccuagacgcggucguuauagguugcauagacaggagcaugguacaaagaguccaacuagcugcugcgucagcggaaagggaagccgcagcaagagaagacaacauacgcaggguacuagaaggcuucaaagaggaaccgugggauggauuccgcgccgagcuggaaagacgagccagaacaaucgucgucagccaccgaccggaacacggcauaggaggggcacuacacaaggaaacggccuacggaccggucgaucccccagaagagggcuucaaccucgugguaagaaaaccaaucgacgggcuuagcaaggacgaaauaaacucaguccgcgacccaagacuaaggcgagcauuaauagaccgacuagccauccgccgaagagacgcgaacgacccagcaacagccuuggccaaggcagccgaagaccuugcagcccaaccagcaagucgugggauaaggcgaguaagaguacuaaagaaagagucaaauccaauccgaguggaacacggaggcaacccaucaggcccccgcucagggggcccauuccacaaacuccuacucgcaggagaaguccaccacgucgacgucgcgcuaagagcugacggcagaagaugggucggacacugggucacacuauucgaagcacauggcggacgaggggccgacggcgcagcggcuccaccccgacuaggcgacggcgagagauuucucaugagacuacacaaaggcgacugccuaaaacuagaacauaaaggacgagugagagugaugcaagugguuaaacucgaaccgucgagcaacagcguaguagugguagagccucaucaagucaaaacagacagaaguaaacacguaaaaauaaguugcgaucaacuaagagcacgaggagcacgucgcguuacagucgacccccuaggacgcguccgcguucacgcaccgggagccaggguuggaauaggaggcgaugcgggucgcaccgccauggaaccagcagaagacaucagcuga

SEQ ID NO: 6344 - RNA, 3513 nt, Artificial Sequence
  Cas9 variant
augagcaaauacaauguagggcucgacaucggcaucgcgagcgugggcuggaguauaguagaugccgacaaaaagaaaaucaucgaccugggcucccgcauuuucucaucaggcaacgcggccgccaaccaagaacgccgcggguucagaggaaccaggcgcuuaaucaggcgacgaaagaaccgacugacggacgucaucaacuucuuuggggagaaaaaguucaucgacacgaaaguagucgacaagaacggucacguacacuacaaauucagugugaacaacacagaaagccccuacgaauugagaguaaaaggcuugagcgaaauacucaccaagcaggaacucgucauugcacuauaccacauaguaaagcacagggguaucucguacgaccucggugaccucgaagacgacggaaccagcggugugacagauuacaaaacaaguauaaauauaaauaggcaacuacucaaugagaaaaccguaggccaaauccaacuggaacgucucaacgaguucggcaaaguacgcggacaagucgaagaaaacgaaaacguaacgcuacucaacgucuucccauccgcagcguacgucaaagaagccacgcaaauccucacaaaacaacgagaguucuaccccgaaaucacggaugacuucauagccaaauucaugcuauuuaucacgagaaagcgagacuacuucgucggcccugguaaugagaaaucaaggacggacuacggaauuuacaagaaagacggccggacgcuggacaaccuguucgacgagcugaucggcauagacaagaucaacggcgagaaaagagcguccgcgucaucguuaacggcccaaauauacaacaugcucaacgaccucaacaaccugacaguccccaacaccgaagacgggcgccuaaccauccaaaccaagaaagaaauucuagaagcagcaaaaacaaccaacggccuauucggaaucgcgcaaauaugcaaaaucauaggaugcaaaaaggacgauaucaaaggcuuccgaaucgauaaaucagagaaaaagaucaugcacacacucuccggcuaccgcaaguuccgcaaagagcuggccgacgucaacauagaagccaacgaccuaaacaucaaccuaguuaacaagaucgcggacauccugacacucaauacagaaaaggcagagauuaggaagcaacuagacaaaaguaacauggauaucucgaacgagaugaaagaaauaguaauuaacaaaaacaaagaguuccuagucgauggacgagcgaccuggcacucguucucauauaaaacccugaacuuacuaauacccgaacuccucaacacgcccgaagaacaaaugacgauccuaaccaggcuagggcucguaaaaccgaacaacaaaaaguacgagggccucaagaacaucccagccaggagaauaacugaagaaauauacaaccccguggucgcccgcgcgaccagagaagccguaaacguauucaacgcaauaacgaagaaagucgggagagacaacauaaaagacgucauuaucgagcugccgcgugaagacaacgaaguagacaucaagaaaggcauagucaaacgccaaaaacagaacgaagucgagaaagagacagccgacgcgcuaguuaaacaacacaugaccaucagugacagcgcucucaucgcacaguaccgcaaaauacguggucucucccaaaaaguacgauacugguaccagcaagacacgaucugcccguacugcggcaagaaaauagaggccguccaacucauaaacaacaacgauagcuuugaaguggaccacauaguacccaucucaguauccuucgacgacagccagaacaauaaagugcuaguacacagucaauguaaccaggccaaagagaaacaaacaccccucggcuggcugaacaacggaggcggcuuugggcaauccaaagcggacuacaucgccaggguaaaaucaaacaaaaacuacgcgaaaaacaaaaucgauaaccuccuaaacgaaaccgaccuaaacgacauagcaacacaaaggggauucauacagcgaaaccucaacgacacccgcuacgcgucccgcauagugcucaacgaauuuuauagcuucuuccgaagcaacaacuuaaguacgaaagucaaaguaguacgcgguaaauggaccagccaaaugcggaaaaaguggaacggggugggaggacugagcaagacccgcgacacuuaccaccaccaugcaaucgacgccugcauaaucgcgugcuucccccuucuaaaagccuucgauaaggcaaucaaacugaucgacguugauggcgaaaccggggaaauucugcaagacaagaaggcgaucaaacuugcucaggaggcagaaaucgucgaaaagauaagcguaauaaagaacaagaaauucgagaacauggugaacgaaaucuacaacuucccccuguucaaacaagucgagcucgcgaacgacaucaccaaccucgagaaccccgucaaauucucgcaccacguggacaagaaagcaaacagggccguagcaaaccaaaccauauacggcacccgaauaaaagagaaagaggucaccaagcgaggcaagaaagagaaaauacaagaacgauacacacucggaacgaucaagaacaucuacgacaucgacggcuucaugaacuucaagaaacuauacgauaaaaucagcaagaacgacgacgucaaauuccuaaugcagaaaaacgaucccaaaaccugggagaagcuaauagacauuuucaacaguuaucccgacucagaagaaguaacacaagucgacggaaaagucaagagagucgccguuaguccauucaaacuguacuacagagaaaacggauucauaaccaaauacagcaaacauaacgacggccccaaggucgugagcauuaaauauuacgacagcaaagucggaagccacauagacauaaccccaaaggacgcacggaacaaggugauacuccaaucccucaaacccuggcgcaccgacguguacuucaacuccauaacgcagcaauacgagcuacuaggcuugaaguauagcgaccuaaaguucaccaacgggguguacgggaucacaagagaugcauacgagaagcuaaaacacggagugucagaggacggaguaaccgcguggaaaccgaucucgaaaaauuccgaguuccgcuucucgcucuaccgcaacgaccggguccgaguaaucgacgagaaaggagacucaauugagcuguuauucgccuccaggaccacaagcaaugaaggauacgucgaacugaagccgaucuacaaagcgaaguucgacagcaaggaagaagucgguuucuaugggcuggucagcaauggcagauuaauaaagaaaauguccaaaggaggguacaaacucuacaaaguaaacacagacauccucggaaaaccauauuacgugacuagagaaucagacgagccgaaacucucacucuga

SEQ ID NO: 6345 - RNA, 3516 nt, Artificial Sequence
  Cas9 variant
auggcuaaauacagcgugggccucgacauaggcauaagcucagucggcugggcaauaaucgacaucgaaacaaagcagaucgucaaucucggcagccgcauauuccccucuggcaacgcagccggaaaccaagagcgccgcggcuuccgcggaauuagaagacuuauccggcgcagaaagaaccggcuaacggaccucaagaaacuacucggugagacauucuuuagcgaccucaagaaaauagacuccaacggcuacgaauacuacgacauagacuuccagaucaacgccaauccauacgagcuucgaguuaaaggcauaaccgaaaaacucagcaagaaagaacucgcagugguacuccaccauaucauaaaacaccgcgggauaagcuacgaccucggagaccuugaagacgacggcacguccggugucagcgacuacaaaaauagcaucaacauaaaucgacaacuccugagagagaaaaccgucggccaaauacagcucgaacgacuaaucgaguucaaccaaguccacggccaaguaaagaaagccgaagacguaagccuucucaacgucuuccccagcuccgccuauagggacgaagcaaacaagauaaugaucaaacaacaagaguucuacuccgaaauaaccaacucuuucauggaacagguagaccaacucgucagccggaaacgugacuacuucaucggccccggaaacgaaaagucccgcaccgacuacggaaucuacaaaagcgacggaaggacacuggacaaccuauucgcagagcucaucgguacggacaaaauaaacggcgaaaagcgcgccucagcguccagccuaaccgcccaaguguacaaccugcugaacgaccugaacaaccugcacgucuccaacacagaagacggaaagcugaccacgagcacgaaaaaggagaucauuaaagccgccaaaacaacggacggggucuucggaaucucccagaucugcaaaaucaucggcugcaagaaagaagaaauaaccggcuuccgccaagauaagucggaaaagaaagucauacacacccuagcaggauaccgaaaaauccgcaaagccuuggccaccaucaacauagaggcaaacgaacucaaccccacaguauucgaucaaaucgcugacauacugacgcugaacaccgagaaagcagaaauucggaaacagcuagacaagguucaacuagacauaacagacgaaaugaaagaauuaguaauagacaaaaacaaagauuuccugguugacggcagagcaacauggcacagcuucuccuaucaaacacuuaacaugcucauccccgaacuccugaacacaagcgaggagcaaaugaccauccuaacccggaugggacuaaugaaauccgauaacgagaaauaccgcggccuaaagaaaauaccagccgagaaaauugcaucggaaauauucaacccagucguggcaaaaucaacacgggaagcaauaaaagucuucaacgcaaucuccaaagaaaucggaaagaacaacauagaacauguagugauugagcugccucgagacgacaacgaagaagacgagaaacgcaaaauucaaaagcuacagaaagccaacgaaacagaaaaggaggcagccgacaaccuagugaaacacaaacucgggauaucugacagcgcacucaucgcucacuaccgcaaguucaaaggccugucgcaaaaaguccgauacugguaccaacaagaaaccuauugccccuauugcggcaaaauuauagaagccacacaacuaaucaacaacaacgacaacuucgaaguagaccacaucauaccgauaucggugaguuacgacgacucccagaacaacaagguacucguacacucgcaaugcaaccaagcaaaagaaaagcaaacuccccucggauggaucaacaacggaggcggcuucggccaaagcaagaacgaguacacaaaccgaguuaaaaauaacaagaaauacuccaaaaacaagguggacaaccucuuaaacgaaaccgaccucacagacaucaucacccagcgcagcuucauccagcgaaaccuuaacgacacccguuaugcagcucguacaguacuugacgaguucuacucauucuucaagagcaacgaccucccuacgaaagugaaggucguccggggcaaguggaccagucaaaugcgccgcaaauggaacaacgucgguggacuccgaaaaacacgagauacacaccaccaccacgcaaucgacgcgucgaucaucgccagcuucccucuucuaagagcauucgacagagccauaaagcucaucgacguagacaaagaaaccggggaaaucguccaguacggcaaggcaucccugaacggcgacgucauagaagaaaaaucaguaauccaggcgccgauaaucaagaacgagaaauuugagaagcuaguagacgaaauauacaacuucccauuauucaaacaagucgagcuggccaacaacaucgagaacccagaaaaccccgucaaauucagccaccacgucgacaagaaagcgaacagaacgguagcuaaucaaaccaucuacagcacccguaucaagaaaaccgagaaaaucguacgcaagaaaguaaccgcuaaagaagaagaguacgucaucgggaccauaaaagacaucuacgacgucaccaacuucgagaaauucaagaaacucuacgacgaaagcagcaagaaagacgacauuaaauuccuuaugcagaaaaacgaccccaaaaccugggaaaagcuaguggagaucaugaauaccuaucccgacuacgaggagauaagccagcuggacgggaaaguaaaacgaguaaaagucagcccauucaaacucuacuuccgggaaaacggauucaucaccaaauacgcaaaacacaacaacggccccaaagucgugagcauaaaauacuaugacuccaaacuaggaaaucacauagacaucacccccguaaacgccaacaacaaaguaauacuacagucacucaaacccuggcgaacagacgucuacuauaacaacgaaacccaacaguacgaacuccuagggcuaaaauacagcgaccugaaauucaccaaaggcguuuacgggauaacccgagaagccuacgaaaaacuaaaguacggguacaccgacggagugccagcauggaaaccgauaagcaaagagucugaguucaaauucucauuguaccguaacgaccgaguacgcaucaucaacgaagcgggugagaaaauugaccuccuauucgguucccgcaacgaaacaagcgaaggcuacguugaaaugaaaccaaucuucaagacgaacuucgacgacgcagaagaagccuccuuuuacgguaagaccaguaacaaacggcuaaucaagaaaauggcacggaagggguaccagaucuauaagguaaacaccgacauccuaggcaaccuauacuacacggcaaaggaaagcaacgaacccaagcuagaccuauga

SEQ ID NO: 6346 - RNA, 3519 nt, Artificial Sequence
  Cas9 variant
augcgcaaacccuacagcaucggccuagacaucggaaccaacucgguaggcugggcgguuauuaccgacgacuacaaaguuccauccaagaaaaugcgaauccagggaacaacagacagaacaagcauaaagaaaaacuuaaucggggcccuccuauucgacaacggggagaccgccgaagccacacggcucaaaagaacaacacgccgccgcuacacacgccgaaaauauaggaucaaagaacuacagaaaaucuucuccuccgagaugaacgagcucgacaucgccuucuuuccacgccuaagcgagagcuucuugguuucagacgacaaagaguucgagaaccauccgaucuucggcaaccuaaaagacgaaauaaccuaccauaacgacuaccccacaaucuaccaccuccgccaaacacucgccgacuccgaccaaaaggcagaucuacgacucaucuaccucgcgcucgcgcacaucaucaaauucaggggccauuuccuaauagaaggcaacuuggauucggagaacaccgacguucacguccucuuccucaaccugguaaauaucuacaauaaccucuucgaagaagacaucgucgaaacagccuccaucgacgccgagaaaauacuuaccagcaaaacuucaaaaucccgccgccuagagaaucucaucgcugaaauacccaaccaaaaacgaaauaugcuauucgggaacuuaguaucgcucgcgcucggacucaccccaaacuuuaaaacgaacuucgaacuacuggaagacgccaaacuccaaauauccaaagacagcuacgaggaagaccucgacaaucuccuugcccaaaucggugaccaauacgcagaccucuuuauagccgcaaagaaacucagcgacgccauccuccuaucagacaucaucaccgucaaaggcgccuccaccaaggcaccccuaucagcaagcauggugcagcgcuacgaagaacaccaacaagaccucgcccuccugaaaaaccuugugaaaaagcaaauaccagagaaguacaaagaaauauuugacaacaaagaaaagaauggauacgcaggcuauaucgauggcaaaacuucccaagaagaguucuauaaauacauaaaaccgauccuccuaaaauuggacggcaccgaaaaguuaaucucaaaacucgaaagggaggauuuccuacgcaaacaacgcacauucgacaauggaucaaucccccaccagauccaccuaaacgaguugaaagcgaucauccgccgacaagaaaaauuuuacccauuccuaaaggaaaaccagaagaaaaucgaaaaacuauucaccuucaaaauuccauacuacgugggcccccucgccaacggccaaucgucguucgccugguugaaacgccaauccaacgaaagcauaacacccuggaacuucgaagaggugguugaccaggaagcgucggcucgcgccuucaucgagcgaaugaccaacuucgauaccuaccucccggaagagaagguacuccccaaacacagcccacucuacgaaauguucauggucuacaacgaacuaaccaaagucaaauaucaaaccgaaggaaugaagcgcccagucuuccucagcagcgaagauaaggaagagaucgucaaccuccuuuucaaaaaggaacgaaagguaacuguaaaacagcuaaaagaagaauauuucagcaaaaugaagugcuuccacacgguaaccauccucggcguggaagaccgauucaacgccagcuuaggaacguaccaugaccuacugaaaauauucaaggacaaagccuuccuagacgacgaagcgaaccaagacauacuagaagaaauaguauggacacugacacuguucgaagaucaggccaugaucgagcgucgucuagugaaguacgcggacgucuucgagaaaagcguucucaagaaauuaaagaaacgucacuacacuggcugggguaggcucucacaaaaacugaucaacgggaucaaggacaagcagaccggcaaaacgauacucggcuuccuaaaagacgacggcgucgccaaccgcaacuucaugcagcucauuaacgauagcagccucgauuucgccaagaucaucaaaaacgaacaagagaaaaccaucaagaacgaaucacuagaagaaaccaucgcaaaccuggcuggcucccccgcaaucaagaaaggaauacuccaauccauaaagauagucgacgaaaucgucaaaaucaugggccagaaccccgacaauauuguaaucgaaauggcccgagaaaaccagagcaccaugcaaggaauaaagaacagccgccagcgucuccguaagcuagaagaaguacacaaaaacacaggcuccaagauacucaaggaguacaacgugagcaacacccaacuccagagcgaccgguuauaccuauaccugcuacaggacggaaaagauauguacaccggcaaagaacuagacuacgacaaccuaucccaguacgacauagaccauauaaucccccaaucauucaucaaagauaacagcaucgacaacacaguccucaccacgcaagcaagcaaccgagggaaaucugacaacgugcccaacauugaaacggucaacaaaaugaaaucauucugguacaaacagcuuaaaagcggcgccaucucucaacggaaauucgaccaccuaacaaaagcugagcgcggagcccucagcgacuucgacaaagcgggguucaucaaacggcaacucgucgagacccgacaaauaaccaaacacgucgcccaaauauuggacucacgcuucaacuccaaccuaaccgaagacucuaaguccaaccguaacgucaaaaucaucacccuaaagucaaagaugguauccgacuuccgaaaggauuucggcuucuacaaacuccgggagguaaaugacuaccaccacgcccaagacgccuaccucaacgcaguaguuggcacagcccugcucaaaaaguaccccaaauuggaggccgaguucgucuacggcgacuacaagcacuacgaccuugcaaaacucaugauccagcccgauuccagcuugggcaaagcgacuacccgcauguucuucuacaguaaccuaaugaauuucuucaagaaagaaauaaaacuagcggacgacacgaucuucacacgcccacaaauagaagugaacacggaaaccggcgagaucguaugggacaaagugaaagacaugcaaaccaucagaaagguaaugucauauccgcaagugaacaucgugaugaaaaccgaagugcaaaccgguggauucagcaaagaaagcaucuggccaaaaggcgacagcgacaaacucaucgcccggaagaaaucuugggacccuaagaaauauggaggcuucgauucgcccaucaucgccuacagcguacucguagucgcaaagaauugcaagcguaaaaauucgaaaaccaaaaauuaccaaagaacgugcgggaauaaaaacaacggcacacgauga

SEQ ID NO: 6347 - RNA, 3522 nt, Artificial Sequence
  Cas9 variant
augagaccuaucgaacccuggauccuaggucuagacaucggcacagacagccucggaugggcagucuucuccugcgaagaaaaaggcccaccuaccgccaaagaacugcuagggggaggagucagacuauuugacuccggaagagacgccaaagaccauacauccagacaagccgaaagaggcgcauuucgacgggcccgucggcagacgaggaccuggcccuggagacgagacagacuaauagcccuauuccaagcagccggccucacuccaccagcagcagagacacggcaaauagcgcucgcauugcgucgcgaagcgguaagccgaccccuagcccccgacgcccucugggcggcccuccuccaucuagcccaccaccgaggauuccgaagcaaccggauagacaagcgcgaacgagccgcagcaaaagcguuagccaaagcgaaacccgccaaagccaccgcuaaagcuacggcaccagcaaaagaagcagacgacgaagcuggguucugggaaggcgcagaggcggcucucagacaacgcauggcagcaagcggagcacccacagugggcgcauuacuagcagacgaccuagacagaggacaacccguacggaugagguacaaccaaagcgaucgagacgguguagucgcacccaccagagcacucaucgccgaagaacuggccgaaauaguugcccgacaaucguccgcauacccaggccuagacuggcccgccgucaccaggcuaguacuugaccagcgaccccugcgcucaaaaggggcaggccccugcgccuuccuaccaggggaagaccgugcgcuccgagcccuaccaaccguacaggacuucauaauacgccaaacauuagcgaaccuuagacuacccucgacaagcgccgacgaaccacgcccgcuaacagacgaagaacaugcuaaagcacuagcacuccuauccaccgcccgcuucguagaauggcccgcccuacgccgagcacucggacuuaaacgaggcgucaaauucacggcagaaacagagaggaacggagcaaagcaagccgccagaggcacagcgggcaaucucacagaagccauacuggcgccccuaauaccaggauggagcggaugggaccucgaccgaaaggacagaguauucagcgaccugugggccgcaagacaagaccgaagcgcacuauuagcucucauaggagauccacgcggaccaacacgaguaacugaggacgaaaccgcugaagcaguugcggaugccauccaaauaguacugccaacugggagagccagccucucggccaaagccgcaagagcgaucgcacaagcaauggcacccggaauaggauacgacgaggcuguaacacuagcacuaggacuccaucacagccacagaccccgucaagagcgacucgcucgccuaccguacuacgccgccgcacuacccgacgucggauuagacggagaccccgucggacccccgccagcagaggacgacggcgcagcagccgaagcauauuacggucgaauuggcaacaucagcguacacauagcacuaaacgaaacacgaaaaauuguaaacgcccuccuacacagacacggcccuauacuacgucucguaaugguagaaacaacaagagagcuaaaagcaggcgcugaugagcgcaaaagaaugaucgcagaacaggccgaaagagaaagagaaaacgccgagauagacguagaacuaaggaaaucagauagauggauggcaaacgcgcgcgaaaggagacagcgugugagacuggcgcgaagacaaaacaaccuauguccauacacaucaacaccgauuggccacgccgaccuacucggcgacgcauacgacaucgaucacguaaucccacucgcccgaggaggaagagacucacucgacaauaugguacucugccaaagcgaugccaacaaaaccaaaggagacaagacaccuugggaagcauuucacgacaagccgggauggauagcacagagggacgauuuccucgcccgccuggacccucagacagcaaaagcucuagcauggcgauucgccgaugacgccggcgaacgaguggcccgcaagagcgcagaagaugaagaccaagguuuccucccccgccagcugacagauacuggcuauaucgccagaguagcccugagauaccuaucccucgucaccaaugagcccaacgccguuguagccacaaacggucgauuaacagggcuauugcgcuuagccugggacauuacccccggacccgcaccgcgagauuuacugccaacacccagagaugccuuacgcgacgacacagcugcccgacgauuccuagacgguuuaaccccaccacccuuagccaaagccgucgaaggcgccguacaagccagacuggccgcacucggacgcucacgcguggcagacgcaggacuagcagacgcccucggccucacccucgccucccugggcggaggaggcaaaaacagagcagaccaccgacaucacuucauagaugccgcaaugauagccguaacaacacggggccuaaucaaccaaauaaaucaagcaucaggcgcaggacgcauucuagaccuccgcaaauggccccggacaaacuucgaacccccauacccaacauuucgagcagaagucaugaaacaaugggaucauauacacccgucgaucagaccagcccacagagacgguggcagccuacacgcagccacuguuuucggcgucagaaacagacccgaugcccgcguccucguacaaagaaaacccguagaaaaacucuuccuggacgccaacgcgaagccgcuaccggcagacaaaaucgcagaaauaaucgacgguuucgcaucgccgagaauggcgaaaagauuuaaagcgcuccucgcacgcuaccaagcagcccaccccgaaguaccaccggcacuagcagcacuagcagucgcgagagacccggcuuucggaccccgcggaaugacggccaacaccguaaucgcaggacgaucggauggagacggagaagacgcggggcuaaucacaccguuccgagcaaacccaaaagccgccguaagaaccaugggaaacgccgucuacgaagucugggaaauacaaguaaagggacgcccacgauggacccauagggugcucacaagguucgaccggacgcaaccugcacccccaccaccaccggaaaacgcucgccuggugaugaggcuacgccgaggcgaucugguauacuggccacuagaaucaggagaccggcuguuccugguaaagaaaauggcuguagacggcagacucgcgcucuggccagcccgccuagcaacagggaaagcaacagcacuauacgcccaguuauccugcccgaacaucaaccuaaacggcgaccaaggauacugcgugcagagcgcagagggcauacgcaaagagaaaauacgaacaaccagcugcacggcacuaggacgacuacgcuuaagcaaaaaggcaacauga

SEQ ID NO: 6348 - RNA, 3525 nt, Artificial Sequence
  Cas9 variant
auggguaaauacuccauaggacuagacauagguaucucaagcguaggcuggagcaucaucgacaucgagaaaaagaaaauagucgacuugggcagccgaaucuuucccucagggaacgccgcagccaaccaagaccgccggggcuaccgcggaacacgccgcuuaauccggcgcaggaaaaaccgacuggcggauguuauuaacuuccucggggaagaaaacuucaucgacaccaaagucguggaccagaacggaaacauccacuauaaacuacucguuaacagcaccgagagccccuacaagcuccgagucaagggacucucaaaaaugcuaacgaaacaagaacucgucauagcauuauaccacauaguaaaacaccggggaauaaguuacgacuugggcgacuuagaagacgacggaaccuccggcgucacagacuacaaaaccaguaucaacauaaaccgccaacuccucaucaagaaaaccgugggccaaauccaacucgaacgacuuaaagaguucggaaaaguaagaggacauguuaaaaaggacgaaaacauaacccuccucaacguauuccccagcagcgcauacguaaaagaagccacccaaauauuaacgaaacaacgcgaguucuaccccgaaaucacugacgacuuuaucacaaaauucauacccuucaucucccgaaagagagacuacuuuguaggccccggaaacgaaaaaucucgcacugacuacgggaucuacaaaaaggauggccgcacucucgacaaccuauucgacgaacuuauaggcaucgacaagaucucgggggaaaaacgggcaucagcgucgagcguuaccgcucaaaucuacaacaugcucaacgaccucaacaauuuaaccguaaccaacaccgaagacggcaaacugacaacccaaacgaagcgcgagauaaucgaggccgauaaaaccacaaacggccucuucggcauaacacaaaucugcaaaauaaucggcuguaagaaagacgacauaaaaggcuuccgcaucgauaagguagaaaagcccaucaugcacacacuaucaggcuaccgcagguucagaaaagagcucgcgaaaauaaacauagaggcuaacgaccuagauauuaaccucgugaacaagauugcugauauccucacccucaauaccgaaaaagccgaaauccgaaaacaacuaaacaaaagcaauaucgacgucucaaacgaaaucaaggaacucauaaucaacaaaaacaaggacuuccuagucgacggccgagcaaccuggcacucauucucguacaagacacuuaaccugcuaauacccgaacucaugaacacauccgaggagcaaaucacaauacuaaccaggcuagggcucgugaaaucuaacagcgaaaaguacaaaggucucaaaaacauacccgcacgacguauaacugaaggcaucuacaacccugucguagccaaggccacuagagaagcgguaaacguauucaacgccaucgcaaagaagaucgggcgcgacaacaucucagacgucguuauagagcuaccccgcgaagacaacgaagcugacauuaaaaagggcaucgucaaacgacagaaacagaaugaacucgaaaaagaagcugcagaugccuugguaaagcaacagaugaccauuuccgacagugcccuagucgcacacuaccgaaaaguccgaggucuaucacaaaaaguucgauauugguaccaacaaggaaccuguuguccguacugcgggaagaacauagaagccguccagcugaucaacaacaacgacuccuucgagguagaccacaucaucccaauaagugucucauuugaugacagccagaacaacaaaguccucguacacucgcaaugcaaucaagcaaaaggcaagcaaacuccccugggcugguuaaacaacgggggcggcuuugggcaaaacaaaacagaauacgucgcgaaggucaaaaccaacaagaacuacagcaagaacaagauggacaaucuacugaacgacauggaccucucggacaucgugacccagcgcgguuucauacagcgcaaccuaaacgacaccagauacgccucgaggaucguccuagacgaguucuacucauucuucaaaagcaacaaccuaucaaccaaggucaagaucguaagggggaaguggaccagucaaaugagaaagaaauggaacggggucggugggcuaaagaaaacuagagacacguaccaccaucacgccaucgacgccucaaucauagcaaguuucccacuccucaaaguguucgacaaagccauaaaacugaucgacaucgaccgcgaaaccggagaaauacugcaagacaaagaggcaaucaagaugucccaggaggccaagcuccuagagaagaucccggucauccagaacgagaaauucgaagaacugaucaacgaacucuacgacuucccccucuucaaacaagucgaacucgcaaacgacauaaccaauccagaaaacccagugaaguuuagccaucacgucgacaagaaagccaaccgcagcguagccaaucagacaaucuacggcaccagaaucaaagaaaaagaaauaaacaaacgugggaaagucgagaaaguacaggagcgcuauauccucgguaccaucaaaaacauauacgauauagacagcuuuaccuccuucaaaaagauauaugacaaaaugagcaagacgggcgacguaaaauuucuaaugcaaaagaaagaccccaagaccuggggcaagcucguagaaauauuaaauaguuacccagacucagaggagauaacacagguggacggaaaggucaagcgcgucaaaguaucaccguucgaacucuacaggcgcgaaaacgacuucauaacaaaauacgcaaaacacaacgacggacccaaaaucguaagcaucaaauacuaugacaguaaaauaggaagccacaucgacauaacacccauaaacgccaagaacaaaguaguucuacaaucacucaagcccuggcggacggacguguacuucaacagcgaaacccgacaauacgaacuacucggccuaaaauacuccgaccucaaauucacaaacggggucuacggaauaaccucggaagcguacgaaaaauugaaacacgggauaagcgaggacggaacaaagaccuggaaacccaucggcaaaaacuccggcuuccgauucucucucuaccgcaacaacagagucaaaauaguagacgagaagggcgagucucuggaacuacuguuugccucccgcaccaccuccaacgaaggguacguggaacuaaagcccaucuacaaaucgaaauucgacagcaaagaagauguaggauuuuacggccagaugacccccuccggccaguuugucaagaaaauggcuagagucggguacaagcuauacaaaguaaacacugacguacucggcaacccauacuacaucaccaaggaaucagacgaucccgaacuaagucuguacaagaaauga

SEQ ID NO: 6349 - RNA, 3528 nt, Artificial Sequence
  Cas9 variant
auggaagaaaugaaacaaacugggcgcaagaacgaagccccgaaacuaaccgaccucaacuaccgaaucgggcuagacauagguauagccuccguaggaugggccguccuggagaacaacagccaugacgaaccauuccgcauaauugaccucggcgugaggauauucgauacggccgaacaacccaaaaccggagcgagccucgcccuaccccgaagagaagcgcggucagcccggcgacguauaagaagacgacgagacagaauagaacgcaucaaaaagcuguuccaagccgaaggacugauaaacauagacgaguucgaagcgcgguacaaaaucgcaggacugucagacgucuacaaacuacgauacgagggacuagaucgcaaacucacggacgacgaacuggcccaaguauugcuccacaucgccaaacaccgcggcuucaaauccaccagcaaagccgaggaggcagagaacgagaacgacgcagcgaaaaagaaagaagcaggggcgcuaaagaaagggauaucgaacaacaaaaagcucauggaagaaaaaggauaccggaccgucggugagaugauguaccuugacgagaacuucagaacggacugcccauggaacgaaaacggauacauccugacgccccgaaauaagucaggugacuacaaacacaccguccuccgcgacaugcugguggacgaagucagggaaauauucaagagucagcgaucacuaggaaacauccacgcgagcgaagaguuagaaaacgccuaccucgacaucaugcucagccaaagguccuucgacaugggcccaggggcgccuagcaaauacgccauggagggcuucgaggaccgaguagggcuuugcaccuuugaaggcaaaaacggcgagaaaagagcagcgaaagccgcguacaccuccgaacuguucgucgcacucgagaaaaucaaccacacgaaaaucgugucagaugacggcgccacccgauuccuaaccaccuacgaaagaaaauccaucauugaauuaaugcacaaacaacaaacuguaaaauacgcggcggucaggaaggcgauaggacuagcagaagaagacaaauucuacaaucuuaacuacagcccgaaagccggaagcaagaaaagccccgaagacacagacuuuguaaaacucgaaaauuaccacaaaauacgaaaagcacugggggaagacauagugucggaacaccuccccgccgaaaagauaaaacuauacgacagcauagcgacgauccuaacauuguucaaaaaugaugacucacggaucaagcgguucaucgaacuaggcauuggcgaagaaugcuucgacggacuacucucgcucucccccaguaaauuccacaaccucagucucguugccauggguaaaaucauaccauuccugcuagacggaaacacauacgacaaagcaugcgaacuagccggcuacgacuucaaagcagacaacaagggggagaaaagcguccuccucaaagguaaaaauaucacagacaugguaaacgacauaacaaaccccguaguaaggcgcagcguaucacaaacgauaaaggucaucaacgcaaucauccuggaauacggaagcccucaggcggugaacaucgaacucgcccgcgaaaugaguaaaaacuucgacgaacggcgcaaacuuaaaagcgacauggaaagcagagaaaaggaaaacaacaacgugauaaaacgagucaaagaauacaagcugaaccccacaggccaagacaucguaaaguucagacugugggaggaacaagacaggcguugccuguacaguggagagaaaaucgacaucaacgacuuauuuucucgagacggaggcuacgacguagaucacauacuccccuacuccaucacguucgacgacaccuaccgcaacaaggugcucgugaaagccuccgaaaaccgacagaaggggaauaggacaccguacgaauacuucauggccgaaaaagacgacgacgaauggaacguguacgaaacgcuggugcguaauacagucaaggacuacaagaaaguucucaaacuacucaagaagcacaucaccgaagacgagaagucggaauuucgcgagcggaaucuuaccgacacaaaauauauaacgcguauaaucuacaacaugauuagacagaaccuaguccucaagccauaccuaagccuggagaaggaaaggaagaagcaaguaauggcugugaauggcagcaucacccacuaccuauccaaacguuggggccuagagagcaaagauaggagaaccgacacgcaccacgcgcaggacgccgugguaauagccugcaccaccgacggcaugaucaacaaaaucucgcgcuacucaaaggggcgagaacuacuauacagcagggguuucaaauucguagacgaggagacgggagaaauacucucucgggacaacuucaccagagaggaaugggaugaaaaguacggaguaaagauacccauaccaugggagcacuuccgagacgaacucgacauacguaugagccgauacaauggcacuggcgacgacuccauagauaaaacgacaccgcgggacuuuauacucagccaccgagacgcccacaaguggaucaacuauccagaguggauguucguggagggacgaccagggagacgcgguguccuagacggcaucuucgucagccgcaugccaaagcacaaagucagcggacaagcgcacgaagaaacgguacggagcgccaaauauuacaacgauggagggagcguauuugagagcggcggauaugucgucacgaagaaaagcauccaagacauaaaacucaaagacggagagauaaaagaguucuucaacccagauagugaccggcuccucuacaacgcccuaguggacagacucaacaaauucgagaaugacccaaagaaggcauucgcggagccauucuacaagccgaaggcagauggaacacaaggaccgaucguaaagaagauaaaagucuucgagaaacaaucaucagggguauucguccgagauggaaaggguaucgccgccaauggggcuaugguaaggauugacguauucugcgaagaggauaagggcaaaaagaaguacuacuucgugccaaucuacaccgcggacguaguuaagaagaaacugcccgacagggccgcgacggcaaacaaacucauauccgaguggcgagugaugaaagaggagaacuucauauucagccuauacuccagagaccugaucuacaucgaaagcgacaagggcguccaggucaaggacauagacggaaagauaaguaaaccugugaaccuguuugccuacuaccugggggcagacaccagcaccgcaucgaucagcggaaagcuacacgacuccagcgccaacuucagaucaauaggcauacaaggucuacgcagguucgacaagugccaaguagacguucucggcaacaucagcuucgugaacaaagagaaaagaaugccauuuaacuga

SEQ ID NO: 6350 - RNA, 3531 nt, Artificial Sequence
  Cas9 variant
augaacaagguccaagaagacugcuacaagaaaaucaaggaaaaacuggcagacagggaguaccgcauuggccucgaccucggcgucgggucaaucggguacgccguaguaucacucaaaggugacaugccugaagauguuauccuagcgggcucacgcauauucaaaucgagcaucggcgcggccgaacgccgacacuuccgcgcccaacgcaacacucaccgacaccaccgagagcgaaugcgguaccucuggaagcuacucgcggagaaaaaccuggcacuacaacuccccgaaaaccucuccaagaaagaaaacuuuacagacuucgauaccagccgaaaacgcuuucccauagaaguccuccgaaacgaccccuauauccuaagauauaaggcuuuagacgaaaagcuaucacuuuuccaacugggcuacgcccuguaccacaucgcgaaccacagagggaccgccagcguccguucauuccucgaagacgaugaggcaaaaguaaaagagaacaaggaaaccgcaaaacuagccaagaacacaaagaagaucauguacgagaagaaauaccgaacauucggagaauaccuauaucgugagcgcauagaaaaauucaggcaaaacgaacgaaugaaaguaaccaacaaaaaugaaaacaaagaguucgcuguaacuagagacaucaucgaaaaagaaguagaaaugauacucggugcccaaaaacgcuacaacaccgcuguccuagccgaugacuacauagagcgcaucaagaaagccaucuuuuacgagaccgaaaaacuuauccccgaaccugaauacugccccuauuucaaagacgacaagagacuaccccgcucccacaaacugaacgaguaccggcgcauauaugaagcucuuaauaacaccagauacuacaucccggagauagaagagaaaaccggcgaaauccugaguaggaaggagaaggaacagcugagcaaagaggagaaagagaaacucuucaacuuccuccucaaaaacaaagaacucaccgaagcaaaagucaagaaauugcuaaaccugagcgaaauggccaagguccaacuacagggccgcgacaagaaaaaucagaaaaucaaaggauacgcacuaauuacccuagaaagccuaccuuucugguccaaacuacccgagcaacaacaagacgaguuccucuaugacuggaacaagcuccccgacgaaaaacuaaaagaccgccugcgcaacuacuacaagcugacggacgacgaaaucgaugaaaccuuccaaaacaucguacucccgagcaacuacgcaccccuaggaaagaaggccauggaaauucuccuagaauacaucaaaaacggccucagcuacauagaggcacuagacaaagcagccgacgaaaacaaaaucaaaguagagaagcacgaaaucaacgaccuacuacccuacuaugguaaaauccuccaagagucaacacagaugccaaucggcaaggccuucagcaagcaguucgccgccaaaaacuacaagaaaccagacauuaacaaaaacgaacaagaguucggacgaauagccaacccaguaguccaccaaacccugaacgaacugcgaaaacucauaaacgaaaucauaaccgucuucggaaagaagccucuugaaaucagccuggaaaccagccgcgaacucaagaaaucacaaaaagaacgugaacucaucgccaagcagcaggacauagacgaggaaaaacgcaagaaaaucuggaagacauacaucgaaccgcaccuacaacaaauaaaaucccgcucagacaagcucaagaaacuauuuguauucgagcugugggaggaccagaaacacaauugccccuucugucucgagaaaaucaauguagacgacaucuacucccgcggaguagacaaggaacaccucuucccccuaaagaaaagcgaagacgacucagaaaauaaccucgugaucgcgcacaacaaaugcaacgcaagaaaggcugaacgcgcccccuuugacgccuuuggccaugaaagcauauggaacgacaucuucucgaacgccgagaaaaaccuucccagaaaacucuggcgauuccgacaggggucuuucgaaaaauuccuagaaaaaccgcccaugcucaaacgcuucgaaaccgacaacuccuacaucagcaaaaucagcgcacgcuaccuggccugccucuuugacaaacccuccaagauauucugcgucaaacccuuccucaccgcccaacuacgcaucgccuggcagcucgacgagaucaugauccgucuagccgagaacaucauccucgacuccgaaaaagacucauucaacaaagguggccuccaaaagaagaaaagaaucgacaaccgccaucacgccuuagacgcggucguaaucgcuuaugcuagccgcggcuaccacaacuuccuaaaucgaguccacgcaaaaggauacaaaaucaacuacgacgagaaaaccuggcugucggaaacacuucgaccgcccggcaacaaaaaccuugaggacuucaaaagcggcaucaucaacgucaugauaaacgccaacaucuccauaaaacacgaccauaauaacaaagggcagcuagucaaaucgaaggcguacaaauuauacuacagcgaaaucgguaaguacaucaucaccacccucaagagcguguccgaaauacuauuuaagcaaaaggagaaaccccaagacacacuccgccgcgcccugugcaaauucgaggaucggcuauccgacaucaaagacaagaaacuacgaaagaagcuggaagacaacauaacaaucuauaagucaauugaaaacgaaucggcucucucgaaagccaaacaagaacuugaagaauuugaccucaaagcaaagaaggaagguaagaagggcuacgagaaaauaacugacauccucauuuacaagaaggcaugcuccaugcauggcggaaaauacauucacgucaaaaaccgcaucgagaacaaauucuucgcauugaaagagcccacagaaauagagacaggauucggcuacgauaccgcagacaaucucagccuagaccuguaccacgacaacaacgggaaacuaugcggcgaagucauccgcaagaucgacuucaaccgcaaccgaguaccaaauuacaagaaagagggcuacauccuucucgagcgaaucuaccagggcgacacgcuggaagucgauaucagcgacgacaaaauaucacugaaaaacaaggucggcagcgcacccgacaaacgaaccuucgucaagguccucaccuuuaccgaaagcgacagauaucucaaaaacaaacgcgaccaaauccaaauauucuucugcaaccuacuaaagucaacccucaaacaugacgacucaucaaagcacgaugacagcuucuacgucuccuccaugcagaaauauaacguccguaaagucauccucaccucgcucggcaucaucaaguaccgcucuaagauacucaaaaauaaagaaaucuga

SEQ ID NO: 6351 - RNA, 3531 nt, Artificial Sequence
  Cas9 variant
augcuguucccuaagaaacuuucuaaagaagaggucgcauacguccuugucgaaauaaacucaaaccucaacaacagcagcaacuaccugggcaacaucagcgaccguucgaaagaauuauacuucaacaaacagaccaucggacaguuccucuacacaaaacugaaagaagaccgccacuacagccucaaaaacaaaguguucuaccgacaagacuaccuggacgaauuugagcgaaucugggaaacacaagccauuuuccacaaagaacugaccgaagaccucaagaaacagauccgagacacgauaaucuuuuaccaaaggcgacucaaaagccaaaaggggcucaucucucucugcgaguucgagaacaaagagauuaccaucgagaaggaagguaagaccgucaccaaacaaaucgguguccgcgucauccccaaaucuuccccacuauuccaagaguucaaaaucuggcaaauccuaaacaacgucauuuguaagaagaaaggcacgcgcaaaaagaaagcagucaccccagcaccccuccuauucgaacuuuucggcaccccauccgagaccuuuuucagucucgacauggaaugcaaacagcugcuauucgaagaacucaaccucaaaggcaaccugaaagcagacaaggucaucaggcuccucggcuacaucccccaagagugggagaucaacuacaaccaacuagagggcaaccgcacgcaaaagagcuuauacgaggccuaccucaaaaucaucgaaauugaaggauacgacaucaaaacguuccuacgcaucaagucggacaaagaggacugggaccuagaagaaucgccccuauccgccaaagagauccgugaaaacauccaacauauauucgagacacucggcauuuccacggccauacucuauuucgacgcgacgcucccgaucaaagacuuugaaaagcaagcgucuuaccagcucuggcaucuacuauacucguacgaaagcgacaacagccccuccggcaacgaaacacuauacaaacuccuucaggacaaauucggcuucaaacgcgagcacgcgguguucuuauccaacaucucauuccaagaugauuacggcucccuauccgccaaagcgauacgcaaaauauacccauauaucaaagaaaaucaauacuccacagccugcgagcucgcuggguacagacacucgaaacucucacucacaaaggaggaacucaacaaucgcccccucaaggaucucauauccccacuaaagaagaacagccuccgaaaccccgucgucgagaaggggcugaaccaaaugaucaacguggucaacgcccucauagagaaaaacagcgaaaaagacgccgaaggcaacaucauaaaguacuuccacuucgacgaaaucagaaucgagcucgcacgggaacucaaaaagaacgcccaggagcgagcagaaaugacgcuaaacaucaaaaaugcaacaaucgaacaggaaaagaucaaaagcauccucauauccgacuucggcaucaaaaacccaaccaaaaacgacaucacgcgauacagguuauaccaagaacuugcacacaacgacuacaaagaccucuacacaaacacugacaucccaaaagagcuccuauuuucaaagaacaucgacaucgagcacauagucccgaaggcccgcgucuuugacgacucauucagcaacaaaacccucgccuaccgcgacuucaaccuuaagaagggagaaaacaccgcauucgacuucaucgacuccucgcucggcgaagaggaacucaaucaauacauagccaggguugaaaacgccuucaaaaccaaaaauaucucggcaaccaaguaccgcaaucuccugaagaaagcgaccgaaaucaacgauggauucaucaaccgcgaccuccgagaaacccaauacaucgcaaagaaagcuaaagaccuacuauuucaaauaacaagaagcgucgucucaacgaguggcagcauaaccgacagacuacgcgaagacuggggccugaucgacauaaugaaagagcuaaacaugccaaaauaccgugaccucggucucacagagaucaucgaacgucgcgacggaaggaagguagaagugaucaaagauuggaccaaacggaacgaccaccgccaccacgcaauggacgcccucacuguagcauucacaaagcccaguuacauccaguaccuaaaccaucuuaacgcacgcaaagacgagaacaacaagcucuacgcagacauccuuggcauugaaagaaaggagacaaccaagauacacgacgaaaacggaaacgagaaacgcguauuuaucgagccgauacccggcuuucgccaaaucgccaaaaaguaccucgaggagauccugaucucgcacaaaacaaagaacaaggucgucacuaaaucaaucaacaagaucgcugggacgaacaagaaacaagaaacacuaacgccacgcggccagcuccacaaagaaacuauauacggcaaauaccacuacuacaguaacaaagaagagaaaauagggaccaaguucgacaaagaaaccaucaguaaaguguccaaccccaucuacagauacgcccuccagaaacgacuagaagccaacgaaaacaacccgaagaaagccuucacggggaaaaacgccuuaaguaaaaacccaaucuaccuagacgacgcaaaaacaaagauccuccccgaaaaagugaaucugaucuaccuggaagaagacuucagcauacgcaagaaaaucgucagcgaaaacccgacuucaaaagaauuuguaccaaacucaaucucaauagagaaaaucgucgaugaaggaauaaagcggauccuuaaagaacgccuggaaaccuacaacaacgaucccaagaaagccuucgcugaccuugacaaaaauccgauauggcugaacaaagaaaaaggaaucagcauuaagcgcgugacaauuuccggcguaaagaauacacaagcucugcacucgaagaaagaccaccucggaaaaccaauccuugacaaagaaggacaagaaauccccgucgauuucguauccacaggcaauaaccaccacgucgcuaucuacagagaucagaaagguaaccuacaggagcagaucgucucuuucuucgaggcaguagugcgcgcacaacaaggauugcccauaauagacaaaacauacaaacaagaggaaggcuggcaauuccucuucaccaugaaacaaaacgaaauguucgucuucccgaacgaaaucaccggguuuaacccuucagaaaucgaucugcuagaccccaaaaacaagaaacuaauaagcccaaaucucuuccgcguccagaaaauauccauuaaagacuacuuuuuccgccaccaccuagaaacaaacgucgaaacaaacaacauccuuaaagacauaaccuggaaacgaggagggcugucccugcucaaaggcaucauaaaaguccguaucaaccaccucggaaacauagucuccauaggcgaguacuga

SEQ ID NO: 6352 - RNA, 3534 nt, Artificial Sequence
  Cas9 variant
augaacaaaguccaagagaucgaauauaagaaaaucaaagagaaacuugcagaccgagaguaccggauaggacuagaccucggagucgggucaaucggcuacgccgucguaagccugaagaaauacgacgaccucucauacuugccggaagacauaauccuagcaggcucgcgcauauucgccucgagcaucggggcggucgaacgccgagaauuuaggcuucagcggaacucacaccgccaccggcgggaacgcaugcgauuccuauggaaacuccuagccgagaaacaauuagcccugcaaccgagcaaagaccuggagaagaaagaaaauucagcagacugcgaaaccucccaaaaacgguucccgaucaacauacucaaaaacgauccauacauacugagauacaaagcccucgacgaaaaacugagccucuuucaacucggauauguccuauaccacguagcuaaccaccgaggaacugacagcauccgcucguuccucgaggacaccgacgacaaaauaaaagagaacaccaaaacagccaaacuugccaccgagaccaagaaaaucaucgacuccaagaaauaccgcaccuuuggggaguaccuguacaaagaacgcauccaacaaaacgagagaaagaaagucuccaaccggaaaaccgccggcaacaaaaacaaagaguucgcagucacuagagacaugaucuuuaaagaaaccgagaaaauccuagccucacaaaagcaauacuacacgaacguacuaacagacgaauauauaaaggaaauagaaggagccauauucuaccagaccgaaaagcucauccccgaguccggcuacugcccguacuucaaggacgaaaaacgucucccaugcucacacaagcuaaacgaauaccgccggauauacgaggccuugaacaacgcacgguacagcgcacccguacucgacgaaaagacgggcgaaauccuuagcuaccaagaaggagaagaguucaguagcgaagaaaagaaaauccuauucgacgaaguacugcuaaagggcaagaaacucacagaaagcgagaucaagaaacuccuccaccuacccgacggaugcgaaauacaacuccaaggacgagacaaacgcacucagaaaaucaaaggcuacgcgcuuaccgcccuagaagcccucccauucuggucaaaacucucgcaacaacaacaggacgaguuccuguacgauuggaacgggcuacccgaagaaaaacucaagccaaaguugauagacugcuacucgcuaaccgaaaacgaagucgacgagacauuccagaaaauccgccuccccagcaauuacgccccagucggaaagaaagccauggaaauacuccugacauacaucaaagacgguuauagcuacacugaagcacuggacaaggccgucucagaaggcaaauucaaagucgauaagcaaacuacaauuuacgacagccucccauacuacggaaaaauacuccaagaauccacccaaaaacuaaucggcaaagccuucagcaaacaauucgccaagcgcaacuauaagaaaccaaacaccaacagaaacgaacgagaguucggaaagaucgccaaccccguuguccaccaaucuuuaaacgaacuucgcaaacugaucaacgaaauaauaacggucuuuggcaagaaaccccucgaaaucggguuagagaccgccagagaacucaagaaaucauccaaagacagagagagccuaguaaaacaacaaaacgaaaacgaauacaaccgaaacaaaauauauaaagacuacgucgaaccucaccuaucccaaaucaaaagcagacaagaaaacccauccagauauaucuucaaauucgaacucuucgaggaacaaaaaucaaucugccccuucugccuaaaagagauuacgccugacgacauuaucaacucaaaaguugacaucgaacacaucuuuccaauugaggaauccgaagacgacgccaaaaacaaccucguuauagcacacaacgagugcaacgcagacaagggcaaaaagucccccuucgacgccuucggagacaagacaucgggcaaguacguguggaaugacauccuacacaacgccaagaaaaacuugccacacaaaaucuggcgcuucuaccaaggaagccuggaaaaauuccucgaaaacaaaccaaugcugaagcgcuucggcacggacaacucauacauuuccaaaaucgcggcuaaauaccuagcgugccucuucaacaacaguucaaagaucuucuguaucaaauccucgcugacagcucaacuccgcaucgcaugggagcucaauucaaucaugaucccccuugcaaagaacauccuaucggagaaagagcucgaggaguucaagacccucaaaaacaagaaaaucagaauggacaaccgccaccaugcccuagacgcuaucaccaucgccuacgccaaccgaggauaucacaacuuccuaaacaaaauacacgcaaaaggauacaagaucgacuacagagagaaaaacuggcucagcaagauacugcucccaccccucaacagagaucucgaagacuucaaaaucuccgugaaaaacuccauagaaaaagcgaacguauccaucaaacacgaccacaagacaaacggaucgcuagucaaagggaccgcauacaagguguacuacucaggcaccgguaaauacauaaucaccacccucaaaaacgucgaagaaauaucauucaaagaaaaggaagaccccgaagacacacuacguagggcgcuauguggcuuugaagacuccaacaucaaagacgaaaaacucaucaagaaacucaaauauaacuccgaccucuauaagaaaauccucaauacaaaacccaaagccaagcaagaacucgaacaggcaaaccaggaaaccaaagaagaaggcaaaaagacccagaaaaucaccgacguccuaaucuacaagaaagccugcucacugguaggcgaacaauacauccaaugcgcaucgcgacuagagaacaaauuuuucgcagugaaagaacccacggaaaucagaacaggcauaggcuacgacaccggagacaaccuauuucucgaccuauacuacgauaaaacacguaaacuaugcggcgagauaauacgcaagaucgacuucaaccaaaacaaaauacccaacuaccaaaaagaaggguacauccucuucgaacgcaucuaccagggcgacacccuugaagcggacaccucggaagacaaaauaagccucaaaaacaaaacaggcagcgcccuagacaauagaacauucgucaaaguacucacguucacagagagcgauaaguacuucgacggaaagaaagacaaaauacaaauuuucuucggcaaccucuuaaaauccaacuacaaacaggacgacucauucuacauauccucgaugcagaaauacaacgugaggaaagugauucuuaccucccuagguaucaucaaguaccgaagccaaauacuuaaaaacaaagaagucuga

SEQ ID NO: 6353 - RNA, 3540 nt, Artificial Sequence
  Cas9 variant
auguccaagaaaguaagccgacgcuacgaggaacaagcgcaagaaaucugccaacgacucggaucacgaccguacuccauaggcuuagaccucggagugggaagcaucggaguagccgucgcagccuacgaccccaucaagaaacagccguccgaccuugucuucgucuccagucguaucuuuauaccauccacgggcgccgccgaacgacgccagaaaagagggcagaggaacagccuccgacacagagcgaaccgccucaaguuccuguggaaacuacuagccgaaaggaaccugaugcuauccuauucugagcaggacguccccgaucccgcccgacuccgauucgaagacgcagucgugcgugcgaacccauacgaacuuagacucaagggccucaacgaacaacuuacccugagugagcuaggcuacgcccucuaccacauagcgaaccaccggggcuccagcagcguacgcacuuuccucgacgaggaaaaguccuccgaugacaaaaagcucgaagaacaacaagcaaugacugaacaacuggcaaaggaaaagggcauaaguaccuucauagaagugcucacagcguuuaacacaaacggacuaauagguuaccgcaacagcgaaucaguaaaaagcaaaggggugccuguacccacacgcgacauaaucagcaacgagaucgacguacugcuccagacgcaaaaacaauucuaucaagaaauacugagcgacgaauacugugaucgcaucguuuccgccauccucuucgagaaugagaaaauagugcccgaggcaggcugcugcccauauuuccccgacgagaaaaagcucccucgcugccacuuccugaaugaagaaaggcggcuaugggaagcgaucaacaacgcgagaauaaaaaugcccaugcaggaaggcgccgcaaaacgauaccaaagcgcauccuucucagacgaacaacgacauauacucuuccacaucgcgagguccggaacagacauaacacccaaacuuguccaaaaggaauuuccggcacuuaaaaccagcaucauagugcuccaagguaaggaaaaagccauccaaaagaucgcgggcuucagauuccgucgcuuagaagagaaaucauucuggaaacgccuaagcgaggagcagaaggacgacuuuuucagcgcguggacgaacacaccagacgacaaacgucugucaaaauaccuaaugaaacaccuccuccucaccgaaaacgaagucgucgacgcgcugaagaccgucagccuuaucggagauuacgggccaaucggaaaaacggcaacgcaacuacucaugaaacaucucgaagacggccuuaccuacacggaggcccucgaaagaggcauggagaccggagaguuccaggaacuaucaguaugggaacaacaaagccuacugccauacuacggccaaauacuuaccggaucgacacaagccuuaaugggaaaauacuggcacucagcauuuaaagaaaagcgcgacuccgaaggcuucuucaaacccaacacaaacagcgacgaggaaaaauacggccguauugcaaaccccguuguacaccagacccugaacgaacuccggaaacuuaugaacgaacugauaaccauccuaggcgcaaaaccucaggagauuacgguagagcuggcgcgcgaacuaaaagucggcgcggaaaaacgggaagacaucauuaaacaacaaaccaaacaggagaaggaagcugugcuagcauacucaaaguacugcgagccaaauaaucuagacaagcguuacauagaaagguucaggcuccucgaagaccaagccuuugucugccccuacugccucgaacacauuagcgucgccgacaucgcggcugguagagcagacguagaccacauauucccgagggacgacacggcagauaacucauacggaaacaaagucgucgcccaccgacagugcaaugacaucaaaggaaaaagaacgcccuaugcugcauucucgaacaccagcgcguggggccccaucaugcacuaccucgacgagacacccggaauguggaggaagcggcguaaguucgaaaccaacgaagaggaguacgccaaauaccuacaaucaaaaggguucguuagccgcuucgaauccgacaauucguacaucgcgaaagccgccaaagaauaccuacggugccucuucaacccaaacaacguuaccgccgucggcagccucaaagguauggagacauccauccuccgcaaagcauggaaccuccagggaaucgaugaccuccugggaucaagacacuggucaaaagacgccgacacauccccgacaaugcggaaaaaccgagaugacaaccggcaccacggucuagacgccauuguagcgcuauacugcucacgcagccucgugcaaaugaucaacacgaugagcgaacaaggcaaaagagcagucgaaaucgaagcaaugauccccaucccgggcuacgccucagaacccaaccuauccuucgaggcccaacgcgaacuuuuccgcaagaaaauccucgaguucauggaccuucacgcauucgucuccaugaaaaccgacaacgacgccaacggagcacuguuaaaagacacggucuacaguauacuaggagccgacacacaaggcgaagaccuaguauucguagugaaaaagaaaaucaaagacauaggagucaaaaucggagacuaugaagaaguugcaagcgccauccgaggcagaaucacggauaaacaacccaaaugguacccaauggaaaugaaagacaaaauugaacaacuacaaagcaaaaacgaggcagcgcuccaaaaauacaaagaaagccuaguacaagcugcagcaguacuggaagaaucaaaccgaaagcugauagagagcggcaagaaaccgauccagcuaucggagaaaacaaucucaaagaaagcgcuagagcucguaggcggauacuacuaccuaauuuccaacaacaaacggaccaaaacguucguaguaaaagaaccaucaaacgaaguaaaaggauucgccuucgacacuggcucgaacuuaugucuagacuucuaccaugacgcgcaagguaaacuaugcggagaaaucauccgcaaaauacaagccaugaacccaucauauaaaccggcguauaugaaacaaggcuacucguuauacgugcgccucuaccaaggagacguaugcgaacuacgggccucggaccugacagaggcagaaagcaaccuggccaaaaccacacacguccgccucccuaacgccaagccaggccgcacauuuguaaucaucauaacauucaccgaaaugggauccggcuaccagauuuacuucaguaaccucgcaaagagcaaaaagggccaagacaccucauucacccucacgacgauaaagaauuacgacguccgaaaagugcaacuauccuccgcaggccucguccgcuacgugagcccacuacucguagauaaaauagaaaaagacgaaguggcacucugcggcgaauga

SEQ ID NO: 6354 - RNA, 3567 nt, Artificial Sequence
  Cas9 variant
augaaauacauacugggucuagacaucggcgucagcagcgucggaauagccgugaucuccgaagagaaccagaaaaagacaauagaaaaccucgccguucgaaucguccccgaggaccccgauuuccacgggaaauucuacagcggcaacacugcaagcaaaaaccuggagcgcacagccaagcgagggaacagaaagaacaaccaacguuucaaagcccgaagagacaaauuauaccagucauuaaaagagaacaacauguuccccaccuccaaccuguucgaccucucggcaguagaacuauacggguugcgggccaaagcugucagcgaacaagugucccuucaagaauuagggcgcauccucauacuccugaaccaacgccgaggauuccuauccaaucgaaagucagucuccgaagaaaacaguaccgaauacaaggaaaggaucgccggccucgaaaaagcacucggcaacaaaaccaucggccaaaaacuauacagcgaacuccaagaaaacaacaacguuuuugaaguacuacucagggaaagaaccuaccagcgcagcucauauacggaagaguucgacagaaucugggacgaacagaagaaauacuaccugauccuaaccggcagcucaaacgaagacgacaacaaaggcacccucuacgaccuaauaagaaaccgaauuaucuacuaccaacgaccccucaagagccaaaaaggccuaaucuccgaaugccuguucgaaaaacaccacaaagcagucgcaaaaagcucgccauacuucgaacucuuccgaaucuggcagaaaauaaacgaccuauccuggaagacacccaauggggaacuguuuaaacccaccgaugaacaaaaacaaaaacuuaaaaacgcgcucuggaacggcgacaaccucaacccaaagcacaaacucaccguaucgaagaucaaggagauauuaggcuacaccucgcgggagaaaauauaccucaacuucaccgagcucgacgggucccgcaccuacucaauccucagaaacgcgcucaucgaagcagggaucgagaaacccgaacaauaucucuucuucaacauggaaaccaacgaugaaaagggcggacucuucgagcuuuggcacauaaccuauucacucccgaucgaaaaggaagucauuaacgcacugaagaacagguucggcuucgacaaaaagcaagcagaaauaaucgcccggagagucggguacucguccgacuacggcucacuaagcacccgugcaaucagaaaacuccucguucaucuggagaaaggcuugggcuacaccgacgcaugcgacaacaucggcuaugaccacaguggauacaaaaccaaaaucgaccugcaacccaaacugaagcaacuaaaacgaaacgaacuacgcaaucccgucgucgagcagauccugaaccaagucgucaacgcggucaaccuaauuaucgagaaguacggcaaaaucgacgagauacggguggaacucgcccgcgagcuacgaaacaacgccaagacccgaaagaauaucagccuacuaaacucgaagaacaagaagaacaacgauaucauccgaaagaaacuacaagaagaguacggguucaaauuugucaacgggcgggacguaacucgcuauaucuugugggaggaaaacagcaaggaaugccuuuacugcaacaaaacaaucaacgggucggacaugcucaccgggaacgccgacaucgagcacauccuccccaaaucccgcagcuucaauaacgccaugaacaacuacaucauaacccaccguaaaugcaauagcgauaaaggccaaaagaccgcguacgacuucaugagcuccaaaggcgagguaauucugcaacaguacauagaaaaggucaacgaucucuauaaagacggaaaaggaagcaucagcaagaccaaguucgagaaucuccucugcaaaggggaggacauccccucagacuucguggaacggaugaagaaagacucacaauacauagcuaaagaagcagugaaaaugcuaaaaacggucugcccaaacgucuacaccacgaccggccaagucacggacuuucuucgcgaagaauggaagcucaaaaaccugcuucaagagcucacauucgagaaauacaaagccauuggucaagugaaagagaagaucaucaagaccaacaacgggcagacaaaaacauuuaaggucauagcagacuggucaaaaagagaugaccaccgccaccaugccauagaugcacucaucugcgcacuaaccgaccagaagauaauauuuaaacucaacaaccuaaauaaaauauaccaauacgagcggaacgcacucucccaaaaagaaauugaagaaaucgaagaguuccucgaaggaaaauucagcaucaaagaguucuccgcccaacagggaaauaucaucgaaugcuccauaccuaacauccgcaaagacgcgcagaaacaccuagaaaacauccucauauccuucaagaaagaaaacagcaaaguacucacaaugaaccguaaccagcccaaaaacugcaaagaacaaaucaccugggugccccgagcccgacuacacgaagacacaaucaugggacgagucaaacgcauuccggaaaagaaaaugaaacugaacgacaaaguauccuucgaacaaauaaagaugaucguaaacccggaaaucaaggaaauacuccuauacaggcuagcgaaauucggcgauaaccccaagguggcauucgccacaaaagcacucaagaaagaaccaaucuucuacagggaaaacgaacuuaaagaaguaucgaucuacgaguggguuaacaccaaacgagucgcgcuaaacgaaaacaucacggacucacagaucgagaaaauaauagaccaggccuccaaacgagccguuaaagaacgucucaacggcggcaaaaucaaagaggucuucaaaaaccuaaccgagaacccaauccaacugaaaaacggcaugauccuaaagaacgucacaguaacagaugaaucaaaagucgaaaagauaagaaauggcuucgcuaucacaggcaaaaaucaucacgcccucguguacaaggacgagaacggaaaguacaacgacaagguggucagcuucugggaagcuguagccaucggccucagaaacguuacugaauauggcaaccccuauccuauaaucaaccgaaaccacaacgacgaacuaggugaguucuacuucucaaugcaaauuaacgaccucuucguauucgaccuaaaacacucggaaaacccacaagaagaaaacgagaucaacuuuuucgacguggaaaaccggaagcagaucuccgacaaacuauuucguguccaaaagaugucgaagaaaagcaacggacaauucguaucagacuuccgacaccaccuagagaccagcgucauaaggaacgacaugauacucaaaaacaucacguggaucucaaucucgaaaaacagcgaccuagaacggcuaacaaagauaagaguaaaccaccugggcgaaaucaucaaggugggagaauga

SEQ ID NO: 6355 - RNA, 3585 nt, Artificial Sequence
  Cas9 variant
auggauuucacggccgacguauccgagcucaacgagagcuucaugcaaauacacacagaaucgaaguucgaaaucgacacagcuaagguucaagaaauaucgcaacuacuccucgacaacaagauaacacgcauggacagacaaaagcaagucgcaaacgugcuggccaaaaauuccggcgauaaggaagcggauaaaaucaacaagaaaauagccacagaguucugcaaagcugugcuuggaaacaaagcuaaauucaacgugauccuaggggaagaugcgguggacagcgacuggagcuucaaaauggacgacgaaaacucggacgaggaaaucgagauucucaugggccaaacgaacggucaacaacaaaacgugcuccgcauaauacaccagugguacucccagauaacacucaauggcaucguaccagacggacagaugauuagcgaauccaugaucgauaaguacgaacuacacaggaaacaccuccuucuccuuaaacaacagauaaaggucaccaaagacaaaaagaaagcccaacaacuucacgaggcauacgaacaguacguccacggaaccggcgccaaaaagaaacucacucaggacgacuucuauuccaaggucaccaagaauuuagaaaccucagacuucucagacgaaaucaagaaacaaaucaacgcagagacauucaugcccaaacagcguaccagcgccaacggcgucaucccccaccagcugcaccaacaagagcucgacaaaaucauagaaaaacaagcaaaauacuaucccuuccuugccgaacucaaucccgacaccaaacgccaaaacauugccaaguacaaacucgacgagcugauagccuucaaaauccccuacuacgucgggccgcucauaacaacggaggaucaaaagaagacaucuggcaagagcuucgccuggaugguacggaaagagccuggcaaaaucacaccauggaacuucgaccagaaagucgacaaaauggccagcgcggaccaguucauacgccgcaugaccaccaaagacuccuaccugaucaccgaggacgucuuacccgccgagucgcucaucuaccagaaauacaagguccugaacgaacugaacaugauccgagucaacggcaacaaauuaacaaagcacgauaaacaaaacauauaccaacaagucuucgagaaauacaaaacagucaauguaaagaaagugcaaaacuacuuccugaccgacggacgauaccagcacgcgccaaaaaucaccggccuaagcgacgacaauaaguucaacagcaaucucaguacguauauagacuucaaaaagauuuuccaagacguagucgacgacccccaaaaacaaaaagacuucgagcgaaucauagaauggucaacuaucuuugaagaccggcacauauaugaagucaaacucaaagaaauaagcuggcuuaacgaugaacagcgcaaagaacucaagaagaaacgccaccaagguuggggcagacucucugccaaacuacuaacagggaucuucgacgagaacggcuacagcauaauggaucaacucuggaacacacagaaaaacuucaugcaaauccaagcggaagaaggcuucaacaagaaaauccaggccgagaacagcaaacaccuagagaaaaacgacuucgaagacauccuagaagacgccuacaccucaccucagaacaagaaagccauccgacaagucaucaaaguaguggaagauauccagaaaacgauggguaccgcaccccaaaagauaagcauagaguucacgcgauccgcugacaaaaacccccgccgaagcaucgagcgccagcggcagcucgaggagaucuacuacaacgacgcaaaagagaucguaucugagggcaugcaagacaaccuccaaaacuucacugauaacaaacaaacgcuaaccgacaaauauuuccucuacuuuacccaacucggcaucgacauguacaccggaaagaagauaaacaucgacgaaauagggaacuaccagaucgaccacauacucccccaggcauucaucaaggacgauuccaucgacaacaaaguacugguauccucggccaucaacaacggcaaauccgacaacgucccccucuccauguacgcaagcguacgcauaaaaagcgaaguccaaaacaaauggaagaacuucgcggaacacggacugaucucacagcggaaacucaacaaccucaugacagaccccgaaagcauagacaaguacaaggcgcgagguuucaucaagcgccaacucguagaaacgagucaggucauacgacugguggcagagauccucaacgaaaaauaccaaggggaaaccgagauaauagaaguucgcgcaaagaugaacucccaacuccgcaaggacuucgaccuccugaaaaaccgcaacguaaacgauuaccaucacgcucucgacgccuacuuaaccaccuucauaggaaauuaccucuaccggcgcuacccgaaacuccgcagcuacuucacauacggacacuucaagaaaauagacgacgccaaguuaaaacaguucaacuuccuccacgacauagaaaacgacaaggacccgaaauacgucaacgacaauggagaacuacuaugggaccgagagaaagacauagccuauuucaagaaaaucuacaacuucaaauauaugcuggucagccacgaaguuucuacgcgacagggggcgauguucaaacagaccaucuuccccgcggcagccgacgcaaaaaguaagcugauaccaaucaaaaacgauaagccuaccgcgauauacggcggcuacacgaacaacaacgacgccuaucucgcaauaaucaaacuagccaaaacaggacaauucaaaguggucggcgucccacaacgagcaaucguaaaacucaaacaagccuacgacaaagagaccggcgacuacagcaacguccucuacaagguacucgagcccaaguucguaaagaagaaaguaaaccgcaagacaggggagauaaccuaccaaguugaaaaguucaaaaucguaguaccaaaagucccguaccgccaacuggugaucgacggagaccaaaaguucaugcuaggguccagcaccuacaaguacaacgcgaaacaacuggugcuuuccgaaaacgccauaaaaaucuuagacaagaaaucuuucgaucaaucgggauacaaaucaagugaccuggacacgguauacgacgaaauacucagucaagucgacagauacuucagcauguaugacaaaaacaaauucagagaaggacuucacaacggaaagaaauacuuucagaggcuaccaaugauagacaauguggaaaaagggaaaauaaaagaaaacggaaaguucaaacuccuaaacgaaauacugaucggacuacacgccaaccccagcuucggaaaccuaaagucccucggcauaagcaccccauucggcaugaugcaguucgccagcggcauaagccucagcgaaaacgcaauacuaugcuaccaaucccccaccggcauauucgagcgucgcgucgcacuaaaagaccucuga

SEQ ID NO: 6356 - RNA, 3588 nt, Artificial Sequence
  Cas9 variant
augcagaaaaacauaaacacuaaacaaaaucacauuuacauuaaacaagcccagaaaaucaaagagaaacuaggcgacaagccuuacaggaucggacuagacuuaggggucggguccauaggguucgccauaguaagcauggaagagaacgacggcaacguacuccugcccaaagaaaucaucaugguagggucacgcauuuucaaagccagcgccggugcagccgaccgcaaacuaucccgcggacaaagaaacaaccaccgccauacaagagagcgcaugagguaccuauggaagguccuagcagaacaaaaacuugcccuacccguccccgccgaucucgaccggaaagagaacucauccgagggggagaccucggccaaaagauuccugggagacguacuacagaaggacaucuacgaacugcgaguuaaaagccucgacgagagguuaucccuccaagaacugggcuacguacucuaccauauagccgggcaucggggaucuucagcgauacgaacguucgaaaacgacagcgaagaagcccaaaaggagaacacggaaaauaagaaaauugccggaaacauaaaacgacucauggccaagaaaaacuaccggacauacggcgaauaucuauacaaggaguucuucgaaaacaaagaaaaacacaagcgcgaaaagauaagcaacgccgccaacaaucacaaauucagcccaacacgcgaccucguaaucaaagaagcggaggccauccucaaaaagcaagcaggaaaggauggcuuccacaaggaacucaccgaagaauacauagaaaaacucacaaaggcaauaggcuacgagagcgaaaaacucauccccgaguccggcuucuguccguaccuaaaagacgaaaaacgacuacccgccagccacaagcucaacgaagaacgaagacucugggaaacacucaauaacgcccgguauagcgaccccaucgucgacauagucaccggcgaaaucaccggauacuacgaaaaacaguucaccaaggagcagaaacaaaaacucuucgacuaccugcugacagguagcgaacucaccccagcccagacgaagaaacugcucggccucaaaaauacaaacuucgaagacauaauacuacaagguagggauaagaaagcccagaaaaucaaaggauacaaacucauaaaacuagaaucaaugcccuucugggcccggcucuccgaagcccaacaagauaguuuccuauacgacuggaacagcugccccgacgaaaaacuccuaaccgagaaauuaucaaacgaauaccaccuaaccgaagaagagaucgacaacgcguucaacgagauuguccuguccagcagcuacgcgccacuagggaaauccgcaaugcuaauaauacucgagaagaucaaaaacgaccuauccuacaccgaagcaguugaagaagcccucaaggagggaaagcugaccaaagaaaaacaagcaaucaaagaccgccuaccguacuacggcgcaguccuacaagaaucgacucagaaaauuauagcgaaaggauucaguccacaauucaaggacaaaggguacaaaacaccgcauacaaacaaauacgaacuggaguauggcaggauagcgaacccagucguacaccaaacccuuaacgaauuacgaaaacucgugaaugagaucauugacauccucggcaagaaacccugcgaaaucggccuagaaacugcccgggagcugaaaaaguccgccgaagaccgaucuaaacucagcagagaacaaaacgacaacgaguccaaccgcaaccgaaucuacgaaauauacaucagaccacaacaacaaguaauaauaacccgccgggaaaaccccaggaacuacauacuaaaauucgaacuacucgaggaacaaaaaucacaaugcccguucugcggugggcaaauuucaccaaacgacaucaucaauaaucaagccgauaucgaacaccuuuuccccauagccgaaagcgaggacaacggaagaaacaauuuagugaucagccauuccgcaugcaacgcagacaaagccaaacguagcccgugggcugccuucgcaagcgccgccaaagauucgaaauacgacuacaaccgcauacuaucuaauguaaaagaaaacauaccacacaaagccuggagauucaaccaaggcgccuucgaaaaauucaucgaaaacaaaccaauggcugcacgauucaagacagacaacuccuacaucucaaagguagcccacaaguacuuggcgugccuauuugaaaagccaaacaucauaugcguaaaaggcucgcuaacagcgcaacuccggauggcguggggcuugcaaggccucaugauacccuucgccaaacaacucaucaccgaaaaggaguccgaaucauucaacaaggacguaaacagcaacaagaagauacgacucgacaaccgucaccacgcgcucgaugcgauugugaucgccuacgccucccgcggguacgggaaccugcucaacaagauggccggcaaagacuacaaaaucaacuacucggaacggaauuggcuguccaagauauuacuacccccaaacaacaucguuugggaaaacaucgaugcggaucucgagagcuucgaaagcagugugaagaccgcccucaaaaacgccuucaucucagucaaacacgaccacuccgacaacggagaacuggucaaaggcaccauguacaaaaucuucuacagcgagagaggauacacccucaccaccuauaagaagcuguccgcgcugaaacucaccgacccccagaaaaagaaaacaccaaaagacuuccuggagaccgcccuccuuaaauuuaaaggccgcgaaagcgagaugaaaaacgaaaagauaaaaucugccauagaaaacaacaagcgcuuauucgacgucauccaagacaaccucgaaaaagccaaaaagcuacucgaagaagaaaacgagaaauccaaagcagaaggcaagaaagagaaaaacauaaacgaugccagcaucuaccaaaaagccauuagccucuccggggauaaauacguacagcuaaguaagaaagaaccagggaaauucuucgcaauaucgaaaccgacgccaaccacgacaggauacggcuacgacacaggggacagccucugcguugaccuguauuaugacaauaagggaaagcuguguggcgagaucauacggaagauagacgcccaacagaaaaacccacucaaguacaaagaacaaggcuucacccuuuucgaacgaaucuacggcggagauauccuagaggucgacuuugacauccacucggauaaaaauucguuccgcaacaacacaggcagcgcccccgagaaucgugucuucaucaagguggggacuuucacagagaucacaaacaacaacauccaaauaugguucggcaacaucauaaaaagcaccggcggccaagaugacagcuucacaauaaacagcaugcaacaguacaacccccgcaagcuaauccugagcuccuguggcuucauaaaauaccgaucuccaauacuuaaaaacaaagaaggcuga

SEQ ID NO: 6357 - RNA, 3594 nt, Artificial Sequence
  Cas9 variant
augagcaagcauguccuaggccucgaucucggcgucggaaguauaggguggugccuaaucgcacuugacgaacaggaucaacccgcagaaauccucggaaugggaucgcgaaucgucccacuuacaacagacgaucuaaacgaguucagccaagguaaagcaaucagcaaaaaccaaaagcgaacaacccaacgaacaauacgaaaggggcuugaccgguaucaacuacgccgaaaaguacucucagaaaaacucgccggccacgggauguugcccgacaaagaccuaaugcaacucccaguccucgaccuaugggagcucagagcgagagcagcaucaccaggggaaaagcucucccuccccgaaauuggaagaguacuauaccacauaaaccaaaaacgaggcuacaaacacgccaaaucagaugaagcagaggaagucacaaaaagaggaaaagagcagggauacgucgccacggucaaaggacguuacgcugaacuccaacgugagggggcaaccguaggccaacauuucgccugcaaauuaaaggaacaccgacaagaauccccaagcggaggcuucuucuauaacuacagaaucaaagaccaagucuacccgcgcgaagcauacauagaggaguucgaccggaucauggaaguacagucagucuuuuacccggaaguacuaacaccagcauucauccaagaacugcgggacaaagucauauucuuccaaagaccccucaaaagcugcaagggccucgucuccuucugcgaguucgaaaaacaagaacgcgugguacaauugaaaagaguaaacagagaaggaaaagaagaacuccaagagcgcaagaucacgauaggacccaaaguggcgcccaaaagcagccccaucgcccaacuaugcaaacugugggaaagcauccacaacauucgaaucuacuauccagacggcaaagaacgaccaauaacacucgaggagaaaagaaaacugcuagcauaucuacaaacccacgacaaacuaacuuuuacagcacugaagaaagagcugaaaaucagcgacaaagagcgacuauggugcgacaaacuccugaaaggcgggaucaagggcgacaccacaagaguccuccugagaaaggcgcucgccggcuacaaacgcuacgaaccccugcuaagaauggaccuagaacugagagacuuucaagaaaucgugagcggcaagcggcuuauccggcccauaguagacgaaagcuaucuaagccagccgcuauacagacuauggcacauacuauacucgaucgaggagcgagaagcgaugcgucgcgcacucaucgaucagcuagguuuccuagaagaagaccuggacggcggacuguuagacaaacuguaccagaucgacuucgcgaaacaaggauacuccaacaagucagccaaguucaucugcaagcuacuaccccaccuccagggcggacacggguacucccaggccugcgagcuagcgggaaaacgacacagcgccggcagucucacaaaggaggaacuggaagaaaggccgcuacuagagcacauaccacuacuacagugcaacgaacugagacaacccauagucgagaaaauccugaaccagaugaucaaccuggucaacgcacuccgccagaaguacggaucgauagaugaaguacgcgucgaacuugccagagaacuaaagaugucccgcgaagaacgcgaagaaaccucaaaacggauaagguccagagaaaaggagaacaaggaaauagcagaacgaauaaaagaauacgaacucuaccccacaaaauccagaauacaaaaauaccggcucuggcaggaagccggagaacaaugccuauauugcgggcgcucaaucgaugucguccaauuccuacgaggagauggaguagaaauagaacacauaaucccaaaaucgauacuguaugacgacucgagcgccaacaaaacaugcgcaugcucacgguguaacaaggauaaaggcaacaggaccgcauacgaauacaucuuagccgaagggcgagaggcagaauaucuagacagacuagaaacacucuuccaugacgguaaacuaagcuacucaaaacgccgccgacuacaauggaagaaagccgacauaccggucgacuucauagagcggcaauuacgccucacgcaauacauagcuagacaagcccaagaaaucuuacgccaaggcaucagacgagucggagcaucugaaggauccgugacagcaaaauuacgccaccuuuggggauacgacgacauacuacgcgagcucaacuucgagagguaccaaagcaugggcgaaacagaaauagucagccaggaggaaaaagacggaucgaucaccaaaagcgaacgcauuaaagauuggagcaaaagaaaagaccaccgacaccacgcgauagacgcccugguugucgcaugcacccgacagggcuacauccaacgauugaacucucucaacagcgaagaagacagccuccaaaugcaagaagacucaaagcagaugcgugagaaaaugggcgggcagaaaagacccaccgccgacaaacauagcauacucgaaaacuggcucauacuccaaccccacuucucccaccaagaagugaaauccaaaguagcagaaauacucgucuccuuccgacccggaaagaggaccgugagcaccggccgaaacacauaccucagaucgggaaagaaagugacccaaucgggaguccugauaccccgcggaccacucuccgaagagucucuauauggccaaauccuacggaacggugagccaacauacgucaagaaagucgccuuagaaucauuaucggaggcacaaaucgaacaaaucguagaccccaaacuuaggcgcgagaugguggcccgaacccaacccucagaaggagcuaaacuaaacccuaaacuuuuacuugccaccccauucuacagugacgcagcaggaacgcaacgaguacggucagucagagucgcuauagaaaacggcaaaaacuccauagugccacugcgcuacaacgaaagcggaaaagccauaacauucgucaaccccggcaacaaccaucacguuggcaucuacaggaccuccgaagggaaacugguagaauccugcgucacauuuuggcaagccguggaucggguucgcuacggcauucccaccaucauccgcaaaccacgagaaguacuggaccagcuguuacugagggacgacaucccugaagcccuucuagcgcaccuccccgcaagcgacugggaguucgucgaauaccuucaagccaaugagauguuccuaaucggacucacugacgaagaaauacaaacagcccuggccgaaucggaccuccugacccuaagcaaccaccuauaccgaguacagaaaaugagcuccgaauacuacgucuuccgcuaucaccucgagacagaagucgcagacaacaaaaacaacacagggaucauaccaaaauuuuaccgccuacgaggcccaaaugacaccuaucugaaagccaacccgaggaaaguaaaagucaaucugcucggcgaaauuucccugccuuga

SEQ ID NO: 6358 - RNA, 3615 nt, Artificial Sequence
  Cas9 variant
auggaaagaauccuaggaauagacaccggcacgaacucacucgggugggccaucguagacaaagacgaaaaccaauaccaccuaguugcuaagggcaccaacauauucuccgaaggagucaaaauugaaaagggcauagaaaguagcaaagcagcagaacgaaccgagcaccgcagcguccgcaaacauuacuggcgacgcaaaauccgaaaaauucggcuccucacaauacuauccgauaaugaccucugcccgaggcuaaaacaugaacagcugcgacaguggcgucucaagaaaguauacccgaccgacgacaccuucauggaauggcaaagaacagaagacaaagcgcaagucaacccauacaaauuccgauacaucugccucacgcagaagcucgacuuaucugacauaacacaaagauucauccucggacgagcacuuuaucaucucaaccaacgcagaggguuccucuccaaccgaaaagaagcgacgaaagaauccgagggcaccgucaaggaaggcauauccucccucucaaaagacaugaaagacagcgggugcgaauaccucggcgaguacuuuuaccaacuguaccagcagggcaaaaagaucagaaaccacuacaccgcacgcaaagaacacuaucugaaagaguucaaagcaaucugcuccaaacaggaacuagacgacgcccugauagagaagcuagaaaaagccauauuugaucagcguccccuaaaaucccagaaaggacaggucggaaccugcaccuucgaaaaaggaaaaagucgaugccccagcucacacccgcuuuacgaagacuuccgcauguacagcuucaucaacaacauaaaagugcaagucgacacccuguacgacaagggcgaacgcagccuaacagacgaggaaaaacaacucaucauuccgcuuuucaaacgcaaaagcaagcgcaccuuccccuucgaggacaucgcgaagaaaaucgcaggcaaaaacaacuauugcuauaucaaaagcaacgaggagaaagccuacaaauucaacuaucaaauggauacccaagucagcgggucucccguaaacgcccagcuggaagagauauucggcgaggacuggcuaagcucagucugcgaaguguacacgcuagccaacaacaagucacgguuccaaauaaugaacgacguuuggcacguucucuucuucuacgacgaugaagacaaacucaaggaguucgccaaagaccgacuacagcucgacgaugaacuagccgaaaaauucucaaaaaucagcauccccaacgacuacgcggcacugucccugaaggcgauaagaaaaaucaugcccuaccucagggacuacggacuaauauauuccgaggcgguguuccuagcaaaccuagucgacguccuaccccaacacguauggggcaucaaagagaugcgggaagcagcaauagaaaacguaauagacgucaugcacaguuacgacaaaaacaacauagacggcauuacgcuagaagguuguguaaaaacauuccucaaggaacgcuaccaggugagcgacgacaaucuaaagaaacuauaccaccccuccaugcucgauccauacccccgccaacggccaaaugacgaaggcgucuuccaacuagggucuccccgcauaucuagcgucaagaacccaauggcaaugcacucccucuuccgacuccgaaagguggugaaccuaaugcucaagaaaggguacaucacacccgacacaaagguacacauagaguucuccagagaucuaaacgacgcaaacaagcgaugggccauacagacauggcaaagggaaaacgaaaaagaacgugaacgaugccgaaaagaaaucgagaaguacauagccagcccuuccgauaccgacauacuuaaguaccaacuuugggaggaacagaaccacaaaugccuauacaccggagacgagauccgcauaacggauuuccucggcgacaaccccaaauacgacauagaacacacgauaccccgcagugcgggaggcgacagcaccaaaaugaaccugacccucugcuccucacgauucaaccgagaugagaaaaagacgaaguuaccggcagaacucguaaaccacgacgagauccuagagagaauaagcaacuggaaagagaaauaugaagauauagacaaacagauacgcaagaucuccacaaagggcgcgaccaguaaagaggacaaagacucaaaaauccgcaggcgacacuaccugauacuccagcgcgacuacuggcgaggcaaguaccagcgcuucaccaugacagaaguaccagaaggauucucgcgccggcagggcacagacaucuccguaauaucgagauacgcgcgcauguaccugaaaagcgucuuuaagcagguauauaucgucaaaggaaucgcgacaagcgacuuccgcaagauguggggcauacaagacgaauacgcaaagaaagaacgcguaaaccacguacaccauugcauagacgcaaucacaaucgcgugcaucggaaaagcugaauacgacaaacucgcagacuaccgccaucaauacgaugacuaccucuuccaaggcaaaacaaaaccaacauucgacaagccguggccaaguuucgugaucgacaucaaacacauacaagacgagcuccugaucgcacauuacgcaaaagacaaucuggaaaaauucaccaagaaaaaccucagaggcaaagacggccgaauaauaagggacaaauuuggaaacaaacuacagaugaaaggagacacgucacgcaacagccuccacaacgacaaguucuacggcgccauaaaccacgagggcgagauaaaauacguguaccgaaccaacauugaagcccuggacgccaaaagcauaggcaacauugucgaccccacaguccgaucaaucauagaauccgccauugccauacacggaagucugaaagccgcgauuaauaagggcauauggaugaacgaagaaaagcacauacccaucaagaagguccgcguauuccgaaacgacgucaaaaagcccaucgaacuuaaagaccaacgcgacuuaagcgacaaggacuauaagcaacacuacuacguuaccaacgacggcaauuauaugaugcucaucuucagcaaacugaacaacaaaggacgcgagauccgacaacacgucgugaucaacucccuggaggcaaccgagguaaucaaaucccacaaacgaagccaggugggcaaaguggucugggagagcuacuacuccaaagagggcuucgaucucaucuacaagcucaaaaguggaacgaugauccuuuuauacgagaacaacagagacgaagucugggacuuagauauccgcaaccuacagaagcgccuauacaucaucaccaagaugaaauaugacggcagaauauacaugaugcaccaccaggaagcccgagagaagaaagaccucgaagagaaaaguggcagcuuuaaaaucaacgaagauuacagaccccucauagucaacuccuacaaccaauucaaugcccuaguacaggaccuagacuucgaaaucaacgaccugggagaaauccgccgccuaauuuga

SEQ ID NO: 6359 - RNA, 3630 nt, Artificial Sequence
  Cas9 variant
augaaaaaggacuacauacuaggccucgacaucgggaucucgucuguaggcuggggccuauuggaacuagacgacaauaacaacccauacaagauaauugacgugggcagccguauauucaccccaggcgaaguagaaaagacuggcgacucgcgcgcgaaagaacggcgggaaaaacgaggagcaagacggauagcucgccgccgcgaguuccgacucgaccgcgugaaaaaccuccuguacgaaaacggauaucucaagggcaacauaaacaguaacaucgucagcgagaagaacgaggaacugucaaucaucuucaacaacaugaucaauaacuacuacaacggaaagaacacaaaccccuacauacugaaaguugaggcgcuagaccgaaaacuaaccgacgaggaacuaucuauaauccugguccacuacgccaagaaaagagguuauaaaucaaaccgcgaagaggcgucggacaaagagagcgggaaaguacuaaccgcuaucaaagaaaacgagaaaaucaugaaagacaacaacuaucguacgaucagcgaaauguacauuaaggacgacaaguucaagaacaagaucaaaaauagcccuaacgacuauaaaauaucagugaccaacgaaauguaccuggaagagauaaacaaaguacuagacucacaaauaaaauucggacuaaucacugacgacuuuaagaaucaauaccuagaaaucuacaacagccgacguagcuacgccaagggcccgggcggcaacagcccauacggaggagaccuaaucgaacgcaugacaggaaagugcaacuucgaugggaacccccgcgcgccaaaaagagccuuuucgucagagaucuacguugcacucaccaagcucgucaaccugaaguacaagguuaaugauggagaguacaucaaacucucagaaaaagagauuaaaaacauaauagaaaaagccaaggaaaagaaauccauaagcuacaaagaccuaaccaaaaugauagggaacaacauagacuucaaagaccuaacacugaguaagaaagaauauauaaaacuaauugaggaacuaaagaagaaacuaaacaucaagaaagacaccaaaaucaauaucaaugaacuaagcuccgaagacaaagagcucuacaacaaacugugcaacgacaaacugcucucaaaaacccucauagagcugaaaggcuaccacauccuaaaagauucggucaucaaggcguacagcaaggacaucugggacgaggugaaggacaauauguaccuauuagacgaccuagcucuauacugcaccaacuacaaggucaacgaggacauccucaauaagaucaaagaauccgaaaacauagacaacauuuuuaacgacauccacuuugucgaauugcucccaaacuucaaggaccaccuaaugcuaucgaccgagcugauacgcaaacuaauacccauaauguacggcggcaacaccuacgacaaggcaaugaacauccucggguacaaccauucggacauuaacggggacaaagagaagaaagaccuacuugugccgauaugcguugacgauaauaucacgaaccaacgaguaauccgaagucugacacagacuagaaaagucaucaacucgauaaucaagaaauacggaaugccaaaaaucauaaacaucgagacggcccgcgaacuggccaaaucgagacaggaaaggaacgaaauagcuaaaaauaacgucgaaaagcaagcugagaacgagaaaaucaaaaaccaacucguggaacucggccucuucgucagcaccgacaaaauaaguaguacugaccuccucaaguacaagcucuggaaagaacaaaaugaguucugcggguauagcaugaagaaaaucagcauagaagaccucuucggaaacaacauaguccaaauugaccauauccugcccuauucccggacauauaaugauaacuaccucaacaaaacgcuaguauacaccaaagaaaaccaggaaaagggaaaccggaccccauacgaaugguuuggcaagaccgacaaaugggacgaauacgaaacauacaucaacaauuugacgaucucucaaaagaagaaagacaacuaccuccucaagaaacucgauuucgacacggagcgagaaaugcgcucucagaaccuaaaugacaccaaguacauaagcaaagaacucagcagccucaucaaggccuaccucaacgucgaaaaaguaaauauguaccccggcgcaauuacggcgaaguuaagggcucgguggggauucaaccgacucacccacagcuaccucagcaaaaacuacauccuaccaaagaacauaaaggaagacauuaauaaagaccgcgacaaccaccuacaccacgccauggacgcccuggucaucgccucaauuacucccucacuccaacagaaaauaacacucuacgaaaaauucucccgguacaucgacggccugacggaacuccaaauuaagaauauaaguuacaucaaaauagaagacucagagggacaauacuacaacgacgacacagacgaggucgaaaccaucgacauuagggaguauauuaaacagcagcuggcagaaaacaacaucuauuacaauagacacaauaucagcaaacucgaguuccccuugcccuacgaaaacuucgacaaggaagcgaagcucagggucuacgaacaagaccuagacacacucaaguggaaccucaaaucauacaacacauacacacagaaggacaucgacaacguacauacucucaucccaagcauagccaagaccaaaguaucgggaaagaugcacgaagagacuuacuacggcauaaaggaaaucggaaaagacgaggacaagaaaaucuacaagacccuccggacgccgaucgaaaaagucaaacgcaaagaccuugacaacaucccggauagacucggaggaucgaaggacgucuacgagucccuagucgaaugguucggcgacuacgaaguuggagaagaaguccucaaagccaacgggaacaaauacccagucagcaaguccgacaaagaacauaaagagaucaagaaacucaaacuguauuccgaguacaaaaacaccggacacaugaucaauaagaguaacgucgaaaagggaggcauauaccgcauagacguauucaagagcaaagacaaagaagacgacaagcuguacuucgccgcauacgacauccuugaaauuaaaaagaucaauacccuaaaggagaaaaacagaguugacgacaauuucaacaucaaacucgacuacggccaaggaaagaacucaaagaucaugucuuacacugacaucaucaacaacuacgaccucuacaucucccucaacaaaaacgaccucaucaagaucacaaccaacgauggcaaggaaagcgucgcuuaugucguagggugcuccagcggcaugcucgaaguuaaaucaaaacucggcgacggauacgacaucaucaaaacagaccuuaacgaaaauaacaucuucucaaagcaaagggcgcaguaccaaaucacggucagcaccaucaaagagauuaagaagcuauccaucagcgucuugggagagauauccgggcuauga

SEQ ID NO: 6360 - RNA, 3633 nt, Artificial Sequence
  Cas9 variant
augcgcaccauccuaggacuggaccucggaacuaacucaaucggaugggcugugauaaacagcguaauuaaagaacagaccgaaagaaucuggaucgaaauggcaggguccagaaucauccccauggacgcagcgauccuuggagacuucgacaagggaaacucaaucagccagacugcggagagaaccagguuuagagggguacgacgcuuacgcgaacgccaacugcuccggcgagaacgccuacacaaaguacuaaagauccugggauuccuccccgagcacuaccucaaagguauagauuucgaaaaacacaccggaaaauuccucagcggcagugaaccaaagcuacccuggguaaaggacagauggggaaaauacagcuuccucuuccagaccgccuucaacgaaaugcuugcugacuucgccaaacaccaaccgagccuagucuucgacgggaaaaagauccccuacgacuggacaguauacuaccugcgaaagaaagcgcugaccgagaugauaucaaaagaagaacuagccuggauacuacuaaacuucaaucaaaaacgcggauacuaccagcucagaggcgaggaggaagaagauaacgcugggaaaucggucgaguucuacgcacucaagguauuaucgguggaagccacggacgaaaagaaaggcagggacauaugguacaacguccaccucgaaaacgggugggucuaccgucggagcuccaauguaccccuagacugggaagggagagucaaagaguucauagucaccacagaccucaacccggacggaacacccaaacuggacaaguacggcgaagucaagaggucauuccgugcccccaaagaagacgacuggaugcuaaucaagaaacgaacugaagcugacaucaccggcacgcacaaaacaauaggcuccuacauauacgacgcauuacuccaagaaccgcaacagaaaaucauaggcaaacucguuaaaacaguagaacggaaguucuacaaggaagaauuaaacuucauacuacagaaacaaugcgccuuccacgcagaacuacaagaucgggaccuauacaugcgcugcauagaggcacucuaccccggcaacgagguacaacgaaggaacauugcaaaccgagacuuuauauaccuccuaaucgacgacguccucuuuuaccagcgaccccucaaaacaaagaaaagccugaucgccaacugucccuacgaagaaaacgaauacgucaaccgcaaaacuggagaaauaaaaacagcaccccucaaaugcaucgccaagucgcacccacucuuccaagaguucagacuaugguacuuucuaucuaacauacggguguaucaaaaagaacgggagguaaacggaacccugcaccuugacguagacguaaccacggaguuccuuaaaacggaagacgacuacguugcccuguucgacuggcucaacucgcgcaaggaaaucgaccaaaaagccuuccuccgguaccccgcguuuggccucaagaaagaaauaaacaauuaccgcuggaacuacgucgaagauaaauucuacccaugcaaugaaaccagacacgccauccugagcagacucgaaaaagccggcauaggcauagacuuccuaagcgacgaaaaagaaaccgcccuguggcacauacuuuacuccguaucagacaaacaagaaaucgaaaaagcgcucgccaccuucgccgugaaaaacgggcuaaacgaaucauucguggaagucuucaaaaaguucccacccuucaaguccgaauauggcgcauacagcgccaaggccaucaagaaacuccuaccacucaugaggugcggaaaauacugggauaugagccucauagacggcaccaccaaagagcggaucgaaaggauaaucgcgggagaaugcgacgaaagcauaggggcaaaaguucgggagaaggcgaugaaccugagcgacauaaguugcuucaaaagacugccauuaugguuagcaugcuacgucgucuacaacagacacagcgaagacaaagaaaucaccaaaugggaaaccccagccgacauagacgccuaccuagcagccuucaaacaacacagucugcggaaccccauagucgagcaggucaucacagaaacacuccgcguaguacgcgacauauggaaacaagucggcaaaauagaugaaauacguaucgaacugggcagagaaaugaaaaacccagcagacaaacgaaaaaggaugaccacgcaaauccuugaaaacgaaaacgcaaaucuccgaaucaaggcgcuccuggccgaguucgucaaccccgaauacggcguugagaacguacgcccuuacagcccaagucagcaagaaauccuccgaauuuacgaagacgccguccucaaaggagaagaacaaaucccagaggacaucgacgucauccucaagaaguuuaacaccuccaagcuacccaccaagucugaguuccucagguacaaacucuggcuugaacagaaauacagaucuccuuauacgggcgaacuaauaccacucgccaaacuauuuaccgccgccuacgaaaucgagcacguaaucccucagucacgcuacuucgacgacucguucagcaacaaagucaucugcgagagcgcaguaaacaagcuaaaggauaaccaacugggcuacgaguucaucaaaaaccaucacggccaaaagguggaagucggauucggcaaaaccguagaaauauucucaguggacucauacgagcgauucguaaaagaacaauacgcgaaaucgggaaucaagaugaagaaacuccuaauggacgacaucccggagcaauucaucgaacgacaacucaacgacucccgguauauaagcaaaguaguaaaagggcuccucuccaacauaguccgagagaaaaacgacagcggagaauacgagccagaagcagugucgaagaauauacuggucugcaccggaagcgucaccgaccgacucaagaaagacugggggaugaaugauguauggaacagcaucgucuccccacguuucgaacgacucaacgcccuuacagagacccaaugcuucggccacugggaaaacaaagacggcaagaaggucuuccagacagcagucccuuuagaguaccaaaaaggguucagcaaaaagagaaucgaccacaggcaccacgccauggacgcaauaguaaucgcaugcgccacccgcaaccacgucaacuauuugaacaacgagucagcuagccggaacgccaaaauaucccgcuaugaccuacaaagacuccucugugacaagucacgaggggacggcaacggaaacuaccgcuggaucaucaaaaagcccuggaccaccuucacccaagacgcccgggaggcgcucuccggcauaauaguaucucuuaagcagaaccuacgcaucaucaacaagacaaccaacauauaccaacacuucgacgccaauggaacacgggucuacgaaaaacagaagauaggagacucaugggccauacguaaacccaugcacaaagauaccgucuucggggccguaaaccuccggaaggcccuaaucccacaacacuacaaccucacccuauuuauaucgagcuga

SEQ ID NO: 6361 - RNA, 3642 nt, Artificial Sequence
  Cas9 variant
auggagaagcggcuuggaauagacgugggaacaaacucacucggcugggccauaguagaaguugacgacgagggcugcacacuauuagaccgaggagucgacaucuuccaagaaggaguggcgcgagagaaaaaucaagaaaaaccagcagugcaagaucgcacggacgcgagggcguuaagacggcauuacuuuagaaggaggcugcgaaagaucgcacuccuaagaguacuggugcggcacgaccuuugcccggcucucuccgaagaacagcucaacgccuggcaaggaaaggggaucuaccccuuagaugacgccuuuaucagguggcaacgaaccgacgauaacgcggaccgaaacccguacagggaccgauucagaugccucaccgaggaacuagaccuagcaugccgagaggagagauauguacucgggagagcguuauaccaccugugccagagacgaggguuucuaagcaacagaaaggacgcaggaaacgaggccgaagaagggaagguaaaacaggaaauaaagacacugagcgcggacauggcggcugcaggcugugaauaccucggugaauacuucuaucgccuguaccagaggaaagaaaagaucagaaaacacuacacggcaagaaacgagcacuaccucgccgaauuuagagcaaucugcagaaaacaaaggcucgaugaggagcuucggcaagcccuagagaaagccauauucuaccaacgcccgcucaaaagccaaaaaggccuugugggcaaaugcacguucgaaaaagauaaaagccgaugcccaguaucacauccgcgcuucgaagaguuccggaugcuccaauucaucaacaacguuagggucaccgggcccggcgacgcagaacccaggccccucagccccgaggagguggaaaucgugcgcccacuauucuugaggaaauccaaaccacacuucgauuucgaagacaucgcaaagaaaauagcaggaaaaggaaauuaugcgugcagaggagagcuauuacaagcaccauaccgcuucaauugcgcgggaaaaucgacgguaaccggcagccccgucucugcacuauucgcgagcgucuucggcgacgacuggcagagagaaaucugcagccuauauacacuaggagcagggaaaaacgaagaacaaauccuaaaugacguauggcacguacuauucgcguuugaagaugaggaacgccugcaagccuggcuacaagaaaaacuacaguuaucggccgaugacgcgaagacacuggcagcauuccgccuaccccaaggauacgcaucacucucccuaaacgucauuaacaagauauugccauaccuaaggaggggguaccgguacgaugaagcagucuucuucgccaauuugggcaagguccuaccagcggaaguauacgcggacccggcccgcagaagggaaguugaacaggggauaucggcacagauggacgaucuuggggacggcgagaaaacacggaaagaagaaagaauaagggacuaccuccgccgauacugggguguugaggaaaagcgccuggagagacuauaucauccaagcaugauugaagccuauccauccgcaucgccgaacggccaaggacuucuacagcucgggaguccacgcauccccgcgguaagaaacccaauggcaaugagagcucuguucagacuccguguacuacugaaugaacuccuacgagaggggaaaauagaccgcgggaccaagaucaauauagaacuggcgcgagaauugaacgacgccaacaagcguaaagccauagaacgauaucaacgagaaagagaagcagaaaacagaaaauaugcagaagaaauaagacaacaauacguggaagcgacagggcacucgauagaaccaagcgaagaagauauccuaaaguacagacuauggguagaacaaggacacugcagccuguacaccgggaaaacuauaggcaucagcgaguucuugggcgacggccggcgauacgacauugaacacacaguacccagauccagaggcggagaagacgcccaauacaacaaaacacuaugcgaagaggaguucaacagagacauaaagagggacaaacuacccagugagcuagccaaccacacagccauccuggcaugcguagaauccugcggaugguucgaacggauagaagggcuagaacacagaguauggggcgcagacaggagagcuaagagcgcaacgaccaaaucagcaaaggacuucgcaauacaagaccgacacuauuggaggaugcaccuggacuacuggaggcgaaaaugcgaagccuucacaaugacggaagucccugagggguucagcaauaggcaaggcguagacguaggcauuauaggccgcuacgcacgacucuaccuacaaacaguauucgaucgaguguacaccguuaaaggcgccaccacggccgcguuccgccggauguggggccuacaggaagaguacgcagcaaaagagagggucaaucacguccaccacugcaucgacgcgauuacgauagcuugcauaggaagcagggaauacgcccucugggcacaauacguacgccaagacgaacuguaccgauggggagaagccgacaagccacgaugcggaaagccguggccgaccuucacagaagacgugagggcuacggcagacgaacuacugauaagccaccauacaccggacaacaugccaaagcaaucacgcaaacggcugcgagugagaggcaaagugcagcgaaacgaccggggagaagucaaguacaugcaaggcgacacggcacgaggggcgcuccaccaacaaacguucuacggggccaucgaaagagacggcgagauacgauauguagucagaaagagccuagaccaacugcugcccgccgauguagagaaaauagucgacgaagcaguacggcagaagguaagggaagcagucgaagcauacggauuuaaagaagccacagaccccaccaaacauacaguauggaugaaugaagaaaaacaaaucccaauacgaaaagucagaauacuuacgggaguuaaaaaccccauacuacugaagccccaccgagacguaagcgugaaagaauacaaaagauacuaccacguagugaacgacggaaacuacugcauggcgauauacgaggggcgcgaccgacagggcagacucaaacgcacauucgaaauagucaauaagcucgaagcugcccgcuacuucaaacguagcgccgaccgggagagcaggccagaucuggugccccuaagcgacguaaacggauacagcuuaaaauaccugcugaagacgggcaccaugguccucuuuuaugaaaacucgcccgacgaacucuaugaaugcuccgugggcgaacuagcaaagcgacucuacaaagugguagggauggcccaagacggacgcgugcaauuucuauuccaccaggaagcgcgcgaccagaaggccguaaccgcggaaugugggaugggcauaagcguauucgacgcacgccacccggccccaaaacucaggauacgggucagcaauuucaagauguucguggaaggcuacgacuucgaacugaccguaacaggcgaaguaaaauucaaacgguga

SEQ ID NO: 6362 - RNA, 3642 nt, Artificial Sequence
  Cas9 variant
auggaaaagcggcucggcauagauguggggacgaacagucugggcugggcaauagucgaaguagacgacgaaggcugcacgcuccuggaccguggcguagacauauuccaagaaggagucgcccgggagaaaaaccaagaaaagccugcaguccaagaccgaacagacgcccgagcccucaggcgacacuacuucagacgacgccuaagaaaaauagcgcuccuaagaguacucguacgccacgaccuaugcccggcacucagcgaggaacaacucaacgccuggcaaggaaaaggaauauacccacuagacgacgccuucauaagguggcaacgcacggacgacaacgccgaccguaaccccuaccgagauagauuccgcugccugacagaagaacuggaccuggcaugcagagaagaaagauacguguuaggcagagcacucuaucaccuaugccagcgaagaggauuucucuccaacaggaaagacgcgggcaaugaagcagaggaaggaaaaguaaaacaggaaauaaagacucuaucagcagacauggccgcagccggcugcgaauaccugggcgaauacuucuaccgccuauaucaacgaaaagagaaaauacgaaaacauuacaccgccaggaacgaacacuaccuagcagaguucagagcaauaugccggaaacaaaggcuagacgaggaacuacgacaggcauuagaaaaagcgauauucuaucaacgcccccugaaaagccaaaagggccuaguaggaaagugcacguucgaaaaggacaaaucaaggugcccgguaagccacccacgguucgaagaguucaggaugcuccaauuuauaaacaacgugagggucacagggccaggggaugcggaacccaggccacucagccccgaagaggucgagauuguaagaccccuauuccuucggaaaagcaaacuacacuucgacuucgaagacauagccaagaaaauagcagggaaaggcaacuacgccugcagaggagaacuacugcaagccccauacagauucaacugcgccgggaaauccacgguaacagggucgcccguaucagcgcuauucgccagcgucuucggggacgacuggcaaagagagauaugcagccuauauacgcucggggcaggcaaaaaugaggaacaaauacuaaacgacguguggcacguccuguucgcauucgaagacgaagaaagacugcaaacaugguugcaggaaaaacuccaacuauccgcagacgacgccaaaacgcuggcagcauuuagacuaccccaaggauacgcaucauugagccugaacguaauuaacaaaauccuccccuaucuaagacgcggcuacagauacgacgaagcgguauucuucgcgaaccuaggaaagguccucccagcagagguguacgcagacccggccagacgacgcgaaguagagcaaggaauaucggcacaaauggaugaccucggcgacggggaacagaccagaaaagaggagaggaucagggacuaccuccgaagauacuggggaguagaagagaagaggcuggagagauuguaccacccgagcaugauagaggcguauccaucggcauccccgaacggccaaggacuacuccagcuaggaagcccuaggauaccagccgucagaaacccgauggccaugcgagcucucuucaggcuaaggguccuauugaacgaacugcuaagagagggcaaaauagaccgaggaaccaagauaaacaucgagcucgcccgagagcucaacgacgcaaacaaaaggaaagcaauagagcgauaccaacgcgagcgcgaagcugaaaaccgaaaauaugcagaagagauacgucaacaguacguagaagcaaccggccacuccaucgaaccgagugaagaagauauacuaaaguaccgccuauggguggaacaaggacacuguucccucuauaccggcaaaacaauaggcauaagugaguuccuaggggacggacggcgcuaugacaucgaacacacagucccgagaagcaggggaggugaagacgcccaauacaacaaaacacuaugcgaagaggaguucaacagagacauaaagcgggacaagcucccaagcgaauuagccaaccacacggcaauacucgcgugcguggaaagcugcggaugguucgagcgcauugaggggcucgagcaccgaguauggggagccgaccgccgcgccaaaagcgcaaccacgaagucggcaaaagacuucgcgauccaagauaggcacuauuggagaaugcaccucgacuacuggcgacgcaagugcgaggccuuuacaaugacagaagucccagaaggauucucuaaucgacagggaguagacgugggaauuauaggacgguacgcaagacucuaucuacaaacggucuuugaccgaguauacacggucaaaggagccacaacggccgcuuuccgaaggauguggggccuacaagaagaguacgcagccaaagaaagggucaaccacguacaccacugcaucgacgcgauaacgaucgcaugcauaggcagcagggaauacgcccucugggcccaguacguccgacaggacgagcuauacaggcgaggcgaagcagauaaaccccggugcggaaaaccguggccaaccuucacagaagacgugagggccaccgcagacgagcuacuaauaagccaccacacaccagacaacaugccgaaacaaucacguaaaagacuacgaguacgcggcaaagugcaacgaaaugacagaggggaaguaaaauauaugcaaggagacaccgcgcgaggggcauuacaccaacaaaccuucuacggugcgauagagcgagauggcgaaaucagauacgucguacgaaagagccucgaccaacugcuccccgcggacgucgagaaaaucgucgacgaagcgguaaggcaaaagguccgcgaggcaguagaagcauacggcuucaaagaggcaacagaccccaccaagcauacggucuggaugaacgaggaaaagcagauaccaauacgaaaggugcggauucucacaggagugaaaaacccgauccuccuaaaaccccacagagacguaagcgugaaggaauacaaacgcuacuaccauguagugaacgacgggaacuauugcauggcaaucuacgagggccgagacagacaaggacgacuaaaaagaacguucgaaauagucaacaaacuagaggccgcacgguacuuuaaaagaagcgccgacagggagucgcgaccagaucuggugccccuaagcgacgugaacggauauagucugaaauaucuacugaaaacaggaacaaugguccuguucuacgaaaacucacccgacgaacuauacgaaugcucagucggggagcuagcgaagaggcuauacaagguaguaggaauggcccaggacggcaggguacaauuucucuuucaucaagaagcuagagaccaaaaggccguaacggcagaaugcggcauggggaucagcguauucgacgcaaggcacccagcacccaaacuccgaauacgaguaagcaacuuuaaaauguuuguagaaggguacgacuucgaacuaacagugacaggcgaagucaaguucaaaagauga

SEQ ID NO: 6363 - RNA, 3651 nt, Artificial Sequence
  Cas9 variant
augacaaaaauacuuggcauagacaccggaacgaacucccuaggcugggcaauaguagacaaaacggccgacaacuacaaccuccuagacaaaggcguuaacaucuuccaagaaggaguaaagauugagaaaggaauugaauccuccaaggccgcagaacgcaccgaacaucgcgccacaagagucagguacuaucgcauuaaacugcguaagauaaggcucuuacggauauuaucggacaaccaccuguguccaccccucucccaagaagaguuaucaacuuggcggcucaagaaggucuacccuaaaaacgaacuauucaugcaguggcagcgaacggacgacgacaccgaaaagacccccuacgcauaccgacacaaauguauacacgaaaaacuagaccucagcgauguaacagaccgguacauacuaggacgagccuucuaccacauaauccagcgccgcggguuccuaagcaacagaaaagaacaagggggcgaagauucgggaaaaguaaaggaggggaucucgacgcuaacacacgaaaugaacgaagcaggcuacgaguaucuaggcgacuacuucuacgcccucuacaacaagggcgagaaaauccggaagcacuauaccgcgcgaaacgaacauuuccuauccgaguucaaagcaaucugcgaaaaacaagaccuagaaaaggaacucggaagcgaaguggucagaaauauagaaaaggccaucuucgaccaacgcccucucaaaucgcaaaaaggacaagucgguaagugcgucuucgaaaagaauaagacaaaauguccaagcagucacccaauguacgaagaguuccgcaugcucacauucaucaacaacaucaagauaaaaacacccaacgacgacguacuacgaccccugaacaccggugaacgggagaaaauaaugccccuauucuuccgaaagaguaagaaacaauucgacuuugaagacauaaccaaaaagcuagcccccaagaaaauguacggcuucuacaaaaaggaagaagacgcagaaaugccguuccuuuucaacuaccccauggauaccagcguaagcggcugcccgguaaccgcggcccucaaagacguauucggcgacgacuggauuacagccauaugugaaacauacacacugggagaaggcaagucccgcuucgacaucgucaacgacaucuggcacgcacuauacuucuacagcgauaaagacaaacuggccgaguucgcaaucaaccgucuccaacuaucugaagacgaagccaaaaucuucucagaaaucucacucccagccgacuacgcaucccucagccuaaaagcaauauguaaaauccuccccuacuuacgccgcggccucaucuacagccacgcagucuuccugggcaaccuaugcgaagugaugccgaaauaugaauggagcauaaaagaaaugagggaaacaaucaucgacaauaucaucauggaaauggacaagugcgacacaaaagacaaacgaacauuugaaguuugcauaaaagacuaccuaaaaggccaguacaacgugagugacaauagccuaaagaaauuauaccaccccagcaugauagagaccuauccccggguccaauacaccaaugaacauggcguguaccagcucggaucaccccggaucgauucgguaaggaacccgauggccaugcgcuccauguucaggcuccgcaagcucguaaauagacuauuaguggaaggcaagaucgaccaaaacaccgaagugcacauagaguucgcgcgggagcuaaacgacgcgaacaaacgcaacgcaauagcacucuucgucaaagaaaaucagucagccaacgacgaagcccgcaaacaaaucaucacccucuucaagaaagaaacggguacggacaucgagccaacugacaaagacauccugaaauacguacuaugggaagaacaaaaccacaucugccuauacacgggaaagcaaauacggauauccgacuucaucggcgcgaauccaaaauucgacauagaacacacgauuccucgaagcgucggcggggacucaaccaaaaugaaucuaacccuaugugauagccgcuuuaacagagaagugaagaaaacgaaacuacccguagaacuaccuaaccacgacgaaaucauggaacgaaucaaagaauggaaaaagaacuacgaacugcuugacauucaaauacgcaagaacaaaaaguuaucaaagggcgcaaccaccaaagaacagaaggacaccaucauacgcaagcgacaucugcucgaacucagacgagacuacuggcgagguaaauacgagcgauucacaauggaaagcguacccgagggcuucagucgaagacaggggacagacauaucgguaauaucaaaauacgcacggcuguaccuaaagucccucuucaaccgcguuuacaccgugaagggaauagccacaagcgacuuccgaaagaucuggggcauccaggacauauacagcaaaaaggaaagaaucaaccacguacaccacugcaucgacgccaucguaauagcaugcauaggccucgacgaauacaacaagcuaggcgcauacuaccacgacgaagagaacaacaaaugguacggcaugucaaaagccagcuuuaagaaaccaugggccacauucguagaagacauaaagaaaauccaagacgaaauacucguauaccacuacaccccagacaacaugcccaaacaaggccgccgcagaauaaaaauugacggaaagaaaauacugugcaagggcgacgcggccagaggcucccuccacaacgacacauacuauggcgccauugagaaugauggagccgugaaguacgucaagcgaaucgaccuagccagccuagaagaaaaagacgucaaaaauaucgucgacgauaccguccgguccauaauagaagccgcaaucaaagaaaaagguuucaaagacgcaauggcauccaccaucuggaugaacgaagaaaagagaguccccauaaagaaggugaggugcuucaccccauccauaaccaaaccacucaauauacgcaaacaacgcgacgucucgauaaaagaauacaaacagcaauaucacgucgcaaacgacagcaacuaccuccucgcucuguauauaggaaccgacaacaaaggaaaggaaaaacgcgaguucgaaaucgucaacauucugcaagcagcacaguacuaccggaccucuaacgacaaagaagucguagaccgucacauaguccccauaaaaagcgaacacgacuacccguucgccuacacccucaaaaucggcacuaugguccuacuauacgaaaaaucccccaacgaagucugggacgccaccauaaaagagagaaauaggcgacuauacaagguaacgggccucucgacgaugcgcaugaaaggccgaaacggggaguacgcuuacgcuaccgucaagcuaauccacaacgaagaagcacgcccaucaaaagacaucaaagccaaaaacggagaguacgagcaaggcgaagaguuccgccccgcaauaauaaugcuccacacucagcuuaacgcccucguccagggauacgacuuugagaucaacgagcugggugaaauccgccgucuacgcuga

SEQ ID NO: 6364 - RNA, 3654 nt, Artificial Sequence
  Cas9 variant
auggagaaacagagaaucuuaggccucgacccgggcaccaacucccucgguugggcaguccuagacuuugacaacagcaaacaggaguacaaucuggugcgcaaaggcgaggucaucuucgaagaaggaguaggcaaaagcgagcgaggagaguucucaaaagcggcauaccggacuuucuacaaaaguacccgaaagcacuacuucaggcgaagacuccgaaaaaucgaagucuuaaaagugcucguaaaguacgacuucugccccuaccuaagcgacgaccuccuaaagcaguggcaugaaaagaagauauacccggcuguaaaagaguucauggacuggcaacggaccagcgaugcugagggaaagaauccauacuacgaccgccacugcugccugaacgaaaaacucgaccucagucuaaaaucagacagauacauacucggcagagcgcucuaccaccugacacagcgccgcggcuucaaaagcaaucgccugauacaaaacaacgacgaaaacgaagaaggcaaggugaagaaagggaucagcgaacucagcacggagaugcaagaggccaacugcaauuaccugggcgacuacuucuacaagcucuacacagaaaaggggaacaccguacagauacggaaacgauauaccgacagagagaaacacuauaagaacgaguucaaugccaucugcgaaaaacaagaacuaaaugaaaccauaguaaaagaacuggacaaagccauauucuuccaacgcaagcucaagccccagcgucacggcguaggcaaaugcacguucgaacccaacaaccgacgcugugccauaucgcaccccgacuucgaaagauuccgaauguuaugcuucaucaacaacauaaaaaucaaaaccccauucgaagaaaaucuccgcccacucaacaacgaagaaaaggcgcucaucgaaccccuauuuuaccgcaaauccaucaaaaacuucgauuucgaggaaauagccaagaaauuagcaggcaaaaauaauuacugcuacauaaaagacgacuccagcaagcaguauaaauucaacuaucgcaugucacagggcgccuccacaugccagacaauagcaaagcuaaagucaauauucggcgaggaguggaaaaacggcauagccgagaccuacaccaacaggcgcaagaaagaaggacugaagaaacaggcagaaauggucgacgacaucuggaacgugcuguauuccgugucagaaugugacguauuaaaagacuucgcgauaaacaaacuucaacuagacgagaaaacagccgacaacuucagcaaaacgaaacucgcgcagggauucgccacgcuuucccucaaagcgaucaggaagauccucccguuucuggaacagggcuucggguacacggaagcaguauuccuagcaaacauccccaccgucguaggaaaagaguacuggaacaacgaagacauacgcaacgacaucauggaggaaauaaaaaccaucuucuaccacaacacgcuaaagacaaacgacagccacaauaccauccucuucugcaucaaagacauccucagcaacaauuuugaccuggccccaggggccauagacaaacucuaccaccccagcaugauaaacguauacaaagaugugaucccaaacgaggacggaauccuccagcugggaucacccaaaaucgacgccgugaagaacccaauggccaugcggucacugcacaucauacgcaaggucgucaacgaacuccugcgcgagggaauuaucaacucugauacggaaguccgcaucgaauaugcgcgagagcucaacgacgcaaacaagcgccacgccauagcggacuggcaaaagaagcaguacggaaaacaccaaaaauaccgcaaggaaaucaaggaauuauucaaagcagagacaggauucgaaauugaaccaaacgagacagacauccuaaaauucgagcucugggaagaacaaaaccacauaugccucuacaccggucaagaaaucggcauaagcgaauuuguuggagagaacccaaaauacgacaucgagcacacguuccccaggucgcuggguggggacucaaccaaaaugaacaugacccugugugaaaacaaguucaaccgcgaaaauaaacaaaagaaacugccaagcgaacuagcaaaucacucagaaauccuagagcggaucgacgacuggaagaagaaaauauacauccugcagaagaaauacgacagcaucaggacacauaacggcauggacaaagagaacaaagacaagaaaauaguaagucgacacaaaauaaaacuggaacuagacuacuggaaagguaaauacaaucgauuuacgaugaccgagaucccagaagguuucuccaggcgccaaggaauggggauaggccuaaucucacgauacgcaggcuuguacuuaaaaacgauauuccacaaaaaggacaacccccaaaagagcaacgucuacaucguaaaaggcucgaucaccgcagaguuccguagaaucuggaacauccaagacgacuacgagaaaaagugucgcgacaaccacauacaccacugcaucgacgccauaguaguaggcugcaucggcaaacgcgaauacgaccugauggcccaguucuaccgggacgaagaaaaauaucggugggaaaagaagaagaagccauucuucaaaaagccaugggaaacauucacucaagacaugcucucacucaaggacgaagugcugaccgugcacuucaauccgagcaacuucacaaagaaagcgcacaagaaggucuucacacccaagggcauauucguggcccaaggggacugcgccaggguuaaacuccacaaggguuccuacuucggagccauagaacagaagggcgaaaucaaguacgugaugcguaaagaacuaagcgcacuaaagauugaagacaucaaaaacauagucgacgcugugguaaaagagaaaguguuagcagucguuaaaaagaaaggcuucaaacaagccauggcggagccaaucuacaugaacgaggacaaaaggauccucauuaagaaaguacgacuguucgucagccaggccaacccacucauagucaagaaacaccgcgaucucuccucaaaagaauacaagcaaaauuacuacguagacaacgagggaaaccucaugaucgccauguaugagggcgucaagaaaaacggcaagaucgaccgcgagaucacuguggugaacaaccuagaagcagcuaaauuuuucagacagucccaaaagaacaaugccgagaaacaacucauuagccaccucucgcccaaaaacggguauccauugaaaacugugcucacccaaaagcagcuaguacuaauguacgaagacagcccaaaagaaaucaaacuccgggacacgaaaaacauggugaaaaggcucuaccaaguguucggcauagaaaaagacgggagaguaaaacuaaaauuccaccaagaagccagaucugaaggucucaacaucaacuccgcggcguuuaagauacaggacacccccgaaucacucuacaggcauacaaaaucaaaccugaaaguacucgucaacggcguggacuucaagauaaacauccugggcgaaaucagccuaauauga

SEQ ID NO: 6365 - RNA, 3654 nt, Artificial Sequence
  Cas9 variant
auggaaaagcagcgaauacuagggcucgacccaggcaccaacagccucggaugggccguccuggacuuugacaacuccaaacaggaauacaaucuaguacgcaagggcgaagucauauucgaggagggggugggaaaaucagaacgcggcgaguucucaaaagcagcguaccgaaccuucuacaaaagcacccgaaaacacuacuuccgcagacgccuccgaaagaucgaaguccugaaaguacucgucaaauacgacuucugcccauaccuaagcgaugaucuccucaagcaauggcacgagaagaaaauauaccccgcggugaaagaguucauggacuggcagcgaacauccgacgccgaggggaaaaaccccuauuacgacagacacugcugccucaacgaaaaacuagaccuuucacuuaaauccgaccgcuaugugcucgggcgcgcacucuaccaccuuacccaacgacggggcuucaagaguaaccgccucauacagaauaacgaugaaaacgaagaagguaaggucaaaaagggaauauccgaacuguccacagagaugcaagaggccaauugcaacuaccuaggcgacuacuucuacaaacucuacacggaaaaggguaacaccguacagauaagaaaaagguacacggaccgagagaagcacuacaaaaacgaguucaacgcaaucugcgaaaaacaagaacucaaugaaaccaucguaaaagaacuagacaaagcgaucuucuuccaacggaaacuaaagccccagcgucacggagugggcaaaugcacauuugaacccaacaacagacgcugcgcaaucucucacccagacuucgagagguucaggauguuauguuuuauaaacaauauaaagaucaaaaccccguucgaggaaaaccuccgaccccucaacaaugaagagaaagcacucaucgagccacuauucuaccgcaagucaaucaagaacuucgacuuugaagagauagcgaagaaacucgccgggaaaaauaacuauugcuacauuaaagacgacucauccaagcaauacaaauucaacuaccgcaugucccagggggccuccacaugccaaaccaucgccaaacucaagagcaucuucggggaagaguggaagaacggaauagccgaaacuuacacaaauagacgcaagaaggaagggcucaagaaccaagccgaaauggucgacgacauauggaacguccuguacagcgucagcgagugcgacguucucaaagacuucgccauaaacaagcuccagcuagaugagaaaacagcagacaacuucagcaagacaaaacucgcccagggguucgccacacugucgcucaaggccauucggaaaauccugcccuuucuggaacagggcuucggauacacagaagccgucuuccuagccaacauccccacggucgucgguaaggaauacuggaacaacgaagacauacgcaacgacauuauggaagagauaaagacaauauucuaucacaacacacuaaagacaaacgacucccacaacaccauccucuucugcauaaaagauauccuguccaacaacuuugaccucgcgccgggagcaaucgacaaacuauaccaccccagcaugauaaauguauacaaagacgucauccccaacgaggacggaauccuacaacucggcagcccaaagaucgacgccgucaaaaaccccauggcaaugcggagucuucacauaauccgcaagguagugaacgaacuacuccgggagggcaucaucaacagugacacagagguccgaauagaguacgcgcgggaacucaacgacgcgaacaagaggcacgcgauagccgacuggcaaaagaaacaguacggcaaacaccagaaauaccgcaaagaaauuaaagaacucuucaaagccgagacaggauucgaaaucgaaccgaacgaaacggacauccuaaaauucgaacuaugggaggaacagaaccacaucugcuuauacaccggccaagaaauaggcauaucagaguuuguaggggagaaccccaaauacgacaucgagcauacaauuccccgcucgcuaggaggcgacuccacgaaaaugaacaugacccucugcgaaaacaaauuuaaccgagaaaacaaacaaaagaaacuaccaucagaacuagcuaaccacagcgaaauccuagagcgcaucgacgauuggaagaagaaaaucuacauccuacaaaagaaauacgauaguauaaggacccauaacggcauggacaaagaaaacaaagacaagaaaauagugucacggcacaaaaucaaacucgagcuugacuacuggaaaggaaaguacaaccgcuucacaaugacagagauaccggaaggauucuccagacgccaaggaauggggaucggacucauuucacguuacgcaggccucuaucuaaaaaccaucuuccacaaaaaggacaacccgcagaaaagcaacguauacaucgucaaagggagcaucaccgcagaguucagaagaaucuggaacauacaggacgauuacgaaaagaaaugccgagacaaccauauacaccacugcauagacgccauugucgucgguugcauaggcaaacgggaauacgaccugauggcacaguucuaccgagaugaagaaaaauaccggugggagaaaaagaagaaaccguuuuucaaaaagccuugggagaccuucacacaagacaugcucucucuaaaagacgaagucuuaacaguccacuucaauccgucaaacuuuacaaagaaagcgcacaagaaaguauucacaccgaaaggcauauucgucgcgcaaggggacugcgccagagucaaacuacacaagggauccuacuucggagccauagaacaaaagggcgagaucaaauacguaaugaggaagaaacucucggcgcuaaaaaucgaggacaucgaacacauagucgacgccguggucaaagaaaagguccuagccguggugaaaaagaaaggcuucaaacaagcuauggcagaaccaauauacaugaacgaagacaaacgcauccuaauaaagaaagugcgccuauucgucagccagaccaauccccucauagugaagaaacaccgcgaccugaguuccaaagaauacaaacagaauuacuacguagauaacgaagggaaccucaugaucgccauguacgaaggcguaaagaaaaacggcaaaaucgaccgcgaaaucaccgucgucaacaacuuagaggcagcuaaauucuuccgacagucgcagaaaaacaacgcagaaaagcaacuaauuucacaccucagccccaaaaacggcuacccccuaaagaccguccuuacccaaaaacaacugguacucauguacgaggauucaccgaaagaaaucaaacuucgagacaccaaaaacauggugaaacgccucuaccaagucuucgggauugaaaaagacggacgaguagaacucaaguuccaucaagaggcccggagcgagggacucaacaagaacucagcggccuuuaagauccaggacacgccagaaagccuuuaccggcacaccaaaagcaaccuaaaaguucuugucaacggaguugacuucaaaaucaacauccucggcgaaaucagucucauuuga

SEQ ID NO: 6366 - RNA, 3654 nt, Artificial Sequence
  Cas9 variant
augaaauacaacuacguucucggacucgauauuggaaucagcuccgucggcuggggacuguuagcgcuagacgagaauaauaacccguacaagaucauagacguaggcagccgcaucuucucacccggcgaggucgagaaaacgggugacagcaaggcgaaagaacgacgugaaaaacggggcacccgccguguaauucgccgccgcgaguuucgccuggacagagugcguaacuuacucuacgagaaaggauaccucaagggcaacauaaccagcaauaucguaucugucaagaacgaggaacuaacuaucaucuucaacgacaugguaaacaacuacuacaaguccaaggacaccaacccuuacaaacuaaaaguggaagcccuugacaggaaacucacaaaugacgagcucagcaucauccuaguccauuacgccaagaaacggggcuacaaaagcaaccgcgaagagagcucugauaaugacaacgggaaagucaaggaagccaucaaggaaaauaccaaucucauggaggaaaagaaauaucguacaauaagcgaaauguacaucaaaaacgaaaaauucaaaaacaagaucaaaaacgggcccgaugacuacaagcugagcguaaccaacgagauguaccuugaagagaucaauaaagugcuagauagccaaaucggguucggccugauugacgacaauuucaagaacgaguacuuagaaauauacaacagccgcagacacuacagcgaggggccaggcuacuacuacgccaaagacgccaacgguaacaaagucaagguacgcagcccauacgguggcgaccuaaucaagaagaugacaggcgucugcagcuucgacaaaaaggccagagcccccaaauacgcguucucaagcgaacucuucguaaguaucucaaaauuagucaaccuccgauacaaaauagacgaugacuccuacaaacagcugacaaaggagcaaauaaacgagcucaucgacgaggcgaaaaacaagaauaagguaaccuauaagagucugaucaaaauccuaggcauuaaaaacauaaaggucaaggaccucaaccugucaaagagcgaauacauaaaagugaucgaugagcuuaaaaagaaauuaaacauaucaaaagaagaaaagaucgacauuuacagccucgacgaggaaaacaagaaaaucuacgacgacaucuacaacgaaaaacucuucucaaaaacacucaucgaauuuaaaggguacaaucuccuaaagaaagcaaucacccuaaguuacaauuccggaacguggaacgacgucaaagacaacauugaguuccuggacgaacuugcgcucuacugcaccgacuauaaaguaaacaacgaaauccaagagcacauccacaacagccucaucaucgacagccgcuuugacgacucaaauuucgucgagaaccugccaaacuucaaagaccaccucaugcucagcacggacaucauccgcaaacucauacccaucaugcuggagggcauaacauaugacaaagcaauggacaaaaucggcuacaaucacucgaaucucuacaaggacaccauuaaagaagaccucuuaguuccagucuacgucuccaaaaacauuaccaaccagagaguaauacgcagccuaacccaggcccgcaaggugaucaacgcaauaaucaagaaauacggaucaccuaaaaucaucaauauugaaacagcccgagaacuggccaagacgcagaaggaacgcagaauaaucgaaaagaaccaacaggacaaacaauacgaaaaugagcggaucaaaaagcaccucgucgaacuagaacuauucagcgacgaaucgaaaauaacaggcaacgaccuacucaaauacaaacucuggcaggaacaaaaggaguucuguggguacagcaugaaaaagauuaaacuggaagaucuauucucaaacaauaucguccaaaucgaccacauccuaccuuacucacgaacauauaacgacaauuacuugaacaagacccucguauacaccaaauacaaccaggacaagggaaauaaaacgccguacgaaugguucggaaaaacagacaaauggcaagaguacgaagccuucauaaacucccuaagcaucagccaaaacaagaaggacaacuaccuacugaagaaccucgaccaagacgcggaaagggaaaugcgcgaacaaaaccucaaugauaccaaauacaucagccgagagcuccugucuuugaucaaggcuuaucuuaacguugaugagguaaacgcauuccccggggcaauaacggcgaaacuaagggcccgcuggggauucaaccgacucacacauuccuauaucagcaagacguacauaaugcccgaggacaugaaaaagggcauuaauaaagaccgcgacaaccaucuccaccacgcgauggacgcccuagucauugccagcaucacaaaauccuuacaacaaaagaucacacuauacgaaaaguucagccgauauguagacggaauaaccaaaaacgagcucggcaagaucagcacggggaacaucaacgaugaucucuacaacuacuaugaugaggaaaccggcgaaauaaaagaacucgaacuccgccaauauauuaaaaaccagguagcacaaaacaacauuuacuucagcaagcauaacguguccaaacuuaucuuccccaccccuuacaauaacuucguggaagaggcgaaacuucgcgucuacgagcgagaucuugaaguccuaaaguggaaucuaaagaaccugggaacguacaccucauccgaacucaaccggauacauguacucaucccaucaguggcuaaaaacaaaaucucuggccggcuccacgaagagacuuacuacggccucaaagaaguagggauuggcgaggacaaaguuaccuacaaaacccugaaaacacccaucagcaaagucaagaagaaagaccuggauaauauuccggacugcaaaggaggcucgaaagacaucuacaacgcccuagugaaaugguucgggaacugcgaaacuggagaggaagcacucaagaugcacgacgggaaguauccagugaacccaaacgacaaggaacagaaggagauucgaaaaauaaaaguguacaccaaguauaacgcgaccggccacgucgugaacaacggcaacguagagaagggaggaauauaccgcauagaugucuucaaaaguaaaaacaaagaggacaacaaacucuacuuuaccagcuacgacauauucgaaauagaacaaauaaaggccuacgagaagggcaaaaacauaaauuucagcaucaaacuggaauacggccaaggaaagaacaacaaaauccuccuguacaaagaugucaaaaaugaguacgacuuaauaaugagcaucuacaaaaacgaccucauccgcauaaaaaccaaaaccggaaacaagucuacagccuacguagugggauucucaggcggcaaacucgagaucaaguccacaauaggcgacggcuacgacaucaucggcaauaacaacaucuucgacaaauccauggaacgauaccgcguaaccagcagcaccauaguaaagaucgacaaacucagcauuucgauccucggcgaggucaguggacucuga

SEQ ID NO: 6367 - RNA, 3657 nt, Artificial Sequence
  Cas9 variant
augaauaagcggauucuaggucuugacacagggacaaacucccucgggugggcgguaguggacugggacgaacacgcucagucguacgaacuuauaaaauacggcgacguaauauuucaggaaggggucaagaucgagaaaggaauagagagcagcaaagcggcagagagaagcggcuacaaagcaauccggaagcaauacuuuagacggcgacugcgaaaaauccaaguacugaagguccucgugaaguaucaccuaugcccauacuuaagcgacgaugaucugcgacaauggcaucugcagaaacaauaccccaaaagcgacgaacuaaugcuuuggcaaagaaccagcgaugaagagggaaagaacccauauuacgaucgccaccgaugccuccacgagaaacuugaccuuacggucgaggcagaccgcuacacacuaggccgggcccuauaucaccucacacagagacggggguuucuguccaacagacuagacacauccgccgacaacaaagaggacggaguagugaaaagcggcaucucgcaacuuuccacagaaauggaagaggcaggaugcgaauaucucggagacuacuucuacaagcucuaccacgaacaaggaaacaaggugcgcaucaggcagcgauacacggaccgcaagaagcacuaccaacacgaguucgaugccauaugcgaaaaacaagaacucucaucagaacuuaucgaagaccuucagcgugccauauucuuccaacuuccccucaagagccagcgccacggcguaggccgaugcacauucgaacgcggcaaaccacgcugcgcggacucacacccagacuacgaagaguucagaaugcucugcuucgucaauaauauccaagucaaaggcccucacgaccucgagcucaggccgcuaaccuacgaggagcgagagaaaauagaacaccuauucuuccgcaaaaguaaacccaacuucgacuucgaggacaucgccaaagaacuagcaggcaagaaaaacuacgccuggauccacgacaaagaggagcgcgccuacaaauucaacuauagaaugacgcaaggcgugcccggcuguccaaccacggcccaacuaaaaucgauauucggcgacgacuggaagacgggcaucgccgagacauacaccuuaauacagaagaaaaacggcucaaagucgcuccaggaaauggucgacgacguguggaacguacucuauucauucagcagugucgaaaagcucaaagaguucgcacaccacaaacugcagcuagacgaagaaaacgccgaaaaauucgccaagaucaaacucucacauagcuucgcugcccucucccuuaaagcgauccggaaauuccuaccguuccuccgcaaaggcauguacuacacacacgccagcuuuuucgcaaacauaccaacaaucgugggcaaagaaauauggaacaacgagcagucccgaaaguacaucauggagaacguuggagagcucgucuucaacuaccaacccaagcauagagacguccaagguacuaucgaaaugcucaucaaggacuuccuagccaacaacuucgagcuaccggccggagcaaccgauaaacucuaccaccccagcaugauagaaaccuacccacaugcgcuccgcaacgaguucggaauacugcaacuaggcagcccccgcaccaacgcaauacgaaaccccauggccaugcgaagccuacacgugcucagacgcgucguaaaccaacuccuaaaagaaagcaucauagacgaaaacaccgaaguccacguagaauacgcucgugaacuaaacgacgcaaacaagcgccgcgcaauagcugaccgacaaaaagaacaagacaaacagcacaagaaauacggagacgaaauacgaaaacucuacaaagaagagaccgguaaagacaucgaaccgacacaaacagacguacuaaaauuccaacugugggaggaacagaaccacuauugccuuuacacaggagaacaaaucgguauuacggacuucaucgguagcaacccaaaguucgacauagaacacaccaucccacaaucaguuggcggagacucaacacagaugaaucuaacccucugugacaacagguucaacagggaagucaagaaagccaaacucccuacggaauuggccaaccacgaagagauccucacgcgcaucgaacccuggaaaaacaaauacgaacagcuaguaaaggaacgagacaaacaacgaacauucgcggggauggacaaagcggucaaagacauccgcauccagaaaaggcacaaacuccaaauggaaaucgacuauuggcgcggcaaauacgagagauucacaaugacagaagucccggaaggcuuuucgcggcgacaaggcacaggaauaggucuaauaagccgauacgcaggacuguaccugaagucacuauuccaccaggcagacucucgcaacaagaguaacgucuacguaguaaagggggucgccaccgccgaguuccggaaaauguggggacuucagagcgaauacgaaaagaaaugccgcgacaaccacucacaccauuguauggaugccauaaccauagccugcauaggcaaacgagaauacgaccugauggcagaauacuaccacauggaagaaaccuucaggcagggccgcggaagcaaaccgaaauucucaaaaccgugggcaacauuuaccgaggacgugcucaacaucuacaagaaucuccuggucgugcacgacacgcccaacaacaugccaaaacacacaaagaaauacguccagaccagcaaaggaaaaguacucgcccagggugacaccgcucggggcagccuccaccuagauaccuacuacggggcaauagaaagggacggagagauaagauacgugguaaggagaccacucaguucauucacgaaccccaaagagcuugaaaacaucguagacgaaacagucaaacgaacgauaaaagaagcgaucgcggacaaaaacuucaaacaggcaauagcagaacccaucuacaugaacgaagacaaaggcauauuaaucaagaaaguacgcugcuuugcgaacagugucaaacaacccaucaacauccgccaacaccgagacuuauccaagaaagaguacaaacaacaauaccacgucaugaaugaaaacaauuaccugcuagcgauuuacgagggcuuagucaaaaacaaagucgucagggaguucgaaauaguaucguacauagaagccgccaaauacuacaaaagaucccaagacagaaacaucuucagcagcaucguaccaacacacucgaccaaguacggguuaccccuuaaaacaaaacuacucaugggccaacaaguccuuauguucgaagaaaauccagacgaaauccagguagacaacaccaaagaccucguaaaacgcuuauauaaggucgucgggaucgagaaagacggccgcaucaaguucaagcaccaccaggaagcccgaaaagaggggcucacuaucuacagcacuccguacaaaaacaacgacgacuacguccccauuuuccgacaaucaaucaaaaacauaaauauccuaguagacggcaucgacuucaauauagauauccucgggaaaguaacgcucaaggaguga

SEQ ID NO: 6368 - RNA, 3657 nt, Artificial Sequence
  Cas9 variant
augaacaaaagaauacucggccuagacacuggaacuaacucacuaggaugggccgucgucgacugggacgagcacgcgcaaucuuacgaacuaaucaaauacggcgacgucauauuccaggaaggagugaaaauagagaaaggaaucgaguccagcaaggcagcagaacgcaguggauacaaagccaucagaaagcaauacuuccgaagacggcugcgaaagauccagguccuaaaaguccucgugaaauaccaccucugccccuaccuaucagacgacgaccuucgccaauggcaccuccaaaaacaguaccccaaaagcgacgagcucaugcuguggcaacgaacaucagacgaagagggcaagaauccguauuacgaccgacaccgcugccuccacgagaaauuggaccucaccgucgaagccgaccguuauacacucggccgagcccucuaccaccuaacccagcgccgcggguuccuaucaaaccgacuagacacgagugcagacaacaaagaagacggcguugucaaaagcgggauaagccaacucaguaccgaaauggaagaggcugguugcgaauaccucggagauuacuucuacaaacucuacgacgcccaaggaaacaaaguacgaauaagacaaagauacacagacaggaacaaacacuaccaacacgaauuugacgcgaucugcgaaaaacaagaacugucguccgaauuaauagaagaccuccaacgcgcaaucuucuuccaacuaccccucaagagccaaagacacggggucggccgcugcacauucgaaagagggaaacccagaugcgccgacucacaccccgacuacgaagaguucaggaugcucugcuucgucaacaacauccaagucaagggaccccacgacuuagaacuccgcccacuaaccuaugaagaaagagaaaagaucgaaccgcuauuuuuccgaaagagcaaaccaaacuucgacuucgaggauaucgcgaaagcgcuagccggcaagaaaaacuacgccuggauacaugacaaagaagaacgcgccuacaaauuuaacuaucgcaugacgcagggcgucccagguugcccgaccaucgcccagcuaaaaagcauauucggagacgacuggaaaacaggcaucgccgagacguacacccugauacagaaaaagaacggcucuaaaucccugcaagaaauggucgacgacguauggaacguacuuuacuccuucucguccguggaaaaacucaaggaguucgcccaccacaaacuccaacucgacgaagaauccgcagaaaaauucgccaagaucaaacucucacacucauucgccgcccuaucucucaaagcaauucggaaauuccuccccuuccuccgaaaagggauguacuacacccacgcaucauucuuugccaacauaccuaccaucgugggaaaagaaauauggaacaaagaacaaaaccgaaaguacaucauggaaaacguaggcgagcuggucuucaacuaccaacccaagcaccgggaaguccagggaacaauagagaugcuaauaaaagacuuucuugccaacaacuucgaacucccagccggagcaaccgacaaacuauaucacccaagcaugaucgaaaccuauccaaacgcccaacggaacgaguucggcauacuacaguugggcucaccccgaacaaacgcgauucgaaacccaauggccaugcgcucccuacacauccuacgcagggucgucaaccagcuacuaaaggaaucaauaauagacgaaaauaccgaaguccacguugaauacgcacgcgaguugaacgacgccaacaagcgacgagcaaucgcagaccgccaaaaagagcaggauaagcaacauaaaaaguacggagacgaaauacggaaacucuauaaagaagaaaccggcaaggacaucgaacccacccagacagacguucucaaguuccaacuuugggaggagcaaaaccaucacugccucuacacaggcgaacagauaggcauaacagacuucauuggcucgaacccuaaauucgacaucgaacacacaauaccacaaucaguuggcggcgauagcacccagaugaaccugacccucugcgauaacagauucaacagggaagucaagaaagcgaaacuccccacggaacuugccaaccacgaagaaauccugacccgcauagagcccuggaaaaacaaauacgagcagcuuguaaaagaacgcgacaaacagcgcacuuucgccgguauggauaaagccguaaaggacaucagaauccaaaagcggcacaagcugcagauggagaucgacuacuggcgcggcaaguacgagcgauuuacaaugaccgaagugccggaaggcuuuagccgacgccaaggcacuggaaucggccugaucucgcgauacgcgggucucuaccuaaaaucucucuuccaccaagcagacucgcgaaacaaaaguaacgucuacguaguuaaaggcgucgcgaccgccgaguuccgcaaaauguggggccugcaaucagaauacgagaaaaagugccgagacaaccacagccaccacuguauggacgcaauaacaaucgcuuguauaggaaagagagaauacgaucuaauggccgaauacuaccgcauggaagaaacguucaagcagggccgcgggaguaaacccaaauucagcaaaccgugggccacuuucacagaagauguacucaacaucuacaaaaaccuccugguaguccaugacaccccgaauaacaugccgaaacacacaaagaaauacguacagaccagcauaggcaaaguauuagcacagggagacaccgcaagaggcagccuccacuuagacaccuacuacggcgccauagaaagagacggcgagauacgcuacgucgucagacgcccguuaagcucauucacaaaaccggaggaacuugaaaacauugucgacgagacugucaaacgcacaaucaaagaagcaaucgcggacaaaaacuucaaacaggcaauagccgaaccaaucuacaugaacgaagaaaaagggauacucaucaaaaaggucagaugcuucgcaaaauccguaaaacaaccaauaaacauacgacaacaccgagaccuaucaaagaaagaauacaaacaacaauaccacgucaugaaugaaaacaacuaccuccucgcgaucuacgaaggacuugucaaaaacaaaguaguacgagaguucgaaaucguaagcuauaucgaagcggcaaaauauuacaaacgaucacaagaccguaacaucuucagcuccaucgugccuacccacaguacgaaauacggacuaccccucaagacuaaacuacuaaugggccaacucguccucauguucgaggaaaacccagacgaaauccaagucgacaacaccaaggaccucgucaaaaggcuauacaaggucguaggcauagaaaaggacgggaggaucaaauucaaauaccaccaagaagcacgcaaggagggacugcccaucuucuccacaccguacaaaaacaacgacgacuaugccccaaucuuccggcaaagcaucaacaacaucaacauucucguggacggaauagauuucaccaucgacauccuaggcaaagucacccugaaagaguga

SEQ ID NO: 6369 - RNA, 3657 nt, Artificial Sequence
  Cas9 variant
augaauaaacgaauauuagggcuagacaccggcacaaacagucuaggaugggccgugguggauugggaugaacacgcccagucguacgaguucauaaaguacggcgacgugaucuuccaggaaggggugaaaauugaaaaaggcauagaauccucaaaagcggcagaacgcuccggauacaaagcgauacgcaaacaguacuuucggagacgacugcgaaaaauccaagugcucaagguccuugucaaauaccaccugugcccuuaccuaucggacgacgaucuccgacaauggcaucugcaaaaacaguaccccaagagcgacgaacugaugcucuggcaaagaacguccgauaaaaagggcaagaacccguacuacgauaggcacaggugccuucacgaaaaacuagacuuaaccguagaagcagaccgcuauacccuaggccgcgcucuauaccaccugacgcagcggcgaggcuuccucagcaauagacucgacacgagcgcagacaacaaagaagacggaguagugaaaaguggaauuagccagcucagcaccgagauggaggaagccggcugcgaguaccucggggacuacuucuacaaacucuacgacgagcaaggcaacaagguaaggauccggcagcgcuacaccgaccgaaacaaacacuaucaacacgaguucgaugcgaucugcgaaaaacaagagcucagcagcgagcugaucgaagaccuccagcgcgcaaucuucuuucagcucccccuaaagucgcaacgucacggcgucgggcgcugcaccuuugaacgcggcaaaccccgaugcgccgacucccacccggacuacgaggaguucagaaugcuguguuucguaaacaacauccagguaaagggaccccacgacuuagaacuaaggccacugacuuacgaagaacgagaaaagauagaaccccucuucuuccgcaaaucuaaaccgaacuucgacuucgaagacaucgccaaggcccuagccgggaaaaagaacuaugccuggauccacgauaaagaagaacgagccuacaaguuuaacuaccgcaugacucagggaguaccaggcugcccaaccacagcacaacucaagucaaucuucggggacgacuggaaaacaggaauagcggaaacauacacgcugauccaaaagaaaaacggcucaaaaucccuacaagaaauggaagaugacgucuggaacgugcuauacuccuucucguccgucgaaaaacucaaagaguucgcacaccacaaacuacaacuagacgaagaauccgccgagaaguucgcaaaaaucaaacuaagccacaguuucgccgcucuuucccucaaagcaauaagaaaauuucuucccuuccugcguaaaggcauguacuauacacacgccagcuucuucgcaaacaucccuaccaucguaggcaaagaaauauggaauaacgagcaaaaccgaaaauacaucauggaaaacguaggggaacuuguauucaacuaccagcccaaacaccgggagguccaaggaacgauagaaaugcucauaaaagacuuccuugcaaauaacuucgaauuaccagcaggagcgacagauaaauuauaucacccguccaugauagaaaccuacccacacgcccagcguaaugaguucggcauccuacaacuaggaucaccacgcaccaacgcaauccgcaacccuauggcaaugagaagccuccacauauuacggcgcguuguaaaccaacuccugaaagaaucgaucaucgacgaaaauacagaaguccacgucgaauaugcgcgagaacuaaaugaugccaacaaacggagagcgaucgcgggauggcaaaaagagcaagauaagcaacacaagaaauacguagacgaaauaagaaaacuauauaaggaagaaaccggaaaagacauagagccuacccaaaccgauguccuaaaauuccaguuaugggaagaacaagaccaccauugccuguacacaggcgaacagauuggcaucaccgacuucaucgguuccaacccgaaauucgacaucgaacacacaaucccacaaucgguuggaggcgacagcacacaaaugaaccuaacccuuugcgacaaccgcuucaaccgugaaauuaaaaaggcaaaacuaccagcgcaacucagcaaccaugaagagauacucgcaaggauagaacccuggaaaaacaaauacgaacagaaaaucaaggaacgcgacaaacagcgcaccuuugccggcauggacaaagcggugaaagaccuaagaauacagaaaagacacaagcuccaaauggacauagauuacuggcgaggcaaauacgagcgcuucaccaugacagaagucccagaaggcuuuucccgucgacaaggaacaggcaucggcuuaauaagcagguacgccggccuuuaccucaagucccuuuuccaccaagcugacagccgaaacaagaguaacguguauguagugaagggggucgcaacugcugaguuccgcaagauguggggcuugcaaagcgaguacgaaaagaaaugccgcgacaaccacucacaccacuguauggacgccauaacaauagcaugcauaggcaaacgggaguacgaccucauggccgaauacuaccgaauggaggaaaccuuccggcaaggccgcgguaguaaacccaaauucagcaaacccugggcaacauucacagaagaugugcuaaacaucuacaaaaaccuccucgugguccacgacacgcccaacaacaugcccaaacacacaaagaaauacguccaaaccaguaaaggaaaagucuuagcucaaggcgacacagcgcgcggaucgcuccaccuagacaccuacuacggagccaucgagagagauggcgagauccgauacguaguccgcaggccgcuaagcagcuucacaaaaccuaaagaacuggaaaacauagucgacgagaccgucaagaggaccauuaaagaagccaucgccgacaaaaacuucaaacaagcaauagcggaacccauauacaugaaugaagacaaaggcauucuaaucaagaaaguacgaugcuucgcuaaaagcgucaagcaacccaucaacauacgccaacaccgcgaucuaagcaagaaagaauacaaacaacaauaccacgucguaaacgagaacaacuacaugcugguaaucuacgaaggacuggucaaaaacaaaguaguccgcgaguucgaaaucgugagcuacaucgaagcugccaaauacuacaaacgaucccaggacaggaacaucuucucuagcauagucccuacccauucagcaaaauacggacucccacucaagaccaaacuccucaugggacagcuagugcucauguucgaagaaaaccccgacgaaauccaagucgacaacaccaaagaccugguaaaacgauuguacaagguagucggaaucaaaaaggauggacgaguaaaauucaaauuccaccaagaagcucggaaggauggacuucucauauuuagcacacccuacaagaacaauaacggcuacguccccauauuccgccacuccaagaaaaacauaaacauccuaguugacggcaaagacuuuacgauagauauacucgggaaagugacucugaaagaguga

SEQ ID NO: 6370 - RNA, 3660 nt, Artificial Sequence
  Cas9 variant
augaaagaggaaguaagagguaagaaccgcucacagacuugggccauccuggcaaaauucuucgucuggagcgaaaaggaaagcguguggaaugagaaagaagcgcggacagaagagagaguaaaagaauacaagcuagucggccucaaacgcgacaccaaaggcaacgagcugaagcuagagaauuacagguggcggguacaggcacuaagcgaacagcucaacccggagauagucgcgaucguccuacaagaaaucaacggacagaucagugccucgagcggauaccucggcgccaucagcgacagauccaaacaauuguauuucaacaggcaaaccgucggccaauaccuaaugucggaacuggaaaaggauccgaacgucucccugagaaacagaguauucuaucgccaggacuaccucgacgaguuugaccgcauaugggagaagcaagccgaguuccacgaagaacucaccgucgaacucaagaaagaaauccgagacauaauaaucuucuaccaacgccgccucaagucccaaaaaggccugauauccuucugcgaguucgagaaacgagaaguuguagucgaggaagacggacggaagaaaaacaaaaccgucggcugcagaguaaucccacggucacaccccuuauuccaagaguucaaaaucuggcaaacauugaacgacaucgaagucuucgcgugggacaagcagagcaaaagaaagaaagccgacaaguccucuauccuguucgacaacucagaagacgcccuccucgucgaagggaaacguuuucucuaccaggaggagaaggagcuacuagccaaagaauuauucguaaaagaaagcaugaagaaagcagaaguguuaaagcugcuauucgaaaacuaucaggagcuagaccuaaacuucaagcagauugacgguaaccacaccggcuucgcccuauucagcgccuacaguaagaugaucgagaaguacggauacgaacccgucgacuucaagcgaucggccgacgaaaucauagaaaaacucgaaaccauauuuacgaaccuaggguggaacacagaacuacucucaaucgaccucucaaaagaagacaaggaauuagagagacagucauacuuccgcuuauggcaccuacuauacucguuugaaggggacaacacccccacaggaaacggcaaacuccuagaaaagaucaugcaacuuugcgacguagagaaagaauacgcgguagaacuagcgaacgugagcuuccaagaggacuacggcucgcuaagcgcgaaggccaucaagaaaauccuaccguaccugaaagaaggaaaccaauacgacguagccugcgacuacgcaggcuaccgccacagcagaucgucucucacgaaagaugagaucgaaaacaaaauacuaaaagacaaacucgaaauucuacccaagaacucccuccggaaucccguaguggagaaaauacugaaccaaauggucaaucucauuaacacccucaucgacacauacggcaagcccgacgaaauacgcguugaacucgcacgcgaauuaaagaaaaacgcaaaagaaagagaggaacucacaaagagcauagcccgcaacacacgcgagcacgacgaaauccgccagcuccuccguaccgaguucgggaugaugaacgucagccgcaacgacauaauccguuacaagcuauacgaggaacuuaaagacaacggcuacaaaacccuauacucaaaugaauauaucccgcgagagaaaaucuucagcaaagaaaucgacauagagcacguaaucccacaagcacgucuauuugaugacucucucucaaacaagacacuggaauaccgagcgauaaacaucgagaaggggaauaaaaccgcguacgacuucgucaaagagaaauacggaaacgacggacuugagaaguuucucaaccgaugcgaaacccucuucaaagacaaaagaaccaagcuacgaaaacuaaagauggaagagaaggacauacccgaagguuuuaucgaccgggaccugaggaauacgcaauacaucucaaagaaagcauucgccaugcuaaacgagauaagccgccgaguaguagcgaccacuggcagcauaaccgauaaauuacgcgaagauuggcagcuaguagaccugaugaaagaacugaaccucccaaaauaugagaaacuggggauggucgaaauguucgaagacaaagacggucgcaagaucaagaaaaucaccgacuggacgaaaagaaacgaccaccgccaucaugcgguagacgcccuaaccguagccuucaccaaagacguauucauccaauucuacaacaacaaaaacgccgcuuggaugcccgcgagcaaagaacacgcaaauauaacggggaucaaggccagguacuucgagaacgggaaagcacuagcucccaugccucuagcacaguuccgcgccgaagccaaacgucaccucgagaacuuacucguaaguaucaaggcgaaaaauaaaguaaucacaagcaauguuaaccgcaccaaaaacaagaacggagaaaaccggaaacugcaacaaacaccccguggacagcuacacuuagaaacgguuuacggcucacaccgccaguacgccacuaaaauagagaaggucaacgccgccuucgacguaacaaagaucgccacugugagcaagcuagccuaucgaaacgcacugcuaaagcggcucgaggccuucgggaacgaucccaaaaaggcuuucacuggcaaaaacacgcuagagaaaaacccacuguaccuagacgaaaaccaaacagaaauggucccagaaaaggugcaaacagucgaguucgagacaguguacacuauacgcaaacccauagaccccaaccucucgaucgacaaagucgucgacgucaaaauaagaagugugcucgagaagcgccuaaaggaauacggaggcgacgcgaagaaggccuucguuaaucucgacgaaaaccccauauggcucaacgaagccaaaggaauaagcauaaaacggguuuccauccgaggcauaagcaacgcucagagccuccacgaaaagaaagacaaagacggcaaccucauacuagggaaagagggcagaaaaauaccaguggacuucguaaacacgggaaauaaccaccacguggccaucuacaagaaacccguccuggacaaagucggacagguaguccuagacgaagagggaaaccccaaguacgagcuagacgaagucgugguaucauucuucgacgcagucacacgcgcgaaccuaggccaaccaaucaucgacaaagacuacagaagaagcgaagguuggcaauuccucuuuucgaugaaacaaaacgaauauuucguuuucccaaacgacaaaaccggauuuaaccccaaagaagucgaccuguuaaacccagaaaacuacgcacugauaagccccaaucucuuccgagugcaaaaauucgccuacaaaaauuacguauucagacaccaccuagaaaccacaaucaaagacaccuccucgacgcugaaaggcaucaccuggacagacuuucgcucaucgaagggacuggacaaaaucguaaaagugcgugucgaccacauaggacaaaucgucuccaucggcgaguacuga

SEQ ID NO: 6371 - RNA, 3663 nt, Artificial Sequence
  Cas9 variant
augaaacgaauacugggccuugaccucgggagugcgagcaucggcugggcgcucauagaagaagacgaaaaaggcauccggaucaucgcgcuagggucacguaucauaccauacaacggaaccgagggacaagacuucgccaaaggggcgggugaaucacguaacagcuugcgaacccaggcccgaacgacccgcaaaggcuacgaccgcuaccaacuacgaagaaaauaccucaucaacguacucgagaaaaaccugaugaugcccuccgaagaccugcgcaagaugccgaagaugaaucuauggcagcuacgauccaaagcggugaccgaauacauaagcagacaagaacugggacgccuccuccuauggcugaaccaaaaacgaggguacaagucuuccagaagcgacgcuaaucuggacaaaaaggacaccgacuacgugaaggaagugaaaagccgauucgacaaaaucaaagagaaaaaucaaacuaucggccaauacuuuuacgagagcuuacaaugcgacgaauacuuccgagucaaagaaaacgucuucccgcgcgaagcauacauugcagaguucgacgcaaucugcucccgacaaaaagaccaccucggccucuccgaagaauuaaucgcagagauccgaaacgaaauaaucuacuaccagaggccacuaaaaucacaaaaaggccuuguaagugucuacgacuucgaaggaaaauggaugaaccaaaacggcaaagaacucuucauaggucccaaaguagcccacaagagcagccccuuauuccagcuugccaaaauaugggaaagcgugaacaacaucaaacucagcaccaaauacggagacacuaucgagcuaacccucgaggaaaagaaacaacucguagaguuccucgauaacaacgaaaagcucaccacggccgcacucuucaagauacugcgaaaggacaagaaagaauacauacuacccaaacagcuagagaagggccuacaaggaaacaucaccaaaugcaaaaucgcagacauccuaggaaguaaauauaaccaacuacuacaauugaaccucgagaaacaggaagugggaaccccaugcuaccuauacacuaagagcacgggcgagguccucggcgaaaagccacuacaauacaucgacaaguccguggagaaggaacucuucuaucaacuguggcacaccaucuacagcaucagcgacgaggacgagugcugcaaagcccugcagaaacgcuucgacauagacgccgaaacagcuggacgucuagccaaaaucgacuucagcaaguacggauucggcaauaaguccgccaaagccauucgaaaaauccuucccuaccugauggaaggcgacaaguacagcgacgccaugugcuacgccggcuacaaccacaguaacagcuugaccaaggaagaaaaccaugagcgcaaauuaaacgacaaacugaagcuccuaacgaagaacucacuccgacagcccauagucgagaagaucaugaaccaaaugauacagcuaguaaacacaauaauugacaaguacgggaaacccgacgaaauacgccuggaacucgcccgcgagcucaaacaaucaaaagaagagagaaacgacgccgacaaagccaugucaaaacgacaaagggaaaacaaagaagcagaaaagaaacucgaggaacacggaauacgggccacgcacaacaauauacuaaaauaccgacuguucgaggaaaugggcgagaaaaagcacgaagccauaugcaucuacugcggaaaccccaucagcuuuagcgcagccaugaauggugacgaaguagacgucgagcacaucaucccccgcaguaaacucuucgacgacucgcaaucaaacaagacccucgcacacaggaagugcaacgcaaacaaaaacgacaugacugccuacgacuucaugaagacgaaaucuaagcaagacuucgauaaauacgucgaacgagucaaccaacucuacgccgacagaauaaucucaaggucgaaauacaacaaauuacuaaugucggaagacgacaucccgagcaacuucauagacaggcaacuacgcgaaucccaauacaucgcaacaaaagcacgagaaauccuacaaacgaucugcuacaacguauggagcaccaguggcacagucacagccgaacugcgccaccucuggggcugggacgacauaacaaugaaccuccaaaugccgaaauauaaagagcuggggcuaaccgaaaugguggaauggaccuccgaccauggcaaaaacguacacuccaaagaaguaaucaagggcuggaccaagcgggacgaucaccgccaccacgcaaucgacgcucuaaccauagcgugcacaaagcaaggcuucauccaacgauucaacacccucagcuccaguaaaacuagagaugacaugcagaaggaacuggaaaagugcucaauacaauuccgggagaaacgcagcuuacucgagaaauacaucaucucccaacgacccaucagcgucuccgacgucgccgaggccgucagcaggauccucaucuccuucaaggcaggaaagaaagucgcuacaauaggaaagcggaaagucaaggggaaagucguacagcaaggcauagucgugccccgcggcgcacuuagcgaagguucaguguacggcaaaauacgcacaaucgugcgaaagaugcccgucaaguaccucuucgagaacccggaccucauauucaagcccuacauaaaagcccuagugaaagaacgccuagccgaguucgacaacgacaacaaacaagcauuagcaucccuaaagaaaaaccccguuuaccucgacaaagaaaagacaaagcuccuggaauacggaaccugcuuuaaagacgaauacgugaagaaguacgacgucaacccgaacuucacgaaaaucgcagauguuauugacggcaagguaaagcaaauccuagaagaccgccugagcaaguucggagggaaacccaaagaggcuuucaaggacgugguuaaggacggcaaaacgcuaaaaugguacgaggacgagggccuggagcguccuauccguagugugcguugccucacgggacuaucagcaguagucccgguaaagaaagacgagaacgggauggacauaggauucgucaaacccggcaacaaccaccacguagcaaucuacgucggcgccgacggaaaaggucaggagcacgucugcaccuucuggaaugcaguagaaaggaagaaauacggacucccaaucaucauaaaagaugcuaacgagguaugggacaaaauaacgauggcuggggacgacgucuacccccagagcuuccucagucuccuccccaagccagacuggacccucaaacuuagcaugcaacagaacgaaauguucauucuggggauggaagaggacgaggucaaguucgccaucgaauccaaagauuacaaacuacuaagugaccaccuguacagggugcaaaagcugagcucgagcgacuacaacuucauccaccaccuggaaacggacguucagaagaaaaccaugaccuaccguguccggucgcuaucgggccuguucgcgcuccgccccuucaaaguccgcauagauugccuagggaauauaauacccagcuga

SEQ ID NO: 6372 - RNA, 3669 nt, Artificial Sequence
  Cas9 variant
augaaaaagaggauacuaggccucgacuccggaacaaacucccuaggcugggccguaguagaccgcgacgaaaacaaccaauacucgcucauaaaguacggagaucucaucuucgaggaaggcgugaaaaucgagaaagguguggaauccucaaaagccgcagagcgcacuagccaccgagcccuccguaagcuauauuucagacgacgccuaagaaagaucgaaguacuaaaaguccucgucaaauacaaccuaugcccccaagucucagaggaagaacuacaccucuggcacacaagaaagcuguacccacaaaacaaggaccuacuccaauggcaacgcacagacgaaaaagccgggaagaacccguacauauaccgcuacagaugccuccacgaagaacucgacaugagcgucagugccaauagaaugacagugggacgcgcgauguaccaccuggcccaacgccggggcuuucugucaaaccgccucgacaacgaggaagacgaaaaccaaaucggugcggucaaaugcgggaucaguaaccucaccgaggaaauccaaucaagcgggugcaaauaccuaggagaguauuucuacaaacucuacaacgaacacggcaacaccguuagacugcgcacccgcuacaccagccgcgaguuccacuacaagaaagaguucuacgccaucugcgaaaaacaaaaacucgacaaaaagcucaucgaagaacuggcauccgcccuauacuuccaacgcccuuugaagucccaacgccacacagucggaaggugcaccuucgaaccaaacaaaccacgaugcgccgacucacacccggcguacgaagaguuccgaaugcucucguucaucaacacaaucaaaguccagggccccuacgauacagaacuucgcguucuaaacacagaagaacgcgacuccauaacaaaacuauucugccgcaaaaguaaacccaacuucgacuucgaagacaucgcaaaagagcuggccggcagaaacaacuacugcuacaucggagacgucgucgacaaagcauacaaauucaacuaucggaugagccagggcgucagcggcugcccaaccaccaccuaucucauaaacguauucggacaagacuggcaaacaggaaucgcagaaagcuaccaagccaucgacacaaagcugggccaaaaauccguagacgccaugauagacgacgucuggaacguccucuacuccuucucgucaaaggacaaacuccgcgacuucggccgcaagaaacuccaacugggggauaaagaggcugacacauucgcuaacauaaagcugacccacaaauucgcuucacuuucccucaaagcuauaagaaaaauaaacauauuccugcgcaugggccucguauacagccacgcagugacacucgcuaauauaccaaccaucguaggcacagacaucuggcaacgcaagcgaaacuucauacucgcggagcuccugccacuaaucgaaaacuucaacccuaaagagacaaaacugcaagaaacccuagauuucugcguaaaagacuuccuucaaaacaacuucgagcugaaaaacggggccguggacaaacuauaccacccuagcaugauagaagcauacccagacgcgggccugaacagcaauggcauacugcaacucgguagcccuagaaccaacgccaucaggaaccccauggcaaugcgcagccuccacgaaauccggaaaguaaucaaucaguuacucaaagacaaaauaauaaaccaagacaccgagauccacguagaauacgcccgcgagcucaacgacgcaaauaaacgaaaagccauaagcauauggcagaaaucacaagaaaagcugcacaagaaauacgucgaagagaucacgaaccuauacaaagaggagaccggaaaagcaaucgugccaacagauacggacauacucaaguucaaacucugggaggagcagaaccacaucugccucuacacaggacagcagauaggcauagccgaguuccuaggugcaacgccaaaguacgauauagaacauacgauaccgcagucagucggcggcgacuccacggauaugaaccuaacccucugcgacucaagauucaaccgcgaaaucaagaaagcgcaauugcccacacagcucgguaaccacgcggacauacuuguccgcaucgcuggcuggaaaaacagcuacgaaaaacuaagcaaagacauagaccgaauacgcacccauagcggaauggcgaaagacauaaaggaucgccuaauacagaaacgccaccuccucaagcucgaaagggacuacuggcgcggcaaauacgaacgauucaccaugaaugaaauaccagagggguucagccgaagacaaggaguuggcaucggccuaaucagcaaguacgccggccuuuaccugaaaucccucuuucacgacaagaacgaacgcaacaaaggacacguguucgucgugaaggggacaaccaccgcagaguucagaaaaauguggggacuacaaaacgaauacgaaaagaaaucacguaacaaccauguccaccacugcaucgacgcgaucacaauugcgugcaucgggaaacacgaauacgcacaaauggcgcaauacuaucacgacgaagcagaauaucucuaccaccacggcauaaaacccaucuucccgaaacccuggaaaaccuucacggaagaucuccuagaccucgaacacucacucuucgucguccaccacucacccaacaacauggccaagcaagcacgcaaacggauuauaacuucaacuggacagcacugggcgcaaggggacuccgcacacggcucacuacacaacgacaccuacuacggcgcaauagaacgagacggcgaaaucaaauauguagugaggcgggccgugagcucauucgaacaaaugagcgacgucgacagcauuguagacgacgugguuaaggaaaccgucagaaaggcacuugagggcaaaaacuucaaggaagccgucaacgccccaauauacaugaacaaagagaagggaguuuuaaucaaaaagguacgcugcuacgccaaauccauaaagaaacccauagacauacguacgcacagagacucauccucaaaagaauacaaacgcaaauuccacguauccaacgacaucaacuaucucauagccaucuacgaaggcacagucaaaggaaaagucaaacgggacuucgaagucgugaaaaacaucgaagcagcuaacuuuuucaaacgaucccaagaccgccgcgauuacccuaccaucguccccgagaaauccaucaaacacgguuucccccucaaaaccacccugaccaauggaaccaugguuauacucuaugaggaaaacaaagaagaaauagacuucaccaagaaagaggacauaugucgcagacuauauaaauuggucggaaugaguucuaugauaguguccggaugcgaguacggggugcugucgcuccggcaccaucaagaagcccgccccaguaaggacaucaaguccaaaaacggagcauucaaaaacggagaagcgcuccgaccagcaauuacgaugcuacacacccaguucaacgcacugguagagaacauugacuuuaacauagacgucaccggcaacaucgagcucauauga

SEQ ID NO: 6373 - RNA, 3669 nt, Artificial Sequence
  Cas9 variant
augaagaaaagaauccuaggacuagacucgggcacgaacagccucggcugggccgucgucgacagagacgaaaacaaccaguauucacuaaucaaguauggggaccuuaucuucgaagaaggagucaagauagaaaaaggggucgaaaguagcaaggccgccgaacgcaccucccaucgagcccucaggaaacuuuacuuccgacgccgacuacgaaaaaucgaagugcucaaagugcuaguaaaauacaaccucugcccccaaguaagcgaagaagaacuacacuuauggcauacgagaaaacucuacccacaaaacaaggaccuacuccaguggcagagaacugacgaaaaggagggcaaaaaccccuacauauaccgcuacagaugccuccacgaggaacucgacaugagcguaucggcgaaccgaaugaccguaggacgcgcaauguaccacuuagcccaacgccgaggcuuccuuagcaacagauuagacaacgaagaggacgaaaaucaaauaggagcagugaaaugcggaaucucaaaucuaaccgaagagauacaaucaagcggcugcaaauaccucggcgaauacuucuacaaacuauacaaugaacacggcaacaccguccgccuucguacacgauacacgucacgagaguuccacuacaagaaagaguucuacgccaucugcgaaaaacaaaaacuggacaaaaagcucaucgaagaacuagccuccgcccucuacuuccaacgaccucugaaaagccagcgacacacuguaggccguugcacauucgagcccaacaagccacgaugcgccgacucccaucccgccuacgaagaguuccgaaugcuaucauucauaaacaccaucaaaguccaaggcccauaugacaccgaacuccggguacucaacacggaagaaagagacuccauaacgaagcuauucugccgcaaaagcaagcccaacuucgauuucgaagacaucgccaaagaacuggccggacgaaacaauuauugcuacaucggagacgucguagacaaagcauacaaauucaacuaccgaaugagccagggcgugagcggcugcccgacaacuacauaccucaucaacguuuucggccaggacuggcaaaccggcaucgcagaaagcuaccaagccaucgacacaaaacuaggccagaagucuguagacgcaaugaucgacgacgucuggaacguccuauacagcuucuccagcaaagacaaacuccgggacuucggccgaaagaaacuccaacucggcgauaaagaagccgacacauucgccaacauaaaacugacacacaaauucgcgucccucagccucaaagcaauacgcaaaaucaacauauuccucaggaugggccuaguguauagccacgcagucacacucgccaacauaccgacaauagugggaacagacauauggcaacgcaaacgcaacuucauacucgcagaguuacugccgcuaauugagaacuucaaccccaaagaaacaaagcuccaagagacacuugacuuuugcgucaaagacuuucuacagaacaacuucgaacucaaaaacggcgcaguagacaaacucuaccaucccucaaugaucgaagccuaucccgacgcaggccucaacuccaacggaauccuccaacuuggaagcccgagaacaaacgccauccgcaaccccauggcuaugaggagucuacacgagauacgcaaaguaaucaaccaacugcugaaagacaaaaucaucaaccaggacacagagauacauguggaguacgccagagaacucaacgaugccaacaaacgaaaggcaauuuccauauggcaaaaaucccaagagaagcuacacaagaaauacgucgaagaaaucacgaaccuauauaaagaagaaacgggaaaagcaaucguaccaaccgacacagacauccugaaauucaaacucugggaggaacaaaaucacauaugccuauacaccgggcagcagauagggauagccgaguuucuaggggcaaccccaaaauacgacauagagcacaccauuccccaaagcgucggcggugacaguacagauaugaaccuaacacucugcgauucccgauucaacagggaaaucaaaaaggcacagcugccgacacaacuuggcaaccacgcagacauucuaguacgcauagccggcuggaagaauagcuacgaaaaacucagcaaagacauagaccgcauccgcacacacagcggcauggcgaaagacauuaaagauagacucauacagaaaagacaccuacucaaacuugagagggacuauuggagaggcaaauacgagagguucacuaugaacgagauacccgagggauucucccgccggcaaggaguuggcaucgggcugauauccaaauacgcaggcuuguaccuaaaaagucuguuccacgacaagaacgaacgaaacaaaggacacguguucgucgucaaaggcacgaccaccgccgaguuccggaaaauguggggccuacaaaacgaauacgaaaagaaaucccguaacaaccauguacaccacugcauagacgcaauaaccaucgccugcauugggaaacaugaauacgcacaaauggcacaauacuaccacgacgaagccgaauaccucuaucaccacggaauuaaaccaaucuuccccaaacccuggaagacauucacagaagaccucuuagaccuggagcacagcuuguucgugguccaccacagccccaacaacauggcaaagcaagccaggaaacgcauuaucaccaguaccggccaacacugggcacagggagauucagcccacggcucccuucacaacgacaccuacuacggcgcaaucgagcgagacggagaaauaaaguacgugguccgcagggccgucagcucauucgaacagaugagcgacgucgacagcaucguagacgacguaguaaaggaaacgguccgaaaggcgcuggaggguaagaacuucaaggaagcgguaaacgcccccauuuacaugaacaaagaaaaaggaguucuaauaaagaaaguacggugcuaugcaaaaagcaucaagaaaccgauagacauccgcacgcaccgagauagcagcucuaaagaauacaagagaaaguuccaugucucaaaugacaucaacuacuugauugcaauauacgaaggcaccguaaaagggaaagucaaacgagacuuugaaguggucaagaacauugaagccgcgaauuucuucaaacgcucgcaagaccgacgcgauuaccccaccauugugccagaaaaaucgaucaaacacgguuucccacucaagacgacccuaacaaacggaaccaugguaauccuuuacgaagagaacaaggaagaaauagacuucaccaagaaagaagacaucugcagacgccuauacaaauuaguaggcaugucauccaugauaguaaguggaugcgaguacggaguucucucgcuccgccaccaccaggaggccagaccaaguaaagacauaaaaagcaaaaacggagcauucaaaaacggagaagcgcuacggcccgcaaucacuaugcuacauacacaauuuaacgcccucgucgaaaacauagacuucaacauagacgucacaggaaacauagaauugaucuga

SEQ ID NO: 6374 - RNA, 3678 nt, Artificial Sequence
  Cas9 variant
augucaaaacgaauccuggguauagacgucggcaccaacagccuaggaugggccguaguagaccgaacggacugcgacaacuacacccuuguaaagcgcggcgacguaauauuccaggaggggguaaacaucgaaaaaggcaacaucgagaaaagucgcgccagcgaacgcaccggccaccguucuacgagaaaacacuacuucagacgccgcaugcucaagauaaaaguccuagaaauccugguagaacaccagcuaugccccuaccuaucacacgaggaacuccaccaguggaugacacgaaaagucuacccaaccaacgaagauuuucgacuaugguugcgcacaaacgacgccaacgaccaaaaccccuaccacgaccgccacguuugccuucacgagagacucgaccuccgacuccaagaaaaccgauaccgacucggccgagcgcucuaccaccucgcgcagagaagaggguuucuauccaaccggcuagaacaaaacucuaaaacggacgaaacuggagccgucaaaucagacaucucccaacuaaacgaagaaaugaagaaagcaggaucccaguaccucggugacuauuuuuacuggcuguaccaagaauacggaaaccaagucacauuaaggauccgauacacagacagaaaacaacacuaccagaaagaguucgaagcgauaugccaacgacaacaacugucagacgaccucguggacaagcugcgccgggccaucuacuuccaacgcagccuuaaaagccaacgcgcaggaguaggaaaauguaccuuugagccggauaagccccgaugcgcccucucccacccccgcuacgaggaguuccgcaugcucucauuccuaaacaacguaaaagucaagggcccauccgacgacucccuaagaccacucagccccucggaaaaagagaaaaucaagccccucuuccuccgaaaaucaaaagcgaauuucgacuucgaagacaucgcaaaagccauagcuggcaagggcaaauaugcaugcauacgcgacaaagaaggggcacaaaaacccuaccaauucaacuacgcgcucagccaaggcgugucaggcugcccagucaccgcgaaauuaaucgcaguguucggagaauccugggaacgaaaucuaguaaacgcguaccgcucucgaaaugacaugcggaaaagcgacgaagagaucguaaacgaagucuggaacguacuuuacuccuucucaagcaaggaaaaguugcgagccuggggcauggaaaaacuaggacuggacgaagccugcgccggcgaguucgccgacauuacacuccccaccgccuucgccgcccuaucacugaaagccgucaauaaaauacucccauuccuaaggcagggcuucaucuacucacacgccguaaugcuggcaaauaucccguacaucauugggauggauagauggaacgaaccaagacaacggcaauucaucauggacaaccuacaagaacuacucgacaauuucaccgcuagcgacaaggcacuccaacaaacccucgacuuuugcauaaaagacuuccugcucaauaacuaugaacuagccccagguaaagcagaccggcuauaccaccccucaaugaucgaaacauacccagaugccaaagcagacggacaggguauauaccaacuggggucccccgccacaaacgccauacgcaacccgauggccaugagaagccugcacauccuccgacguguagucaaccaacuccucaaagagaaaaccaucgacucagaaacagaagugcacaucgaauacgcaagagaacuaaacgacgccaaccggagaugggcuaucaaccaguggcaacgcaagcaggaaacacagcgaaaagacuaugcggagaaaauacggaaggucuacgccgacgaauuugaaaaagugaucgaaccaacacaagaagaacuccuaaaauaccaacucugggaagaacaacaacaucuaugccucuauaccggagaacagaucggucuaacagauuucauaggacccaacccaagauacgacauagaacacaccaucccccaaaguaugggaggagacucaacccgaaugaaccucacucugugugaacguaccuacaacagaacgguaaaaggcaaccgaaugccgucacaacucgcagagcaugaaagcauccuaacucgaaucaagccuuggaaggacaaauacgaggaacugaccgugaaaauaaacaaacugcguacacacccgggcauggacaaggccuccaaagacaacaucauccgcaaacgccaccuacucgaacuugagcgcgacuacugguuccaaaaauaccaacgcuucaccaugaccgaagucccggaaggguucucccuacgccagggaacagguaucggccugaucggcaaauacgccggucucuuccuuaaaucacuauuccaccauguaaaagaacgaaaccgaaaacaagucuacgucauaaagggaccaaucaccgccgaguuccgccgccugugggggcuccagaaccuuuaugaacaaaagucgcgagauaaccacgcccaccacugcauagacgcaauagucauagcgugcaucaaccccgcugaauacgcaaggauggcaaguuacuaccggcaggaggaagauuuucgacuaaacaaaggcaacaagccugucuuccccaaaccguggaccacauucacccaagaccuucaagccuuagaggcagaacuccuagucguccacgaaacaagaaacaaccuaacaaagaaagcccgcaaacgugucaggaccaaaggggguaacguccuaagcgagucggacuccgccaggggcagccuacacaacgacacauacuacggagcaauacaaaaagacggagucauucgauacguaguacgaaaagcucucuccucgcucagcgaaaaagacgucaaagauauugucgacaagaccgucagagaaaaaguccaagccgcaauacaagagaaaggcgcuaaggaagcauuggcaggaaccaucuacaugaacgaagaaaaaggcauaaccaucaagaaaguacgauguuucaccaagaucgccucaccacucgccaucaggcgccacagagacgccagcgcaaaagaguacaagcgacccuacuacgugaccaacgagagcaacuauguuaugggcauauacgaaggaugcauaaaagagaaaaccaagcgcgaauuuauacuugucaacaaccucgaagcuguacgccaacuaaaggcagcccgcaaacaaggcguggucucguccauccuaccgccaguauccgcgaaaagccaauucccccuuaaauaccgccuauacacaggaacgcucguacugcucuaugagaacucccccgaagagauagacuuuacaaaccaaguggacauaugcaaacggcucuacaagguaaccggacucuccucaaugacuguuacgggcaaccaauacggaaccauccagcugcgcuaucaccaagaagcccgacaggcgaaggacuuaaaagcccaaaacggugcguacaaagagggugaagaacaccgucccgccauuaugaugcuccacacccaauucaaagcccucguggaaggcaccgacuuccggaugaacaucuuaggagaaauagaaccccuccggaaauga

SEQ ID NO: 6375 - RNA, 3690 nt, Artificial Sequence
  Cas9 variant
augggagaccgaaaguacaaccuaggacuugauaucggcaccagcagcaucggcuucgccgcagucgacgaaaacaaccagcccauacgcgugaaaggaaaaaccgccauaggcguucggcuauucgaagagggcaaaaccgcagccgaccgccgcggauuccggaccacccgaaggcgccuaagccgcagacgcuggcguaucaaccuacuaaacgagauauucgacgcccaccuagcggaagucgaccccaccuuccucgcaagacucaaagaauccaaccgcagcaaccuagaccccaaaaagucguuccaagggucccugcucuuuccagaacguaaggacuaccaauucuacgaagaguaccccacaaucuaccaccuacgcaaggcacucauggagaaagaucgcaaauucgauaucagagaaaucuaccucgccguacaccacauaaucaaauaccgggguaacuuccuaaacggaaccccaaugcguuccuucaaggucgaaaacauagaacucaacacccucuucgaccaacuuaaccagcuuuacgcagaaaucgucccagacaacgaacuggccuucgacuuagcacaaguagcggacgugaaagauguauuauccaguacaacaaucuacaaaauggacaagaagaaacagcuagucaaaaugaugcuccuaccagccagcaacaaagcccuacagucagagaacaaaaagaucgucacccaauucguaaacgcgauacugaacuauaaguuuaaacucgacguccuccuccaaguggagaccgacgccgacuggucccucaagcuaaacgacgaaggugcugacgauaaacuagaagaguucacaggcgaccucgacgaaaaccgccucgaaauaauugaccugcuccagaggcuccacaacugguucucgcucaacgaaauuacaaaggaugguaacagccucuccgcagccauggucgaaaaauacgaaaaccaccaccaccaccucggguuacucaagaaagucaucgaaaaccacccugaugccaagaaagccaaggcacugaaagagacauacacagccuacguaggcaaaaccgaugacaaaacccaaaaccaggacgacuucuacaaagccguugaaaagaacuuagacgacuccccagacgcaaagggcauaaaacgcuugauucagcuugaccaauuuaugccgaaacaaagaacggggcagaacggcgcgauaccgcaccagcuccaccaacaagaacuagaccagauaaucgaaaaacaauccaaguacuaccccuuccucgcagaacccaaccccaaugucaaacgccguaaagaugcacccuacaagcucgacgaacucauugcauuuaaaauccccuacuacgucgggccacucguuacccccgaggagcaggcacaaaacaaagaaaacguuuucgccuggaugaaacgcaaagcagcaggucccauaaccccuuggaacuucgacgaaaaagucgaccgcauggaaucagcaaaccgcuucauccgacggaugaccacaaaagacacguaccucuuuggugaggacguccuaccagcagaaucgaugauuuaccaaaaguucguagugcugaacgagcuuaacaaccucaaaauuaacgggcgccaccucucccucaaagacaaacaagacgucuacaacgaccuauuuaagcaacagaaaaccgucucuaucaaggccuugcaaaauuacuaugucacaaagaagaaagcagccacggccccgaccguuggcggccuugcggaucccaagaaauuccuauccucacuaucgacauacauugacuucaaaaacauguucggcgaacgcgugaaugauccgcaauuccaagaggaccuagagcaaaucguggaauggagcaccaucuucgaagaccgcggaauuuucaaagccaaauuacaagcgcuuggguggcucagcgaaaaacaaauucaacagcugguagccaaacgcuauaaaggauggggccgccucuccaagaaacuccucacgggccucaaaaacgcagaaggauacucaauacuagacgaaauguggcgcucaacggagaacuucaugcaaauccaaagcagacccgaguucgccgcacuaauccagcaggccaacgaaaaacaauucgaagggaaugaccccgacaacguaugggaaaacauugagaauauacuuggcgacgccuacacaagcccccaaaacaagaaagccauacgucaggucgucaaagucguccaagacaucgaaaaagccguaggcaacccgcccgagaaaauagcaaucgaguucacccgggaagccgccgcaaacccccagcggacgcaaucccgccuacgcacccuagaaaaacuguaugaaucggccgaagaaguggucgacgcgggacugacagcggaacuugcggaguucaaggaaaacaagcacguacugagcgauaaguacuaccuauacuucacccagcucgggcgugacgucuacacaggcgacacgaucagccuagacaaacuaaacgauuacgacguagaccacauacucccccaauccuuuauaaaggacgacagccuagauaacagaguccucacgauccgggcaguuaacaacggcaaaagcgacaacgugccagccaaaauguuuggaaagaaaaugggcucuuucuggagacaucuacucgacaacggaaugaucucaaaacgaaaauauaacaaccucaucaccgaccccgacaacaucucgaaauacgcgcagaaaggcuucauaaaccgccagcucgucgaaaccucccaagucaucaagcucacagccaacauacucaauggcaucuaugacaaggauacagaaauaauagaggugcccgcaaaaaugaacucgcaaaugagaaaaauguucgaccuagucaaaguccgggaagugaacgacuaccaccacgcauucgacgcauaccuaacgauauucaucggcaacuaccucuacaagugcuacccaaaacuacggcccuacuucgucuacgacaacuucaagaaauucggaaauaaagaagacaucggccacaagagguuuaacuuccuaggaaaaauagaacgggagaagaaaguaguagccccggaaacaggagagauucuuuggucaaacgucgccccgaacgagacgauaaaacaaauaaagaaaguauacaacuacaaauucaugauagugagcagggaaaucaccacacgccgagcugaacuguuuaaccaaaccguauaccccaagaacuaucgcggaaaacucauccccaucaaggaagaucgacccacggacuuauacggcggcuacagcggcaacacggacgcuuaucucgccauagucgcccuagaggacaagaagaaaggcaaauacuuuaaaguagugggcauuccaacacgagccgcagccaaacuagaaaaacucaaacaacaggacucccaacaauaccuucaagcucuccacgagguaauagcaccacaauucacaaaaagcacaaagaaaggcauaaagaaaaccgaauuugaaauuguucuggauaaaguccacuaccgucaacucguccaggauggaccggucaaaaugaugcuaggaucauccaccuacaaauacaacgcaaaacaacucguucuaucagagaaagcguuauga

SEQ ID NO: 6376 - RNA, 3696 nt, Artificial Sequence
  Cas9 variant
augaucacccgcauccuaggguuggacaccggaacgaacagccuagcaugggcaguagucgacagagaugcgaacggcaacuauacguuagucaaacggggcgaugucauauucacagaaggcguaaaaauagaaaaaggcaucgaaucuaguaaagccgccgagcgcacggcacacaaagcccucaggguccacuacucacgccgccgucuacacaaaaucgacacacucaaaguccucgucgaacuggaccucugcccuuaccuaucaaacgagcagcugaaucuuuggaaggcgaaaaagacguacccacucaccgacgacuucaugcuauggcaacgcuccgggagcgcagaagaaaacaacccuuauuacugccgccaccggugucuuacccaaaagcucgaccucacggaccaaucccagagauuccuccucggaagggcauucuaucaccucgcucaacgcaggggauuccugucaaaccgauuggacaccucugccgacagcgacgagagcggcaaaguaaaaaguggaaucgcagagcuauccguugagauggagaaagccggcugcgaguuccucggagaauacuucuaucagcuauacaaacaacacgggaacacgaucaaacugcguucacgguacacagacagagaggaacacuacaagaaagaguuccucgcaaucugugaaaaacaggaacucgacccaaaaugggucgaagcacuccaaagggccauauauuuccagcgcccacugaaaagccaacgcaaaggaguaggcaaaugcaccuucgaaccaaagaaacccagaugcgcagaaucccaucccgacuacgaagcauuccgcaugcucugcuuccuaaacaacgugaaaauccagaccccuaaugauacgucacucagaccucugaaugaagaugagcgggagaaaaucuggccauuauucuuccgcaaauccaagccaaauuucgacuucgaagacaucgcgaaagccuuggcgggcaaaaacaacuacgccugguacaaggacgcaggcgaaaaaccauucaaauucaacuauaggaugcaacaaggugucagcggcugcccggucacagcgcaacuaaucgacauauuuggcucagacuggcagacagcaaucgccgaaaccuacacagccgucgagaaaaagaacgggaccaagaccaucgacgaaauggccgacgacguauggaacguccucuacuccuucucaagcaaagacaagcuaaaggcauuugcuaccgaaaaauugcaacucgacgaagcaagcgcgacgaaauucgccaacgccaagcuaccccacggauucgcaagccuuucacucaaagccauccggaacauccuucccuuccuucggcaaggauucauauacgcacacgcgguucaccuagcaaaaauacccgauaucgugaccaaggcagucuggaacgacgccgauaagagagaaaugauacuaucaggcuuaauggaaaucaucgaaaacuacaaccccaaagacagaggaguagaaggaacaaucgacuucugcauaaagagccaucuccaagacgucaucgaccuacgccccggggcggcugacgcccuauaccacccauccaugaucgagacauaccccgacgcaaagcuaaacaaaaugggagucuuccaacucggcagcccccgcacaaacgcaaucagaaaccccauggcgaugcguagccuccacauacuccgaucggucgucaaccaacuccuccgcgacggaauaaucgaccgaaacacagagguucacgucgaauacgcccgagagcucaacgacgccaauaaacggaaggccaucgccgauuaccaacgcgaacaagaaaagaaaagaaaacaauacagagaugacaucaucgcccuguacaaaagcgaaugccacaaagagauagaacccaccgacacagacauccucaaauuucaacucugggaagaacaagaccaccuaugccucuacacaggaacgcaaauagguauaugcgacuuccucggggacaaccccaaauucgacauagaacacacaguaccacgcucggucggaggcgacuccacccaaaugaaccucacacuaugcgacgcuacuuucaaucgccagguaaaaggcgcccagcuccccucccaacucagcaaccacgcagacauccucguacgaauagaccacuggaaaucuaaaugcgaagaccuacgaaaacaacucgacaaaauucgcaccuacgggggcauggaaaaagcaaugaaagacaggcucauacaaaaacggcacaggcugaaaauggaccucgacuacuggcaaggaaaauacucccgcuucacaaugacugaaguacccgaaggcuucagucgccgccagggagcaggcauuggccuaguauccaaauacgcaggccucuuucucaaaagccuguuucacaacgaacaaaaucccaacaaaucaaacguauacgucgucaaaggcgucaccaccgcggaguuccguaggauguggggacuacaaggcgaauacgagaaaaagucacgacugaaccacugucaccacugcaucgacgccaucacaaucgcaugcauuggcaaagccgaauaugacaaaauggcacaauacuaccacgacgaagaacuuuuccaauggcgcgguacaacaaccaaaccccacuucaacaaacccuggccgaccuucacggaagacguccuagccaucgaacagucccuucucgucaaacaccuuacaaaggacaacaugcccaaacaggcgaagaaaagagucagaaccgcgacuggcaaguaccuugcacagggugacacagcgcgcggcagccuucacaaagacaccuacuacggggccauagaacaagacggagaaauaagguacgugcuccgcaaaccauuaaacaaauucgaaaacgaagccgaacucgagaaaaucgucgaccaagccgucaaagaaaagauaaaagaagcgaucgcaggcaaaaacuucaagaccgcaaucaccgaaccaaucuuuaugaacaaagaaaagggaauaagaauaaacaaaguccgcuacuacguaaaagcccaagaacgacuaaagauccgccagcaacgagaccuaagcuccaaagaauacaagcaguucuucugcguggaaaaugaaagcaacuaccuacucgccaucuacgaaggcgaauuaaaaggaaagaaagaacgggauuuuugcguugucaacaaccuggaaagcgcagcuugucugaaaagaagcaacaaaggaaaagccgccccucugguccccgaacgaucggaagaacgaaaccucccacuacucgccguccucaaacgcgggacacaggugcuauucuacgaaaauucccccgaagagauacuauucgacaauccgcaagaucuagucagaaggcuauacaaaguaacaggaauaaacaccaagaaagacgugaaaaauggcaagaccuaccucuacggcaacaucgaauugcgauuccaccaaaaugcgcagaagaaagacgacguaaaaaugcagagugguguauacaaaaauaacgagguccucagacaaggcaucguccugucccauaagcaguucaaagcacucguugaaggcguggacuucgaguucaacguacucggagaaaucaagaagaaagaacgccacgccuga

SEQ ID NO: 6377 - RNA, 3699 nt, Artificial Sequence
  Cas9 variant
augacuaaaacacggauacuugggcuagacaccggcacuaacagcuuaggcugggcuaucgucgacagagacgaaguauccggacaauacgaacuggucgacaggggagaccuaauuuucacagaaggcgucaagauagaaaagggcauagaaagcagcaaagccucagaacgcacacaacaccgcgcacuucguaagcaauacuucagacgacgccuuagaaagaucgaaguacuccgcgugcuaaccuucuaccaccucugcccacccguaagugaagaagaacuccacuuauggcacguaaagaaaauauacccagucgaaaaucaugaguucaugauauggcaacgcaccaaugacaaugaaggcaaaaacccauacuauuacaggcacauaugccuacacaccaaacucaaccuuacucucaugaaagaccgauacauccucggccgugcacucuaccaccucagccaacgccgugguuuccuauccaaccgccuagaccaaucacaggacgaagaugacaaaggcacgguaaaaaccgggauauccagccucuccaaggacaugaacgacgcaggaugcaccuaccuaggcgacuacuucuacaagcucuacagugaaaacggcaaccgcguaagaauccgcaaucauuacacggcacgaaacgaacacuaccuagccgaguucgaagccaucugccaaguccagaagcuggaaccagaacucgucgaagcgcuacgaagggccaucuucuuccaacguccccucaaaucucaaagaaaaggagugggcaaauguaccuuugaaccgaggaagccucgcugcgccgacucccaccccgacuacgaagaguuccgcaagcucugcuucauuaacaacaucaagauccagacaucagacgacgacacaaugcgucccuuaaacaaagaagaacgccaacgcaucaacucgcuguucuaccgcguuucaaaagcgaacuucuacuucgaagaaaucgccaaacugcuaggcggacgcaauaacuacuguuacuucaaggaugaaguucaaaaggacuucaaauucaacuaucgcaugucccagaguguauccggaugccccaccacagcgcagcugcgaaacaucuucggagaagauuggaagacaggcaucgcagaaaccuaucaacacuccgcgaaaaaggacggaaguuuaaaaacaguagacgaaauggccgacgauaucuggaacguauuauacucguucucuagcaaggacugccucuacaacuucgcagucaacaaacuacaacucgaggaggacaaagcgaagaaauucagcaaaauaaaauuaucacauggcuucgccucaaucucccucaacgccauucauaaaauucuuccguuccuccgcaugggaaugaucuacucacacgccgugcuauucgcgaacauccccacaaucgucggaauggaugucuggaacgacgaaucgaaaagacagcacauaaugacagaacuaucagaccuaguauucaacuacgaucccaaaaaccgcgaagucgaaggaacgaucgaaauguguauuaaagacuuccuccucaacaacuacgaucuuccagcaggcgcaguuugccgccuauaccacccaucuaugaucgacaccuacccugacgccaaagccaauaaauacggaguacuucaacuuggauccccggccacuaacgccaucagaaaccccauggccaugcgcucacuacacgaacuacgacacguagucaaccuacugcucaggaaagggaaaauugaccaaaacacggagguacacgucgaauacgcccgagaacuaaacgacgcaaacaagcgaaaagccauagccgaccgccaacgcgaacuggacaaacuacacaaaaaguaucacgaugacaucauaacccucuacaaggaggaaaccggaaaagacaucaacccgacacaagcagacaucuuaaaauuucaacuaugggaggaacaggaacaugucugccucuacacagguaggcaaaucggaaucagcaaguuccucggccccgacccagaguuugacaucgagcauaccguaccccgcucagucggcggggacaguacucaaaugaauaugacacucugcgacagacgauucaacagagacgucaagaaagcaauguuacccucccaacuacccaacuaccaagaaauacuaccccguauagaaaaauggaaaaagaaauacgaaaaacucacaaaagacauugaucauugcaucacccacuccggcaugacuaaagaagcgaaagauagcauaauacaaaaacgacaccgacucacacucgaacacgacuacuggcgcaacaaauacagccguuucacaaugaccgaagugcccgaaggguucucuaggcgacaaggagccggaaucggauuagucucaaaauaugccggccucuuccugaaaucacuauuccacgaccccacggaccgccgccgcagucacgucuacguaguuaaagggaccacaaccgcagaauuucgcaaaauguggggacuccaaagcgaauacgagaaaaagucccgcgauaaccacgugcaccacugcguagacgcaaucacaauagccugcauaggcaaaaacgaguacaauaaaauggcguccuucuaccacgacgaagaagcauucgaacguggcgaaugugaaaaaccccacuucgacaagcccuggcccaccuucacacaagacguccuaggacuagaaaaacgccucaucguagugcacucaacucaagacaacaugccgaagcaugcaaagaaauacgugcguacuccacgcggcaaauuuauagccaaaggagacugcgcccggggaagccuacaucucgacacuuacuauggcgccaucaaacauaaagacgauaccgaaccacguuauguucucagacgcgaacucucgaguuucgacucagugaacgaucucgacaucauagucgacgacgccgugcgcgagaaaaucaaagaggccgucaagggcaaguccggcaaagccuucaaggaagcccucgcgaauguauacaugaacaaagaaaaagacauccgaauaaagaaaguccguugcuacguaccaagugucaaacgucccauugacauacgacaccaacgagacaugagccgcuucgacuauaaaagacaauuccacgucgcaaacgaugguaacuauaugauggcaauauaugagggcgucguuaaaggcaaauuaaaacgcgacuuugaacuugucaaaaacaucgaagcugccucguauuucaaaguaucccaagacaacgagagcuucucaucaaucgucccggaaaagucgucaaauggcuucccccucaaagcaguacucaaaauuggaacucacgugcuccucuacgaaaacacagcuuccgaaauagacuucuccgacccaguagaccugacccggcgccucuacaagguagucggauugucgagcgcaaucauaaacaacugcagcuacggcuucaucaccuuacgcuuccaccaggaagcacgacaagcgaaaaaccuuaaacuaacaaaaggugucuucaaaaacguugacaacuaccgcggggccauaauccucuaccacacccaacuuaaagcacuggucgaaggcuacgacuucgauaucaacauacuaggcgaaauuaccucaaagcaguga

SEQ ID NO: 6378 - RNA, 3705 nt, Artificial Sequence
  Cas9 variant
augccgaacuucuggucgauauucacagagaaucuccaaaccuaccuaaugaaaacccgcauccuagggcuggacacaggaacgaacucccuaggcugggccguugucgaucgggacgaaaacaaccaauauacgcccauuugcagaggcgaccucauauucaccgaaggagucaaacaagagaaggggauagaauuuagccuagccgcugaacgaaccagcuaccgagccucacgaagacacuacuuccggaggcgccuucgaaaggucgaaguccucaaaguauugguaaaacacaagcucugcccgccucucucggacgaggcacucaaccgauggcacaccaagaaagaauacccccuugacgaagacuuuauacuauggcaacggacaaacgaagcugauaacaagaauccuuaccacgaccgccacaucugucuccaccgcaaacuaaaccuaaaggacagccaaacagaccgauacacacucgggagagcccuauaccaccucacccaacgacgcgguuuccuuaguaaccgccucgaucaaaacgaagaagcggaagaaaccggcaaagucaaauccgccaucuccgaacugucgaaagaaaugaaagaggccggaugcgaguuccucggagacuacuucuaccuccuauacaggaccgaaggcaaccgcguaagaaucagaucacgauacaccgaccgcgaaaagcacuaccuacaagaguucaaagaaauaugccguguacaagaacuagaugaagaccuagcgaaagcccuagagaaaaccaucuucuuucaacgcccacuaaaaagucagcgccaaggcguagggaaauguaccauggaaaaaggacacucgcgcugcgcaguaucccacccccuauacgaagaauaccgccuccuaugcuaccuaaacaauauccgcaucaagacccccagcgaugaccgccuacggccccuuaacgccgaggagcgugagaaaauaaccccacuguucuacaaagagaaaaacuucgacuucgaaaagaucgcaaagaaacuggccgggaaaaccccauucggcuggauacgcgacgccgaagacuggccauaucaauucaacuaccgaaugacccaagaagcacccgccugccccaccacugcccagcuaauaaaaguauucggagaagacuggaaggccgcccuggccgagaccuacacaaugucggccaaacaggacggcacucuaaaaacugaagacgaaauaugcacagauaucuggaauguccuauacaguuucucaucgaaggaaaaacucaaagaguucgggcuaaagaaauuacaacuagacgaaguucaagccaaagcauucagugaaauacgucuaacacgagacuucgcaagccucucccucaaggcaauacgcaagauacucuucuuccuuagaaccggcgaagacuacucaaaagccaucuuccuagccaauauacccaccauagucggagaagagaucuggaacgacauagaacgccgaagcagacuacucuacaaggucgaccuagcucuacgaccacaagaagaacgagacgccgaggaacaccgaaccaucgccgaacgaauaaaagcagcagucgcagccgaagucccagacgcgcccauugacuuacucuaccaccccagcaugauagaagccuaccccgacgccaaacguaacgaaagguucgacugcuaccaacuaggcucccccaaaaccaacgccguccguaacccgauggccaugagaucccuacauaugguucggaagguuaucaaccaccuccugcgcaaacacauuaucgacgagaagacagaaauccauauugaguacgcaagagaacuaaaugacgcaaacaagagacaagcaaucgccgacuggcagcgagaacuaagcaagcgccacacagccuacgcgcaaaacauacgacaacuguauaaagcagaaaccgggcuagucauagagccgacaaaggcugacauacucaaauaccaacugugggaggaacaacaacauguuugucucuacaccggaaagaagaucgguauagcggacuuucucggagccaaucccaaguucgacauagagcacaccaucccccgcagcagaggcggcgacucaacccaggaaaauuugacucucugcgaaagcaaguucaacagggacaucaaaagagacaaacucccaacggaacuagccaacuacgaagaaauccuagcgcggaucgaacauuggaagaaacaaugcuacgcccucaaacucaaacgcgacgggauacgaacccauucaggccucgagaaaagcauaaaagacucccgaauacgccggcgacaccuagucgguuuagaauacggauaccucaaagggaaauacgaccguuucacaaugaaagaagucccggaaggauucucgcgaagacaaggggccggcauaggccucauuuccaaauacgcgggacucuuccucaaaucucuauucaaagaccccaaaaacccaaaccgaagcaacgucuacguugugaaaggagcaaucaccgccgaguuccggaaacucuggggccuccaacaagccgaugaagccaaaucaagggaaaaccauacccaccacugcaucgacgcguacaccaucgccugcauagggccaugcgaauacgccgcccuagcagcuuacuaucgcagugacgaagaguucaaauacggccggcgcagggaaaaaccacaauuugaaaaaccauggcccacauuuacagaagaccuccucaagcuacaagaagaacugcuaaucgugcaccaaacaaccgauaaacucggaaaacgcgacagacguaagguaaagacaccccgcggcaaauuccucacagggggcgacuccgcccgcggacgccuccaccaagaaacauacuacggagccauaaacuaugacgggaacauuaaauacguaguccgaaagccccuugacucccugaccgagaaagacuuagacaaaauaguggaugaaacggugauggggaucguaaaaggcgcagucgaggccaagggcagccucaaagaggcacucgcagacgguaucuauaugaacaaagagaaggguauccugauaaaacggguacgaauuuucucagacgugagcgagccgauuaaccucaaacaacugagggacgugucaaccaaagaguacaaacgccacauccaccuccgaaaagacgaaaacuaccuauucgcaaucuacgaggguauagacaagaagaaaaauaagaaacagacugagaccgccacgguggacuaccuggaugcugccaaauucuacaaagacuccaaacgcagagacaaagcaaacagccucguaggcgacuacuccaagaagaacaaacucccacugaaaugcauccucaaaaagcgccaaaugguccucuuuuacgagcacuccccagaagaaauucguuucaaagacaagaaagaccucucacggcgccuguauaucgucacaucaaucgcgaaagacggacgcgucaaauucuugcaccaccaggcugccaccgccacgggcauucaaagcagcccgagcccauucacuaacgacggagagcaucaaccguacuaccgccucuccgcaucaaacaucaaagugcuuguagcaggaauugacuucgacaucaacauacuuggagaaaucacccccaaacucuga

SEQ ID NO: 6379 - RNA, 3711 nt, Artificial Sequence
  Cas9 variant
auguacuucuacaaaaacaaggaaaacaaacugaacaagaaaguaguacucggccuagaccuaggcauagccagcgugggcuggugccuaaccgacaucucccagaaagaagacaacaaguuccccaucauccuccacggggucagacucuucgaaaccguagacgacuccgaugacaagcuccucaacgaaacccgccgaaagaaacgagggcagcgaaggcguaaccgccgccuguucacccgcaaacgcgacuucauaaaauaccuaaucgacaacaacaucauagaguuggaguucgacaaaaacccuaaaauccugguccggaacuucaucgaaaaguacaucaacccauucagcaaaaaccuagaacugaaguacaaaucaguaaccaaccugccgauaggcuuucacaaccugaggaaggcagccaucaacgaaaaauacaaacuagacaaaagcgaacuaaucguacuucuguacuucuaccuaucacugcgcggcgcguucuuugacaaccccgaggacaccaaaaguaaggaaaugaacaagaacgaaaucgaaaucuucgacaaaaacgaguccaucaaaaacgcagaguuccccauagacaaaauaauagaauuuuacaagaucuccggcaagauccgcagcacgaucaaccuaaaauucggccaccaagacuacuuaaaagaaaucaagcaaguauucgaaaaacaaaacauagacuucaugaacuacgaaaaguucgcaauggaagaaaaguccuuuuucagccgaaucagaaacuacuccgaagggccaggcaacgagaagaguuucaguaaauacggccucuacgcaaacgaaaauggaaacccugaacugaucauuaaugagaaagggcaaaagaucuacaccaaaauauucaaaacccuaugggaaagcaagauuggaaaaugcagcuacgacaagaaacuauaccgcgcccccaagaacagcuucagcgcaaaggucuucgacauaaccaacaaacugacggacuggaaacacaagaacgaauauaucuccgaacgauugaagagaaagauacuacugagccgauuccucaacaaagacaguaagagcgccguggagaaaauacugaaggaagaaaacaucaaauucgaaaaccucagugaaauagcguacaacaaagacgacaacaaaauaaaccuccccaucauuaacgccuaccacucccugaccacaauauucaaaaagcaccucaucaauuucgaaaauuaccugaucagcaacgagaaugaucucucaaaacuaauguccuucuacaaacagcaauccgaaaaacucuucgucccgaaugagaaaggcuccuacgaaauaaaccagaacaauaacguacuccacaucuucgacgccaucuccaacauccugaacaaauucagcaccauccaggaccggauccgcauauuagaaggauauuucgaguucucaaaccucaagaaagacgucaaaagcuccgaaauauacagcgaaaucgccaaacuacgcgaauuuuccgggacauccucgcuaucauucggcgcuuauuacaaguuuaucccuaaccucauaucggaagguuccaagaacuacagcaccaucucuuacgaagaaaaagcccuacaaaaucaaaagaacaacuucucucauagcaaccuuuucgagaaaacaugggucgaagaccucauagccucccccaccgucaaaagaucgcugcgccaaacaaugaaccuacugaaagaaauauucaaguacucagagaaaaacaaccuagaaaucgagaaaaucguaguugaagucacucguucguccaacaacaaacaugaaagaaagaaaaucgaaggcauaaauaaauauagaaaagaaaaguacgaagaacucaaaaaggucuacgaccugccaaacgaaaacaccacccuccuuaagaaacuauggcugcuucggcaacaacagggcuacgacgcguacucccugcgcaaaauagaagcaaacgacgucauuaacaaacccuggaacuacgacauagaccacauaguaccucgaagcaucucauucgaugauucuuucuccaacuuaguaauagucaacaaauuagacaacgccaagaaaucgaacgaccucucagccaaacaauucauagagaaaauauacggaaucgaaaagcucaaggaggccaaagagaacuggggcaacugguaccucagaaacgccaacgguaaagcauucaacgacaaggggaaauucauaaagcucuacaccauugacaaucucgacgaguuugacaacagcgacuucauaaaucgaaaccucagcgauaccucuuacaucaccaaugcgcuaguaaaccaccuuacguucaguaacuccaaauauaaauacagcgucguaucagugaacggcaaacaaacaucaaaccuacggaaccagaucgccuuuguuggaaucaaaaacaauaaagagaccgaacgcgaguggaagagacccgagggcuucaaaucuauuaacaguaacgacuuccucauccgcgaagaggggaagaacgacgucaaagacgacgugcuaauaaaagaccgcagcuucaacggucaucacgccgaagacgcguacuucauaacaaucaucagccaauauuucagaucauucaaacgcauagaacgauugaacguuaacuacaggaaagaaacccgagaacucgacgaccucgagaaaaacaacaucaaguucaaggaaaaggcaucguucgacaacuuccuucucaucaacgcacuggaugaacucaacgaaaaacucaaccaaaugcgcuucucccgaauggucaucaccaaaaagaacacgcaacucuucaacgaaacgcucuacagcggcaaauacgacaaaggcaagaacaccauuaagaaaguggaaaaacuaaacuuacuggauaacagaacggacaagauaaagaagaucgaagaguucuucgacgaagacaaacucaaggaaaacgagcugaccaagcuccacauuuucaaucacgacaaaaaucuauaugaaacauuaaaaauuauauggaacgagguaaaaaucgaaaucaaaaacaagaaccucaacgagaaaaacuacuucaaauacuucgucaacaagaaacugcaagaggguaaaauaucguuuaaugaaugggucccgauucuagacaacgacuucaaaaucauacgcaaaauacgauacaucaaauucagcuccgaagagaaagaaacugacgagauaauauuuagccaaucaaauuuucugaaaauugaccaacggcaaaacuuuagcuuccacaacacccuauacugggugcagaucugggucuauaaaaaccaaaaagaccaauacugcuucaucucuaucgaugcacgaaacucuaaauucgagaaagaugagauaaagaucaacuaugaaaaacucaaaacccaaaaagagaagcuacaaauaaucaacgaggaaccaauccucaaaauaaacaagggcgaccuauucgaaaacgaagagaaagaacucuucuacaucgucggucgagaugaaaaaccccaaaagcucgagaucaaguacauccuaggaaagaagaucaaggaucaaaaacaaauccagaagccgguaaagaaguacuucccgaauuggaaaaaggucaaccucacuuacaugggagagaucuucaaaaaguga

SEQ ID NO: 6380 - RNA, 3717 nt, Artificial Sequence
  Cas9 variant
augacgaaaguccucggccuagacuuaggugccgcuagugugggcugggcgaugauagaagaagaagagaaaucccacaagauccuggggcucgggagcaggaucaucccguacgaaggcacggaaggcaacgacuucgccaaagguaccggcgaaagucgaaacgcucuaagaaccaaagcacgcaccgcccggaagggauacgaccguuaccagcuacgacgcaaguaccuagucgacacacucgucaaaaaugagaugaugcccgacgaguaccugcggaaacugccaaaaaugcagcuaugggaacuccguagcaaagccgugacaaccgagauaaccaaacaagagcuagggagacuguuccucuggcuaaaccagaagcgcggcuacaagaguaguaggagcgacgccaaucuggacaaaaaggacaccgaauacgucguagaagugaaaagccgacacgagaaaaucaaagaaucgggauucacgaucgggcaguacuucuacagugaacuaaaaagcaaugaauacuucaggguaaaggaaaacaucuucccacgggaggccuacaucgaggaauuugacgccauaugcaaacaacaaaagcggcaccuaacagacaaacucaucucacgaauccgcaacgaaaucaucuacuaccagcgcccccucaagagccaaaaaggcuuagugagcguaugcagauucgaaggcuucuucaagaagggcaucaacggaaaagaauacuucguaggacccaaagucgcaccaaaauccaguccccucuuccagacagucaagaucugggagaacauaaauuccaucagacucuccgaccggaaugggaaagaaaucaugcuaagccuggagcagaaaaagugcaucuucaaccaccuagacaacaaugaaaagcuaaccccgaaagacuuauucauaaucauaggaguaaagaaggaaaacugcuucguaaacaagcagcucgaaaaggggauccaaggcaacgucacuaaaucaacaauacucaaguguuucggcgaaaacaacgauuacgacaaguggcugaaacucgaccuuaacaucaucgucaagaaggacaccuucggauacuuguacgacaagaaaacaggggaaaucauuggggaaaagcugaucaagcacguggacagcgccguagagcgugaaccgcuguaucaacuguggcacaccaucuacagcaucaacaacacggacgaaugcagcgccgcccugcaaaacaaauuuggcuucgacagugagacagccgacaaacucagcaauaucgacuucggaaaggccggcuuuggaaacaagagcgccaaaguaauccgcaaaauacugccauaccuaauggaaggcgacgacuacucacagagcaugagcuacgccggcuuuaaccacagcgacagccuaaccaaggacgaaaaccuaaagcggaaauuacucgacaagcuaagacccaucgaaaagaacucucugcgacagcccauagucgagaaaauccuaaaccaaaugguaaacgugguaaacgcgaucauagacaaauacggcaagcccgacgaaauacguaucgaacucgcccgggaacucaaacaaaacaaggaagaacgcaauaaaacggacaaagacaugagcaaaagacaacgagaaaacggcgaaauuucgaaaagacucgcggaauacggauuacgggcaaccaggaauaacauaaucaaauggcgccuguaugaagagaucgacaaccaagacaagaaacucaacgcaauuugcguauacugcggccagccuaucucgcugaccgaagccaucaaaggcaacgaagucgacguagaacacauaaucccgaaauccaaacucuucgacgacucgcaaagcaacaaaaccuuagcccaccgccgcugcaacuccaccaagggagacaugacagccuacgacuuuauggaaaacaagccagcccaagucuucaaugccuacauagaacgcgucaacaugcuuuacgacaacaaaaucauacgaaagguaaaacgcgacaaacugcucaugcccgagucaaaaauaccagauaauuucaucgaccgccagcugcgcgagucccaauacaucgcgagcaaagcccgagaaauucuacaaacaauauguuacaacguguggaguacguccggaaccgucaccgcacgacuaagacaucucuggggaugggacgacgccacgaugagccugcaacucccgaaguacagggaacuuggacuaaccgagauggucgaaugggagucugaacacgggaagcaaaagcacagcaaggaggucauaagcgacuggucaaagcgagacgaccaucgacaccacgccgucgacgcccucacaauagcaugcacgaagcagggguuuauccaacgcuuuaacacccuaaauuccucuaaaaccaaggaagacauggaguucgaaauagcaaaguguuccauagaauaccgggaaaaccugagcaagcucgaaaaguacaucaucgcgcuccgcccgauaccggugucagagguagaggacgcagucgccaacauccucauauccuucaagagcgggaagaaaguggccgucaaagggaaaagaaagaucggcaaacgcgggaacaagaagaucauacagaccgacaucaucauaccgcacggaagccugagcgaggaauccguuuacggcaaaauaaaaacuaucgaacgggaaaaaccucugaaauaucuguuccaaaacagccaacucauauucaacaacaaaauaaaaauccucgucgaagaaagacucgccacauucgagaaugacaccaagaaagcccucgcgagccuaaagaaagugcccguauaccuggaugaagagaaaacaauagugcuggaauacgccacuugcuucaaagaagaguacgucaagaaauacgauguagacaccaauuucucaaaaacagacaaagugaucgacgacaaaauaaaagaaauccuccaacaucgacuaggcaaauucggaggcaaggccaaggagaaagaagccuucaaagacguucagcaaggggacaaaaccauaaaaugguacgaggacgaaggccucgaacgacccauccacucagugcgcugcuuuaccggacuauccgccaucguccccgucaaaaaggacgaaaacgggauagacaucggguucgugaagccggggaacaaccaucacauagcaaucuacuccgacaaagacggcaauagauacgaacacaucugcaccuucuggcacgccguugaacgaaagaaguacgacauaccugucgucauaaaagacagcaacgaaauauggaauaaaaucugguccaaacccgaagggagcuacccacagucguuucuggacaagcucccccaggaaaacuuaacccuagaccuaagcaugcaacaaaacgagaugcuaauccuaggcaugucguacgaagacaucaagaccgcgaucgauaacucagacuacaagcaauuaucaucgaaccucuaccgccuacaaaaacuggcaaacgcgaacuacauguuccgucaucaccuagagacucaaaucauagacgacaacaacagcaaagccucgcgacgauucaucaacauccacagccuaaaagccuuguucgcauggaaccccuauaaagugaacauaaauugucuaggagacauacaaaccaacucgagguga

SEQ ID NO: 6381 - RNA, 3720 nt, Artificial Sequence
  Cas9 variant
augacggaaaaacgcaaauucgacaucagggagguauaccucgcaauccaccacauaguaaaauaucgagguaacuuccuaaacagcgcaacuguagacagcuuuaaaaccuccaacaucgacuuuaccucccaauucgaccgccuaaacgaacucuaccgccaagucauccuugaagaaccuuuccagaucaauaugaaccaaguggacaaaaugaccaacaaacuacuagacaaugacgcacuaaaacuggacacgcagaaacaaguagcuaaacuccuaccagucaucuacaacgacaaacccgucgacaagcaauauacaagacucgcaacagaguucuccaaggccauuuuaggcuauaaaacaaaacucgacguaauucucaaccuggacacacaaaacgccaaggacugggccauacgccuagacgacgaagacauugacgacaaacucccagcccuuguagaaaaccucgaugagucccgucaagaaaucguaacuaucauccgcgaucuauacgcacaaaucacacuaaacgcgaucguacccaaaggcaaguccuuaucugaguccaugguggacaaauacaacgaccacaaagaccaccucgacuuacugaugggcuuaauccacgaauuaggggacgacuccgcaaaaggaauaaagcugcgugaagccuacacacaauacguagggaaaucaggagacaagacgcucaaccaagacgacuucuacgcagccauuaaaaagaaccucgacgaagauuccaagagaucccccaagauccaacgccuuaucgaacaggccucuuucaugccaaagcaacguaccucagcaaacggcguaauuccccaccaacuucaccaacuggaacuggaucgcauaaucgaaaaccaaggacgcuacuacccguuccuuaaagaacccaacagcaacacccacaagcccaauggcggcaaauacaaacucgacgagcucguugcauuccguaucccguauuacguuggaccccucaucaccaagcaagaccaggaaaagacauccggagccgacuucgcuuggaugaucagaaagcccggccaaggaggugagaucacuccguggaacuuugaucaggaggucgaccgcauggcuucagccaacacuuucauaagacguaugaccaccaaggacagcuaccugguggcagaggacguccugccagacucgucccuaaucuacgaaaaauucaagguuuuaaacgaacucaauaugcucaaagucaacgacaggcggcuuuccaucagccaaaaacaggaccuauucaacaaccucuucaagaaacaaaagaccauaagaacaaagaaacuccaaacuuacauccguaccaaaugggaacugccaagcguaaugaucagcggacucuccgaccccgacaaauuuaacaguucccuagccaccuauauagacuucagagacguauuuggagagaaaguagacgacccuaaccgccaggcagacuacgaaaagauaaucgaaugguccaccgucuucgaagaucguaaaauauaccaggccaaacucaaccaacuagacuggcucaccgaaucccagucaaaggcgcuccucacaaagcacuacacgggaugggggaggcucuccaagaaauuacucaccggccugaaagaccaaaauggcgacucuauccucgaccaacucuggaaaacaaacgacaauuucaugcaaauucaaagucgcgacgaguucgccaaacagauacacgacgagaacgcaaaacaauuccaugaagccaacaacguagacgacauacuagacgaugcuuuuacaagcccacaaaacaagaaagcuauccggcaaguagacaaaguaguccaagacguagugaaagccgugggauacgcccccgacaaaauagccauagaguucacucgcucaccccaagauagaccccaacggaccuucagccgccaacgccaacuccaauccacauaucuaaauguugccaaagcacugaugaaaagcaaccucaaccaagagcuaaaauccgugauugacagucaacaaacgcuaaccgacaaacuuuaccuauacuucacucaacucggccaagacauguacacaggaaaagaaaucaacuucgacgaacuggugaacuaccaaauagaccauauucucccccaagcauucaucaaagaugacucucuagacaaucgcguccuaguauccgccccuauuaauaacgcaaagagcgacaacguccccgucaagaaauucggcgccaaaaugggcuacuucuggaaacagcuagcagaaaaccacuuaauaagcaaacgcaaacuuaauaaccuaacgaccgaccccgacaagauagggaaauucaccgcacagggcuuuauacaccgacagcucguagaaacuucccaggugauccggcucguugcgaacauacucggaaacgaguacggacacgacggcaccacuaucaucgaggucaccgccaaaaugaaccaccaaaugcgaaaagacuucgaucuuaucaaaauacgagacguuaacgacuaucaccaugccauggaugccuaccuuacugcauacgugggagacuaucucuaccuacgauaccccaaacuccgauccuacuucguguacggggacuucaagaaacugaaagaccaaagucucaaaauacgcaauuucaacuucuuacacgaccucacaaacgacgaagccggugacaaaaucguagaccaagagacaggcgaaaucaucugggacaaacacgaaagcgugaaacaacucaagaaaguuuaccacuacaaauucaugcucgugagccaagagguguauacgcgccaagacgcacuguucaaccagacaauuuacccagccucugacgcggacaaaagaaaacuaaucccgaucaaaaacaauaaacccguggacguauauggaggcuacucaggcaacgucgacgccuauauggccauaguacgaauacacgguaagaaagaagacaaauacaaaguaguggggguacccaugagagcagucgcugaccuaaagaaagccgaaucaaaaggccgcgacaacuaccuuaacgccgugcacgagguacugaaaccgcaauucacgaaaaagaagaaagaccgcaaaacaggcgaaaucacagaaaugauggacgacuucgacguacuccucggcaaagucuauuaccgucaacuaauagucgacggaaauaagaaauucaugcucggauccuccaccuaccaguacaacgccaaacaacucguacuauccgacaaagccaugcaaguucucucgaaagacgacaaacucaaaaaucaagaugaaaaccagaaccucauagaugucuacgacgaaauccucgagaaagucgaucaauacuucgaacuguacgacauaaacaaauucagacagaagcuccacgacggccguaagaaauucaucgaacuaccugucgacaacgacuucaacggaaagaaacuuaucucauacggaaaaagagcuaccaucaucucuauacuaaacggacuccacgccaacgccacaaugucgaaccucaaauaccucgggaucagcucgccuuucggaaugcugcaagucccgaacggcauaauauuaucacccgccucgcgcaucugcuaccaaucuccaacaggccuguucgaaagaaaaguuaaacuauccgaucuauga

SEQ ID NO: 6382 - RNA, 3738 nt, Artificial Sequence
  Cas9 variant
augaucaucuacuucaucuucgagaaaaucgucaacaccauacuuguuaugaaaaagauaguaggucuagaccuagguacaaacucaauuggcugggcccuaauaaacgcauacauagacgaauacaacaaagaacaccuguaugggaucgaagcgugcggcucgcgcauaaucccgauggacgcagcaauccucggcaacuucgacaagggcaacuccaucucacaaacagccgaccgcacaagcuaccgaggaauacgacggcugcgugagcgacaccuacugcggcgcgaacgacuacaccgaauccucgaccuacucggcuuucucccgaaacauuacagcgacagccucaaccgauacggcaaauuucucaacgacaucgaaugcaaacucccgugggucaaagacgaaaccggcaguuacaaguucauauuccaggagagcuucaaagaaaugcuagcagacuucacagaacaccaccccaagcucauagcuaacaauaagaaagugccauacgacuggacuauauacuaccuccgcaaaaaggcgcucacccagaaaauaucaaaagaggaacucgcauggauccuccuaaacuucaaccaaaagcgggguuacuaccaacuacgcggcgaagaagaagaaacaccuaacaagcuagucgaauacuacagccuaaaagucgaaaaagucgaagacagcggcgaaagaaaaggcaaagacaccugguacaacguccaucucgaaaacgggaugaucuaccgaagaaccucaaacauuccacuggauugggaaggcaaaacaaaagaguucauagucacaacagacuuagaggcggacggaucccccaaaaaggauaaagagggaaauaucaaacgcaguuuccgagcucccaaagacgacgacuggacuuuaaucaaaaagaaaaccgaggcggacaucgacaaaauaaaaaugacagucggcgccuacaucuacgacacgcuccugcagaaacccgaccaaaagauccgcggcaaacucguucggacaauugaacgaaaauacuauaaaaacgagcuauaccagauccuaaaaacacaaucggaguuccacgaggaacuacgugacaaacaacucuacaucgcaugucucaacgaacuauacccaaacaacgaaccacggcgcaacucaauauccacgcgggacuucugccaucucuucauugaagacaucaucuucuaccaacguccacuuaaaucgaaaaagucacuaauagacaauugccccuacgaagagaaccgcuacauagacaaggaguccggagaaaucaaacacgccucaaucaagugcaucgccaagagccacccccuauaccaagaguuccgacuauggcaauuuauagucaaccuacguauauacaggaaagaaaccgacgucgacguaacgcaggaacuccugccaacagaggccgacuacguaacacuguucgaauggcugaacgaaaagaaagaaaucgaccaaaaagccuucuucaaauaucccccauuuggcuucaaaaagaccacuuccaacuaccguuggaacuacgucgaagacaaaccauacccuugcaacgaaacucacgcccaaaucauaacacggcucgggaaggcccacauuccaaaagccuuucugagcaaggagaaggaagaaacucucuggcacauacuauacuccauagaggacaaacaagaaaucgagaaagcucuccauucguucgccaacaaaaacaaccucucugaagaguucaucgaacaguuuaaaaacuuucccccauucaaaaaggaauacggcagcuacuccgcgaaagccauuaagaaauuauugccacugaugaggauggggaaauacuggucuaucgaaaacauagacaacggaacacgaauacggaucaacaaaaucauagacggugaauacgacgaaaacauccgcgaacggguccgacaaaaggccauaaaccucacggacaucacgcacuuccgcgcacucccucucuggcucgccugcuaccucgucuacgaucgacacuccgaggugaaagauaucguaaaauggaagacacccaaagacaucgacuuguaccugaaauccuucaaacaacacucgcugagaaacccaauaguggagcaggucaucaccgaaacacucagaacuguacgggacauauggcaacagguaggacacauagacgaaauccauaucgaacucgguagagaaaugaagaacccagcugacaagcgggcgcgaaugucucaacagaugaucaaaaacgagaacacaaaucuccgaauaaaagcccuccucaccgaguucuuaaaccccgaguucggcaucgaaaacguacgucccuacagccccucgcaacaagacuuacuccgcauuuaugaagaaggaguucucaacucuauccuagaauuacccgaggacauaggcaucauccuaggcaaauucaaccaaacagacacucucaaacgccccacgagaucagaaauacuccgcuacaaguuauggcucgaacagaaauaccggagccccuacaccggcgaaaugaucccccuaucgaaacucuucaccccagcguacgagaucgaacauaucauaccccaaagccgcuacuucgacgauucccucucaaacaagguaaucugcgaaucggaaauaaacaaacucaaggaccgcagucucggcuaugaguucaucaaaaaccaccacggagaaaaagucgagcuagccuucgauaaaccagucgaaguacucuccgucgaggccuacgaaaaacucguacacgagucauacagccacaaccgcagcaaaaugaagaaacuucucauggaagacauccccgaucaauucaucgaacggcagcucaacgacucccgcuauaucucaaaaguuguuaaaagccuacucuccaacauagugcgggaagaaaacgagcaagaagcuauaaguaaaaaugucaucccgugcaccggagggaucacggaccgccucaagaaagacuggggaaucaaugaugucuggaauaaaaucguccugccccgcuucauuagacuaaacgaauugaccgaaagcacuagauucacuagcauaaauacaaauaacacaaugauccccucuaugccucuagaguugcaaaaaggcuucaacaaaaagcgcauagaccaccgccaccaugcuauggaugcgauaaucaucgcgugcgcgaaccgcaacauaguaaacuaccuaaacaacgucuccgccuccaagaacacaaaaaucacccgucgagaccuacagacacuucucugccacaaagacaaaacagacaacaacggaaacuacaaauggguaaucgacaaacccugggaaacauucacacaagacacccucacagcccuccaaaagaucaccgucagcuucaaacaaaaccuacggguaaucaacaaaacaacgaaccacuaccaacacuaugagaacgguaagaaaaucguaucaaaccaauccaaaggagacucaugggccauccggaagucuaugcacaaagaaaccguccauggggaagugaaccuccgcaugaucaagaccgucucccuaaacgaagcacuaaagaaaccucaggccaucgucgaaauggaucucaaaaagaaaauccucgcuaugcucgagcuaggcuaugacaccaaacguaucaaaaauuacuucgaagaaaacaaagacacauggcaauga

SEQ ID NO: 6383 - RNA, 3741 nt, Artificial Sequence
  Cas9 variant
augcgccuggucuaccuagcccuggcgcacaugauaaaauuccgagggcacuuccuauacgaaggcgaccuuaaagcagagaacaccgacguccaagcacuauucaaagauuucguagaagaauacgacaaaaccaucgaggagucacaccucucagagauaacagucgacgcccuauccauacuaacggaaaaaguguccaaaucaucccgacucgaaaaccucaucgcccacuacccaacggaaaaaaaaaacacccucuucgggaacuuaaucgcacucucauuaggucuccaggccaauuucaagacgaacuuucagcucagcgaagacgccaaacuccaauucuccaaagauacauaugaggaggaccuagaaggccuccugggugaagucggggacgaguacgcggaccuauucgucagcgccaaaaaccuguaugaugccauucuccuauccggaauccucaccgucgaugacaauagcaccaaggccccucuaucggccagcaugguuaaacgcuauaaagaacacaaggaagaauuggcugcguucaaacgguucaucaaagagaaauuacccaaaaaauacgaagagaucuucaaagacgacaccaaaaacggauacgccggauacguaggcgccgacaaaaaacuucgaaagcgcucuggcaaacuagccacggaggaagaguucuacaaguacgugaaagggauacucaauaaaguagaaggcgccgacuacuuccucgacaaaaucgaccgagaagacuuccuccgcaaacaacgaacauucgacaauggcucgaucccacaccaaauccaccuccaagaaaugcacgcuauacuucgccgucagggugaacacuaccccuuucucaaagaaaaccaggacaaaaucgaaaagauccucaccuucagaauaccauacuacguaggcccgcucgcccgcaagggaucucgauuugcgugggcagaguauaaagcagacgaaaaaauaaccccuuggaacuucgacgacauccuagauaaagaaaaauccgcagaaaaauucaucacuaggaugacccuaaacgaccuuuaccucccugaagaaaaaguccucccaaaacacagcccacucuaugaaaccuucaccguuuacaacgaacuaacaaagguaaaauacgucaaugagcaaggcgaagcaaaauucuucgacaccaacaugaagcaagaaaucuuugaccauguguucaaggaaaaccgaaaagucacgaaggacaaacugcuaaacuaccucaacaaagaauucgaagaauuccgaaucgugaaccuaaccggccucgacaaagagaacaaggcguucaacgccucgcuuggcacauaccacgaccuacgcaaaauacuggacaaaagcuuccuugacgauaaaguaaaugaaaagaucaucgaagauauuauccaaacccuaacacuauucgaagaccgcgaaaugauacggcagagacugcaaaaguacucggacaucuuuacgacccaacaacuaaaagagcucgaaagacgccacuauaccggcugggggcgacucagcuauaaacuaauuaacggcauacggaacaaagaaaacaaaaaaacaauacuugacuaccucaucgacgacggauacgccaaccgaaacuucaugcaacucauaaacgacgacgcccugagcuucaaggaagagaucgcccgcgcccaaaucauaggagacgucgacgauaucgccaacgucguccacgaccugccgggcucacccgcaauaaagaaggguauccugcaaagcgucaaaauaguggacgagcucguaaaagucaugggccacaaccccaccaacaucaucaucgagauggcccgcgaaaaccagaccacggacaagggccgaagaaacucccaacagcggcucaaacuacuacaagacucccuuaagaaccuagauaaccccguaaacaucaaaaacgucgaaaaucaacaacuccaaaacgaccgccuguuccucuauuacauccagaaugggaaagacauguacacgggugagacacuggacauaaacaaccuaucccaguacgacaucgaucauauaauaccccaagcguucauaaaggacaacagccucgauaaucgcguccucacacgcagugacaaaaacaggggcaaaagugacgauguccccagcauugaggucgugcacgagaugaagagcuucugguccaagcuacucuccgugaagcuaaucacucagaggaaauucgacaaccuaacgaaagcggaacguggcggucucacggagaaugacaaagcaggcuucauaaaacgccaacucgucgaaacccgacaaauaacuaaacacguagcccaaguacuagacgcgagguucaacgcaaagcacgacgagaacaagaaagucauacgcgacgugaaaaucaucacucucaaaucgaaccucguaucucaguuccgcaaagacuucaaguucuacaaagugcgcgaaauuaacgacuaccaccacgcccacgacgccuaccucaacgccgucauaggaaccgcgcuucucaaaaaguacccgaaacuugcaagcgaauucguuuacggugaguucaaaaaguacgacguacgaaaauucaucgccaaaagcgacaaggagauagguaaagccacagccaaauacuucuucuacuccaaccucaugaacuucuucaaaaaagaggugaaauucgccgacgggacagucguggaacgaccagacaucgaaacauccgaagacggcgaaaucgccuggaacaaacaaaccgauuucaaaaucguacgcaaaguucuaagcuacccucaagucaauaucgucaaaaagacagaaguacaaacccauggcuuggacaggggcaaaccccgcggccuauucaacgcgaaccccucacccaaacccaaacccgacagcuccgaaaaucuagugggcaucaaacgcaaccuagacccgaaaaaguacgguggauacgccggcaucuccaacuccuacgccguccuugucaaagccaucaucgaaaagggaguuaagaaaaaagaaaccaugguacucgaauuccagggaauaucaauacucgacagaaucacguucgagaaagacaagcgugcuuuccuucuagggaaggguuacaaagacaucaagaagaucauagagcuccccaaauacagccuauucgaacuuaaggacggcagcagacggaugcuggcaagcauacugagcacaaacaacaagcgcggagagauacacaaaggaaaugaguuguucgugccccaaaaauucaccacucuccuguaucacgccaaaaggaucaacaacccuauaaacaaagaccacauagaauacgucaaaaagcaccgugacgacuucaaagaacuucuuaacuacguccuagaauuuaacgagaaguaugugggugcaaccaagaacggcgagcgccuaaaggaggcagucgccgacuucgacagcaaauccaacgaagagauaugcaccucguuccucggagcagugaacucuaaaaaugccggccucuucgaacuaaccagccucgggucagccucagacuucgaauuccugggcgugaaaaucccccgcuaccgggacuacacaccaucgagccuccuaaaggauagcauccuaauccaccagaguauaacaggccucuacgaaacccguaucgaccuaucaaagcuaggcgaagauuga

SEQ ID NO: 6384 - RNA, 3747 nt, Artificial Sequence
  Cas9 variant
augaagaaaauccuaggccuagaccuaggaucagcaaguaucggcugggcaguaauaacggaaaacgucgaaaacgguaucaccaaaugcgacaucuuggguauggggagucgcaucaucccauacgagggcaccgaggguaaagacuucaccaaaggaaccggcgagucacgaaacagccuaagaacuaaagccaagacggcacgcaaagguuacgacagauaccagcuccgccgcaaguaccugguagacacacucaucaagaaccagauguacccagacgaagcaacccgcaaccuaccaaaaaugaaguuaugggaauuacgggacaaagcaguccacagccccgucucgcucauggaacucggccggcugcuccucuggcucaaccaaaaacgcggauauaaauccucccgcucagacgccaaccuaggaaagaaagacacagaauacguagcaacgguaaaaucccggcacgagaaaaugaaagaacucgacgucacaaucggacaauacuucuaccgcgaacucagugcgaacgaauuuuucaaagugaaggaaaacaucuucccccgcgaagcguacaucgaggaguucgacgccaucuguaaaacacaacaaauagcgcacccaaugauacuccgcucagaacugaucgacaagaucagaaacgagguaauauacuaccagcgcccacucaaaagccagaaagggcuuguuucagucugcgaguucgaaggguucuggagaaucggaaaagacgggaaggaauacuucgugggcccuaaaguagcuccgaaaagcagcccccucuuucaacuagccaaaaugugggaaaacauaaacaacaucaaaauagggagccgcaccggggaagaccugaagcugacaaccgaacaaaagugggcaaucuuucaacaccucgacaacaacgaaaaacuaaccccaacggaccuccuaaagauccuaaaccuuaaaaaggaaaauuguuacguaaacaaacagaugggcaaaggacucaacggaaacaucacgaaacacgcaauacugcaaugucucggaggcucagacaaauacgagaaucugcugaaacucgaacucaaaauggucgacggagacaaggaaggauaccuguacgaccguaaaacaggcgagguacucaacagcaaaaugauaaaguucauagauccuauggucgaacaagagcccuucuaccaacucuggcacauaaucuacagcauacacgaccaagaagaguguagcagaguccuccaagcgaaauucgacaucgaacagccgaucgcagacaaacuagccgccaucgacuucagcaagcacgccuuugggagcaaauccgccaaaguaauuagaaaaauccugccauaccucauggacggagacggguacucggaggcgaugucauacgcagguuaugaccacagcaacucccagacaaaagaagaaaaccuacagcgaaagcuauuagaccuccuaaagccaaucccgaaaaacucacuacgccaaccaaucgucgagaaaauccuaaaccaaauggucaacgugguuaacgccaucaucgaaaaguacggaaacccagacgaaauucgcgucgaacucgcacgcgaacuaaagcaaagcaaggaggaacgcaaugaugcugacaaagccaugucuaaacgacagagagaaaacgacgcgauaaccaagcgccucgaagaguucggcuuacgcgcgacccgaaauaacaucauaaaauggcgacuguaugaagaaauagacaaccaggaaaagaaacuaaacgcaaugugcgucuacugcggucagcccaucagccucaccgaagcccugcggggaaaugacgucgacaucgaacacaucauccccaaaagcaaacuauucgacgacagccaauccaacaagacccuagcacacaggcauugcaacaagaacaaaaacgaccuaaccgcauacgauuuuaugaagggcaaaccagaagcaguuuucaacgaauacguagagcgcguuaaccugcuguacgacaaccauaucaucaggaaagccaagcgggauaagcuccugaugacugagagcaaaauccccgacaacuucaucgaccgucagcuucgagaaagccaauacaucgccaagaaggcacgcgaaauccuacaaacuaucugccacgauguguggucaaccaguggaaccgugaccgcagaacucagacaccuguggggcugggacgacguaacgaugaacuugcaaauggcgaaguaccgcgaacucggacucacacaccaaguagagugggaaucagaacacggaaagaacaaacacgagaaagaagucaucacggacuggacaaaacgugacgaccacaggcaccacgcagucgacgcacuaaccauagcaugcacgaagcaaggcuucauccaaagauuuaacacacugagcgccgcaaaaacgcgagaagacaugauguucgacauugaacaacggagccacgaguucaaagagaaaagaucccuccuggaaaaauacauaaucagcgaacagccgcugaaagucgacgaaguagaaaaggccguaucuaacauccucaucagcuucaagagcggaaagaaagucgccguguggggcacccgcaagaucggcaagcgcggaagcaagaaggugauccaaaagaaaaucaucguaccacgcggcagccucucagaagaaucgguauacggaaaaaucaaaaagcaagaagagaaagauuacaaguaccucuucgaaaacccucaacucaucuucaacccuacgaucaaagcaaaggucgaggaacggcuacuaauguucgacggagacgucaagaaagcaaucacuucacucaagaaaaucccuauuuaccucgacaacaacaaaaccgucguauuggagaaagccaucugccucaaagacgaguucgucaucaaauacucuguggauauaaacuucaauaagguagacaaagucguagaccccaagaucaaagaaauacuacaaaaccgacugaaaaaguucgguggaaaggaaaaagaggccuuuaaagacguacagcucgaggacaaaaugauuaucaagugguacgaagacgaaggccucgaacgacccaucaaaucagucaggugcuucacaggccucagcgcggucguccccgugaagaaggacgaaaacggcaaugacaucggcuucgucaaaccaggcaauaaccaccacaucgcgaucuacacggacacggaagaaaacaaacaacaacacguaugcacguucuggcaugcaguagaaagaaagaaauaugacauucccgucaucaucaaaaacacaaacgaaguaugggacaaaauacaaucacaaccggacggcacuuacccggacucguuucuugaaaugcucccgccacccaauuuaaaccuccucgucaacaugcagcagaacgagauguucauccucggcaccacaaccgaagacauaaaacucgccaucgauaaacgcgacuacaaaauuauuggcgacaaacuauaccgacuucagaaaaugucgaucaaaccauccagcggccaaauagacaucgucuuccgacaucaccucgaaacucagcucaucgacgacgagaacucgaagaaaagcaaacgcuucuacaacguacaaagccugggagccuuguucgcccucaacccguucaagguacggauagacaaccuaggcaaccuagucaaagaaaaauga

SEQ ID NO: 6385 - RNA, 3762 nt, Artificial Sequence
  Cas9 variant
augaaggcacggggaaacuuccuucaccaagacaccccaggacucacagcagccaacgcaaacaugggagacgcaguagagaaacucugcgucgcccuggaggauugguguacacuucgaaaccucgaaugcaacauacgcaaaaaccaaaagaacauacaaaaccuucuagaaggaaagaccguggaaguauccgccgaaaacgcccugaaagaaaguuuugacucaucccgagcaagucgcaaggacaaagccaccauccugagcacauggaucgcgauccaacccggggaauaccuagaugcgaagcaggcaaaagacgcaucaaaggagauagccaacguccucuuuggccugcaagggaacaugaagaaaauauucaucgaguucgaagaagaccagaaaauaaggcucgacaacgacgaacaagucgaagccuucuacucgcuaugcccggaugacggaguggcccucuucgaaucauuccaaucaauauacucggcguacauccucaugggcauacucaagaacgcaaacggcgggucgauaucaagcugcaagguagccgcguacgaccaguacaaagaagaccuaaaacuccucaaagaccucguccgcgaguucgccucagaaaaauaugacgaguucuuccgcggggacaucuuugacucaucaaaggguuucagggcccgcaacuacaaccccgcaacagcuaaaggauacacgaaauacaacagugugcgaggcgccagcuacgacgacuucaagaaagaaguggagaaaaucuucaaaggaaccgucgccgaagaagacauuagauauguggauaugaugcagcgauucgcggaaggcaccuuucuacgccgccucaaaaccagcgacaacggcagcauaccauaccaacugcaccucgaagaaauggacgccauuguagaaaaccagaaacaauucuauccauuucuggaaagcgaaaaggagaaacucgagucccuugucacauuccggaucagcuacuacgucggcccgcuaacccaaaagaacgcuagacucgacaaccacaacaacgcaagguucgcauggagccagcggaaggaaggcaaagaacaugcacgcguauaccccuggaauugggaagaagucauugaccgaaaacagagcgcagccaaauucauggaacggcugacagggaccugcacauacauucucgacgagcccguccucccacgcugcucgcuacucuacgaagaguacugccuccucaaugaacucaacggaaguaaauggcgagacaugggcggcgacuggcaccgauucgauuaugagaccagaauggaaauaauagagaaccuauucaagaaaaagaaagggucagugaaauacgccgcggucgaggacuggcucaaaugcgaaaaacacaaaucaugcgcggaaguaaaaggaggccaaggagaaacgggauucgaaagcaagcugucgagcuacguguucuucaaagaaguccuccacguggacgaaaucgacgaggcagacauaccaaugauagaggaacugauuugguggaacacacuauucgaagacagaagcauccucaaggaaagcauagaggacaaguacggcgaccgccucaccgaugaccagauaaaagccaucugcaagaaacgguucaccggcugggggcgccuauccaaggagcuccuaugcggcaucaaaacccacacugacaacggaccauacagcaucauggacguccuacgagagggcaaccccaauaacaacgcacgcuccgaaacgaugguauucauggagauacuccgagacgacaaauucggguucgacaaauuaaucgaagaagagaacaugagacgcgugucggaggucgacaacuucgacgucaacgaccuaccgggauccccagcgguacgccgcaccguaaaccaggccaaacgcauugucgaugaaauagucggcaucgcaggaugcgaaccgcaaaacaucuuuaucgaggucacccgcgacgaggacggacgcaacaagggccgcagaacaaaacgccgcuacgauaacaucaaaaaugcgauagcggcccucaagaaagaacagaaagaauauuucaacaaagacgucagcgauucccucaacaaaacgaaccccagcgaccuagacaacgagcgccuagcccucuacuucaugcaaaacgggaaaugcauguacuguggcaaggaccuugacauaaagcaacucgacaaauaccaagucgaccauauacuaccccagagcuacgugaaagacgacucguucgagaauaaagcccuaguucacauggaggacaaccaacggaaaagcgcuucgaugcuccucgacgauagcaucauccggaaaaugaaaccuuauugggaagcgcuaagagcagcaggccugaucggggaaaagaaauuuaaaaaccuaacgcgcguucgugucagcgacaaagagcuuggaggauucaucgcacgccaaauggucgaaacgucccagaguaugaaacuaaccagccucgugcuagagaaaacauaccccaacaccaacguccgcccgguuaaggccggguucucaagcgaccuucgcaaaagacuagaccuaaucaagugcagagaaauuaacgacuaccaccacgcgcacgacgcguaccucgcgugcgaaaucggacaguucauaacgaugcgucacaacaagcuauacgaaaaccccauaucauacucccaugccgucaaagacuucauugcuaaacgcgcaaaauacgccaacgaccacggcacaccaaugaguacauauggaaugcccggaagcuccucuuucguaauuucuucguuccugacguccggauucgaugaagaaaccggagaaaucuucaaagacgcguggagcgccgaagucgccgcgguucgaaucagggagagcuuaaaccggaaagacugcuacauaucgcggaugcccgaagaaaccagcggcgcauucuggaaagaaacucucaucaguccacgcgauccaagccuggguaaaaaucugucucucccgaucaagaaaggacucgaccccagaaaauacggcgguuacaaugaacagaaauucgccuacuucuucguauaugaagccgucaagaucaaaaagaaaggcgaagucaaagaauauguauucgcagcaguccccguccaggucgcagccauaguagccagagacccaaacgccuuaaccgguuucgcaaagaaagacgcggaagcucgaaaaaucaaauuccuccgcaucauccgggaaaagguauacaaauaucagcuaauugaagucaacggcgaacgacuauacaucaccgggcuaaaaagcguccgcaaugcccgacagaucgcacuaucacaagacaugaccaccguuuuucucaaagccauaaacgacaaagacgucgccgaagacgaguuaaagucacucuucgaagagaucguccaacguuaccggcugugcgccaacagacuaggaaaucaacuaaaaaucuucucccucagcgacuccuucaacuccgccaacucugaauccaagaaacgcgcacucgugagccucgucgcaauuaucgacgccaagacgaacaagauagaucuuuccggcaucggaucgggaaaagcaguuggcaacaugagacuaucauucuccaaagagaugucaaacagcaaaaaccacuucgccuucaucgaccagucagucacaggaauguucgagagaaagaccuaccucuga

SEQ ID NO: 6386 - RNA, 3777 nt, Artificial Sequence
  Cas9 variant
augaccgaggaaaacccggacaucagaaaagucuuccucgccauucaccacauacucaagaaccgcggccacuuccuccuccaaggacagagcuucaaagagggaaaccucaacaaccugauaaaagaacuacugaaccuggacauccuacacaucagcauagaaauuaccgaggagaacauaaacaagauaacagagauagcccucgagaaaaagacucucaccgacaaagucaacgaccuuaagaagaucuacccaaaggaaaaacaacuccucgaagcauuccggcuaaucuucggaggaaagaccagccuggacaaacucuuugccaucgacgaguauaaggagcucgacgccucgguaaagucagucuccuucaaagagaagaucuacgaagaagucaggcacgacuacgaacaaguccuauccaacuacaucgaacuccuggacuuagcaaaacucguguacgauagcaucauacucagcgacaucaagaaggaaggaaagacgcugagcgaauccaaagucgaacuguaucacaaacaccgcgaagaccucacgaagcucaaaacgcuaguaaagaacgauagcaaacugucagaagacaagaaagucgaacuauacagcgccauauucaaagaagauaaagacaaaggcacaaacuacgugaacuauauccgcaaaagcgaagaaggaaagggaugcaacuacgaggauuucaagaaauuccuaguaaaagagcucgccaagcuagaagaguccucggccaaggaagagauccucagagacuuggagcucgaacucuuccugccucuacaacgcacuaaagacaauucgguggugcccuaccaaauacacaaggaagaacucgucaaaauauuagacaacgcugccaaauaccauaaguuucucaacgaaaaagacgacuccggcuacuccaucauagagaaggucauccaacuccucgaguucaggauaccauacuacgugggaccauuaaauagcuccaagaaagccaaaguugacggcuuugcaugguccguacggaacaaaggcuacgaaaacacgcccgucacacccuggaacuacgaaaagguaaucgacgagucggcgagcgccgaaaaauucauuacuaacuuaaccaacaaaugcacuuaccucaaaggagaagacguccuccccaaguccagccugcuauacucggaguucgcgcuucucaacgaauugaacgcauuaaaauacgacgguaacagaaucagucuagaagcccggaacguaaucaucgaaaaacucuucaaagagcaaggaaagaaagucaccaaaacgagcauuaaaaaccugcucaaagcggagggauauaucgacggcaagggagaaauaaccggcauagacaucaccgucaaaaacgaccucaaaucuuaccgagacuucaagaaaauucuaggcgacaaguucaacacagaacacguagagaauaucauucuauggaucacgcucuacggcgagucacgcaaauugaucaaagccaagauagaagcagucuacggggacauauacucuaaggaggagaucgccaaaaugucccgccugguauacaaggacuggggucgcuucucccgcaaacucuuaaccgagcuaguaucuaaaaagcuguacaacgaagaaacaggagaaugccuaaacaucauaggagcaaugagacaaaacaacauccucuucauggaacugcuagcggacagauucgacuauagccagcaaauaaucgacuauaacaaggaacuccaaaaagaagucaccgaaauaacgccagagauacuagaugaucuguacgucagcccuuccgucaaacgcagcaucuggcaaacuguccgcauagucgaagaacucaagaaaaucauaggcugcgcuccggccaaaaucuuuguggaaaccacccgauccaaccaggacaaaaagaaacccaccgacagccgaaagaaacagcuggaacucuucuacaaagcagucaagaaagacgugaaagaccucgagaaagaaauaggaucgcugaauuuugacaaauuaaacgaacgacugagcucaguugagccguccaaacugaaagcaaagaaacuguaucucuacuacacacagcucggucgcugcauguacagcggggagaccauagacaucacccaauugaacaccacagccuacgacauagaccauauauacccccaaaguaaagucaaagaugacagcuucaccaacacagugcucgucaaacgcgaguacaacgccgcgaaaacagacagauacccccucggcagcgacauccagacgccuucaaaccgacgcuucuggaaauucuuaaaagaaaagggccucaucacugacgagaaauauaaucgccucguacgcacggaggaguucagcgacgaggaauugacuggcuucauagcccgucagcugguagaaacaucacaguccgugaaggcagucgcgggcauccucggcgaacucaaccccaaaacaagcauauguuacucaaaagcugagaacguaagcuccuuccgccagaauuucgggaaaauaaaggaagggaaccgcaagucugacaauaccgaacagcuaaucaaaguucgcgagaucaacgacuaccaucacgccaaggacgcauaccuaaacguggucgucgggaacguauacgacacaaaauuuacacgcaacguauucaacuucauaaaagacaaaaaggauggccguaaauacucgcucaauaauguguucuacgaaaacguaagcaacucgaauaacgucgccugggagcucaauaagaccguccaucagguggaaaaagucaugaacaacaacaauauccugguuacccgucgcaccucagaacagaaaggcggucuguucgacgcaacaguuuacaaagcaaaggucgccgccaaggcgaaagaaggaguguacuacccccucaagaccucggaccccguaguaaacgacgucaccaaguacggcggauucaccaaggucaagaucgccuacuacagcauauucgaauacacccuaguaaacaagaaaggcgaagagaaaauuacccgcaucaucccaauacccaucuacgucagccaaaacaucaaagacgacuccacucuccucgaguucggaaaaacccaaaucaacaucaaauccggggaagaagucaaagacuuuaaacucaaauacagaaagcuaugcauuggggaccucguuaagauaaacaacuucuucaacuucauugggggcaagaccaacgacucauucguauacgacggagccguacaggugacucuggacaccgaauccgaacgguacaucaaaacgcugagcaaguaccagaacuggaagaaagagaauaaagacggugaacuaugggaaucaaucaccaaagaaaagaacaccgaacucuacaaccuccuagucgagaaaaugaacuccggaauuuucaucaaaaagaaaccaaacaaauucaacgaacucaacagcgaagaaauacgcaacaacuucuccuccaucucccucgaggaacaagcaaaagugcuccuagaaguccucaaccuccugacaaauaagaaaucaaucuucgaucucaaaucaauaaacaucaccgcggcacgggggaaaaucagcuucaaccucaguaaucugucccaauucagcauaauagaacaaagcguagcgggcuucuacgaaaaagaaaucacuaucaucggcgacaaagagaacgacauggaaaacaacaacugcuga

SEQ ID NO: 6387 - RNA, 3780 nt, Artificial Sequence
  Cas9 variant
augaaauauauccugggccuugaccucggcgucgcaucaaucggaugggcaguuaccgagauaaacgagaaaggagagcccguaggccugaucgacgccaacuccgucauauucaaaccgcuggauaacgacaaggggaaacucuacaacguggaacgacgcgacaagcgcggcagccgccguauccugcggcgcaaaaagcaccgggucgagaggacgaaaaugcuccuaguaaacagcucauuccuaacaaacgaagagaucgauaaccucuacgucggcaagcucgacaacauauacgagguccgccugaaaggucugaaggaacaacugagcaaaaacgagauagcccgacuaaugauuuacuacugcaagaaccgggguuucaaauccaaccgaaagacggaggaccucgagauccucaagagccucggcgagaaaaucagugaaaaggacuccgacgaaaagaaacucaagcccauaaucgccaaaaacaccgaacugauagaauccaaaggccucaccccgaucgaaguaauauacaugauccgagaaaacgacaacucgauccucggcuucaaaaacaaagaagguaacuauaaauucgguuucaaaagaaaccaagucaucgacgaagugcgaaaaauacuaggaacccagcaaauacucucaaaagagauaguggacgaguacauagacauccucucuucccagcgggacuucucagacggcccgggcggugacucuaaguacaaaauagauuacacaaaacuugcagggaaauguaaauacacaggagaaguccgagcgguaaagagcgcgccaaguuacgagaucuucacaaugcuacagaagcugaacgacaucagauacgugaaauuuaccagugaagacaagauagagaagaagaagcucucaaaagagguaauacacaagcuguacgaccuaguaguggagaaaaauaaaacucuaaccuacgaccucauagaaaagagcauugacgaagagaacaucaaacuacucaacauuccgaagcucagcaagucgaaauacguggaacuccgcaagagcuacuucaaggagcgaaacgacaaugaaaacuuaaccgaagaagaaaucaacgcuuucaacgaaaagcuaaacaacgagcgcaugaaacaggaacugauacgcaacaaccucaaagccuacaaagaacucaaaagcaaauucaaaaagaacaacauagacgagaaccgaauaaaggaacuaggagggauauacuuuuuagaccucguggccgaacuccuuacauauaguaaaacagacgagaagcuggaguacuucguagaaaacgucgaacgcuacagccuguucaaggaacaaagggacaucguagagaucauaaagaccuuccccaacuacacuaaaaacgggaaccugucccuuagccucguaagagaacugaacaaacuccucauggaagggcacgauuacgaguccagccucagcagccugaacuacuacauagacaccgacgucgacugggaaaaauuucccacaauaagugagaucgaagacagccuauccaccaaaauuaccaauccaaacgucaagcauauacucgucauccuccgaaaacucuacaauacgcugcuauucaaguauggucggccugagaagguccaccuggaacugucuagagacuucagcaacgacuucucgacccgaaacaagauccaaaaggagcaacuggagaauaaaguccgucgcgaagucgcagcguucgagauguacggagcaaacaaagacauagucgcaggaaaagaccgacucucgaacgacgacuucguccgcauaaaacucugggaagaacaaaauaaaguaugcauguacucaggccgcacgaucgagaaauaucagcuaacgagcgcagaggugcagaucgaccacauccuccccuacagcaaguccuuugacaacagcuacagcaacaaagugcuaguguuuuccaaugaaaaccaggacaaaaaggaaagaaccccuuaucaguggcuuaaggggacggagaaauggaacgaguucaaacaacgcguaaggcucaaccucaacaucucaaacaaaaagaaagagaaccuguuauucgaagaugaaguggugaacaacgaguuccuagaaagagagcugcacgcuacgagcuauuccagccgccucgcacuaaacaucuuccaacgucugauaccaguaagcgacgaggacaaauacgacgaacacggaaacgaaaagguaaaguaccuguacaauaggaacguaaucgccuuccagggcaagaugacgaguaugcuccgcaaccuauacagccugaauaaguacacacacucguucgagagcgacacgcuggauauugacaacaaagccuucauccucaaagaguucgagauuaauaaggacaaccuaaaaaugaccgcauacaacgucaacacaggccucgagaucaccucagaaacgaagguggaaaagaacaaauccggcgaguucaaaaccauuaaggacgaacugcucaagaaggaacucgacaagaaagagaaccuaaucgagaucagcgacuacuucaaagacaagguguuauucgaccucaaaaucguugacuuugaagaaauagacacaguggaacccgaaaucauaucaauccuauacaaaaugaucacagccuuaaaagaagaggucuacagcaaaaaccgagaaaaccaccuacaccacucccuugaugcuuuccucuuaaccauaaugaacaggaguaugcagaugaaacucaucaaauacaaccagcuaaucuccguccucaaaaacaaggaaauagagaucuucaacgaagagaagggcgaguauauagauuccaaggaguucgccgaagaacuccaaaaacagaaaauaauugacauagacggaaacgaacggggaaucaaguucaacgucaacggaaagacccaccgccugaaucuaguuaagcccuacgagaacuuccucgacgacauaaagaacaaaaucuucgacaaacgcgaaaacaacaaacugcccuaccacgucguuaagagcaaaguaagcggagcacugcacgcagaaacaauacugggagaaaguaaaggcgaaaucacaaaacgcauaucgguauucgacaucaacuacaaaaaccucggcaaaauauucgacaaagacggaucacaaaaagagauuuacgaaacauuaguaaaauggcucgaagcaaaaagcaaagacuaccccaaacucaaaaacggaaacauaauuaagaagguuaagaucgucgaugggaacaaggacaaacuaaucaaacucggcaacaagagguacgucgaaaugggcagaaccaccgugaaaauacugguauugaagaaggaagccgaggaaggucugaaauuugcaagcaucggccgguacaaauacaaccuauuaaagucagagaaagaugucaacauaucaauauggaaggacgccauacacuucugcaaggucagauacaacaagcugaaagagaacggauacagacucauccacgaacuuauacccggagagacaaucgaacucgaacucaacaaagguaacauuucgaagugccucguggucggcuucuccggcggaaagaucgagaucagcucagucaucggagacgcccucgaccugaucaacgacaaaauaagcaccagaaucaaggaacgauacuacaucaccguuagcacaaucaagucaauuaagaaaauaaacaaaaacauacugggagacuga

SEQ ID NO: 6388 - RNA, 3792 nt, Artificial Sequence
  Cas9 variant
augcacaaaaauaaucccgacauccgagaacucuuccuggcgauccaucacauacucaaauaccgaggacauuuccuguucgccggucagcaauucaaaggaagugagaucaaggacaacauccgggaacuccuccaguacaauuccuugaacaucaaaaucgacaucaccgacgagcucauaaacaacaucgcugaaauccuacucaaaaagaaaaacagcaccgacaagauaauagaguucaagaaacucuucgccgacgagaagcaacucauagaagcacugagacuugcacugggcaacaaaacccaacuggccaaacuauucgacaucgaggcguacaaggaacuggacaucuccauaaagaccauauccuuuaaagaaaagaucuacgaggacguccgcagcaacuacgaggagaucuuaggagaauacaucaucguccuagacacggcaaaguuaauauacgacgcgauaauccucucagaaaucaagauuaaaaauaugacgauaagcgagucgaaagucauaagcuacgaaaagcacggaaaagaccucaagcaacuaaagcagcucauaaaagaagacagcaaacucuccaagaaggagaagcgucaacucuucgaaaacaucuuuguaaaagaggacgaaaaggaggcaaacuacguaaacuacauaggcaagaauaauguagguuccagcaagaguuccuguaguuacgaagacuucaagaaaucgcuuauaaaagaguuaaaauacugcgaagagagcaaacuuaaacaagacauccucgcagagcucgaacuagaaacauuccuucccagacaacgaaccaaagacaacagcgugaucccguaccaaauccacaaggaggagcuggagaaaauccucaacaacgcaguacaauaccaccccuuccuaaacaacacagaugaguauggcaucuccauaaaggaaaagauaauccaacucuuagaguuccguauuccuuacuacgucggcagccugaauaccagccacaaagucggcaacggcggcuuuuccuggagcgugaggaacaagggcuacgaaaggaccgcagucacgccguggaacuucaacaaggucauaaauaaggaagagucagccaaaaacuucauagagaaccugaccaaccaaugcaccuaccuccuguacgaagacgugcugcccaaacacagccuccucuacagcgaguucacgcuccuaaacgagcuuaacucaauaaacuacggcggcaaacgccugaccguagaacaccguaaccucauaaucgaaagauucuucaagcagucagccccaaaggcaacuggcaaggaacucaaaaaguucuuaaugagcgagggcgugauagauggcaaggacgaacuauccggcuucgacaucucaauaaagaacgaucugaagucguaccgagacuucaaaaagauccugggagagaaguucgacucugagaaggucgagaaaaugaucagauggaucacacucuucggagagucuaaacaacugcucguagacaagauaaccaaggaguacggagacauauauagcucggaggaaauaaagaaaauaagcggccuaaccuauaaggacugggggcgccuuagcgaaaagcuacucaccgagaucguaagcucccaacuguaugacgaguccaccggcgaauguuuuaacauaauuaacgccaugaggaacaacacccuacucuucaucgaguugcugggaaccaacuacgauuacuucgagaaaaucaauacguacaacggaaaacuuagaaaggaaaucaccgagaucacgccccacauccucgacgaccucuacgucuccccggcagugaaacgcuccaucuggcagguuguucgcauagucgaagaacugaagaaaguuaucgguagcgaacccaaacgcauuuuugucgaaacaacacgcagcaacaaagaaaagaaaggcgacgaugggcgcaaagacagccgaaagaaagcccuacuggaacuauauaagaaaaucaaaaccagugacaucgcggagcuagagaaagcacuuggccacacaguagacuucgacaaaaagaaacaggaccucacggacauagacaacaacaaacucaaagccaggaaacucuaucuauacuauacccaacuuggucgaugccuuuauaccggcaaagcaaucgaccugaacaaccuguucggcuccaacagcgaauaugacauagaucacaucuacccacaauccaagacgaaggacggaagcuggaacaaucucguccuaguaaacaaaacagaaaacagcaaaaagucaaauggccucauaucggaguccauccagcgcaaaaacaaacacuucuggagauuccucaaagcuaaaaaccuaaucucggaagagaaguauaaacggcugacccgcacagaagacuucaccgauggcgagcugucgggcuuuauagcgcggcagcuaauagaaaccucacaaagcgugaaggucgugagcaaaauacuccagaaucuaaacccaaccacagagcuaugcuucuccaaagcggaaaauguaucggacuuccggcaagaguucggaaagauaaaggugggcaagcgcaaaaaccugaccgaagaagaacagaagaaagccaaagaaggccagcucaucaaaguaagagaccugaacgacuugcaucacgcgaaagacgccuaccugaacaucgucgucggcaacgucuaccacaucaaauuuaccaggaaccccaaaaacuucauacgcaaaaacuucaagaaccgcgaauacacccucaacaccuuauuuuacucagacaaagucgagaggaacggagaaguggccugggagaagggcaaaacagaagagaucgucuccucaguaaugugcaacaaccugaucaacgucacgcgacgcaccagcgagcaaaaaggcgcgcucuaugaggcaacaaucuauaaagccaacgccgcgaaggaaggaagcuauuaucccgucaaaaccaacaauaaaaaucucaaaaacgucaccagguacggcggcuucacauccaucaaaaucgcauacuacuccauuuucaaguacgauauccgaaacaaggacaaggucaaggaaaacaucaagaucaucccgauacccaucuacauaagccaaaacauaaaaacagaccuggaccuaaucaacuucgcugaaaaacagaucaaacuuaagaaaggggagaacaucgaaaaccugcaauuaauauauaagaaacucaacauaggugcucugguaaaaauagaccacuacccauacuacaucgguggaaaaaccgacgacaacuucuacguagacggggccguacaaguacugcucaguagcgacauagaacgcuaccucaaggaaguagucaaguucgugaacuuccaaagagaaaacaaggaggcuaaagucucgaaagaacacaucucucucgaagagaacaucaaacucuacaacacguugguauguaaaauggcaacaaaaauauucacgcacaagaaaaauaacaaauacaacgacuugacucaagacaaagccaaaaacaccuucaacaagcuaagccucgaggaacaguguaaaguccuccuagaaauccuaaaccuucucacaaauaagaaaaccaccuuugaccucagcuugauaaacgagaagaccagccgggucaagugcggcuucaaccuacuuaaccaaaaacaguucagcauaaucgaacaaagcguaacaggccucuacgaaaaggaaauuaaaauaaucgaggacuga

SEQ ID NO: 6389 - RNA, 3795 nt, Artificial Sequence
  Cas9 variant
augaaaaacguccugggccucgaccugggcacuaacucaaucggaugggcgcucauagaggucgacgagaacaaccuccccauccggaucaucgccaugggcucacgaaucauaccacuuagcaccucagacaaagaagaguuccagcgggggcucucaaucacuaaaaaccaaagccgaacagucucgcgcacccagagaaagggcuacgaucgcaaacaacucaaaaagagugaccuaaagaagauccucaacaaauacaauaucuucccauccgaagaauuacuacggcuaccaaugcuagaucucuggaagcuacgcuccgacucagccaacccagacgaaaacaucucagccgaacagcugggccgaauacuuuacaugcucaaccagaagcggggauacaaaagcgcccgcuccgaggccaacgcggacaagaaagacuccgacuacguccaagccguaaaagggcgauacgaccaacucaaagaccgcaaacagaccaucggccaauacuucuacgacgagcuauacaacgccaaugcaaauaacucguacuucagaaucaaagaggagguguacccccgagaagcauauauagaggaguucgacaccauuauuucugcacaaagggaaaaacacgacuuccugacagacgaaguaguccaucagcucagaaacgaaauaaucuacuuccaacgaaaacugaagucacagaaaggccucguguccaucugcgaguuugagggcuucgaaaagacaguauucgacaaagagaaaaauaaaaacaaagucguauucgucggcccaaaagucgcaccaaaaacaagcccccuauuucaacucugcagaauaugggaagucguaaacacgaucacacucaagaucaaaaacccggaaggauccaaguauaaauggggcgagaaaauacccgauaucaaagaaaaagaaauccucgccgacuaccucuucaagaacgaaucgcugagcuucucgaaacucuuagaaauccuagaauugaagaaagaaaauguauacgugaauaaacagauacuaaaaggcaucaaagguaaugaaacuuacuccgcccuucacucaauacuaggagacaacgaacuccugaacuucgaugugagcauaaugacaagcaaccaaaccgcccuccucguagaccggaaaaccggcgaaauccuagaagaaagggccggacucgaauuagacgcaagccuagagaaagagccccucuaccaacuauggcacacuaucuacucauuaaaagaucuagacgaaugcaaaaacgcacugauaaaacgauuugacuucgacgacgagacggccgagaaacucagcagaauagacuucaacaagcaagcauucgggaacaaaucgaacaagucaaugcgcaaaauacucccauuccucauggaaggguacgacuacucccaaucuagcagccuagccgguuacaaucacuccaacagucuaaccaagaacgaacgcgagcaacaaaucacccucgaccgucuagaacuccuuccgaagaacagccugagacagccaauaguggagaaaauucucaaccagaugaucaacguagucaacgcaauccuagacgaauacggcaagccauccgaaauccgcguugaacuggcccgcgaacucaagcaguccaaagacgaaagaaacgagaccgaccugcagaacucgaaaaacaagaaacuaaacgacgaaauuggcaaacggcucgaggagcugggacuaccagugacaaaacgcuacauccaaaaauacaaauucauauuccccucccucaguaaaaaccucaaggaggcaaagguaaacaaucagugcauauacugcggcgagaccuucaaccugaccgaggcgcuguccggagacgcguacgacguagaccacauaguccccaaagcccuacucuucgacgacucccagacuaacaaaguacugguucacagaaagugcaacucuaccaaaacgaaccagaccgccuacgauuacauagcaacgaaaggggacgagcaccucaagcucuauagugaacggcuugaugacugguuugaacgcggaaucauaucguauuccaaaaugcaaaggcugaagguaagccacaaagaauaccuagagcguaagaaacuaggaaaagaaacagaaaccgacaagaaacugugggaaaacuuuaucgaccgccagcuccgcgacacgcaguacauaagccguaaaucccgcgaaauacuacagaaaaucuguaacgaugugaaaacgacggaggguggagucaccgccaagcucaggaaccuauggggcugggacgacguccucaugaaccuccaaaugccuaaguacaaagagcuuggccaaaccaucaccaaagaauggaccucggaacacggcaagcgcaaacaccagaaagaggaaauagacaacuggaccaaaagagacgaccaccgacaccacgccaucgacgcccuggucauagccugcacaaaacagggcuucauacaacgcaucaacacguuaaacuccagcgacacgaaagaccuaaugauaaaagaagucgaagaggcgaagauagaauuuaacgaaaagacuacacugcuggaaaaguaccucaaaacccagaaacccuucuccacacaagaagucaugaaagaagccgacaagauauuagugagcuucaaagccgggaagaaggucgccacaaucacaaaauucaaagcaaccggcaaaaacaaagagacaggcguuaucgugccccggggcgcgcuacacgagcaaucggucuauggaaagauaaaagucauagaaaaagacaaaccacucaaauaccucuuggaaaacucagacaaaauagucaacccgcggaucaaaaaccucauagagaucaaacucucagagaacaaaaaugaccccaagaaagcccuccuagcgcucaagaaaauacccaucuuccuggacgaagaacaaagcauaacccuagaaaaagcauccugcuacaacgacgccacuguacucaaauacaaacuucaaaaccucaaagccgcccaaguagacgacauaguagacgagaagguaaagaaaaucgugcgcgagcgccucucucaauucgguaacaaagagaaggaagcauucaaagacacacucugguucaacgaagaaaagaaaaucccaaucaucacaguucgccucuucgcacgccccgacgccaauaaccuccagaccaucaagaaagacgaaaacggcaacgggaucggauucgucgucacgggcaacaaccaccacauagcgaucuacgaagacaaagauaacaaaccagugcagcacagcugcaccuucuggcacgcagucgaaagaaagaaauauaacauacccgcgguuauucgagacagcucagaggucuggaacgaccuacuccgaaaagaacuccccgaauccuuucugaauaaacuccccgcugacaaccuaaaccuaaaauuuagcaugcaacaaaacgaaauguucauccugggacuuucacaagacgaauuugugaaggccaucgcaaacaacgacaaaagccuacuaucaaaacaccucuaccucguguggagcauaucagaaaacaacuacugguucagacaccaccuagaaacaaagaacuccgaccuaaagaaaacagacggcgucaaagaauccaagagacucuacaacauccgaucgcucggcuccuuguucucccugaacccaaucaagguaagacugaacuaccuaggagaaaucacaaagauaggcgaguga

SEQ ID NO: 6390 - RNA, 3801 nt, Artificial Sequence
  Cas9 variant
auggcgaaguacauccuagggcucgaucugggaacuaacuccaucggaugggcucuuauagaaguggacgagaacaacaucccaauccgaaucaucguaaugggcucccggaucaucccccucaguagcaacgaccgcgaggaguuccaacgaggccucucgaucacgaagaaccaaaaccgaacaaucagccgaacgcaacgcaaaggauacgaccgcaagcaacuaaagcgcaacgaccuaaacaaaguacucaacaaauacaauauauucccaagcaaaauguuacuuaaucuaccgaugcuagaccucuggaaacuccgcucagauucagcaaacuccaauaaggacaucucagcagaacagcucggcaggauccuuuacaugcucaaccaaaaacgaggcuacaaaagcguacgaagcgaagcgaacucagacaagaaagacaccgauuacguacaagcagugaaagggcgcuaugcccaacuaaaagaucggaaccaaacgaucggccaguacuucuacgaggaacuguacaacgcaaacgugaacaauagcuacuucaaaaucaaagaggaaguauacccccgugaagccuacauagaagaguucgacacuauaauaaacagccagaaaacgaaacacgaguuccucacagaccaauucguacaucaacuccgcaaugaaaucauauacuuccaacguaaacuaaaaucacagaagggacucauaagcaucugcgaauuugaaggguucgagaaaacaguauucgacaaagagaaaaacaaacacaaaaucguguucgucggccccaaggucgcuccgcgcucggcaccacuguuccaacucugucgcguuugggaaguuaucaacacuauaagcaucaaaguaaagaacccagaaggaucgaaauacaaauggggagaacguaucccgagcaucaaagaaaaagaaauacucgcugauuaccucuucaagaacgaaguacuauccuucaccaaauuacucgaaauccucggccucaacaaaaaugacgucuacgugaacaagcaaauauugaaaggcauaaaagggaacgaaacauacgcuacacuauacaacauacuuggggaaaaugaguuccucaacuucgacguaagcaucauaccaucaaaccacacgucgaugcuuguggacaagaaaacaggagaaauacucgaagaacgcgcaggccucgaacuggacgugucccuagaaaaacaaccguucuaccaacucuggcacaccaucuacucccugaaagaucuagaugaaugcaaaaacgcgcucauaaaaagguucgacuucgaugacgagaccgccgagaaucuaucccgcaucgacuucaacaaacaagccuucggcaauaaauccaacaaaucaaugagaaagauccuccccuucuuaauggagggguacgacuacagccaaucgugcagccuggcgggcuauaaccacaguaacagccucacaaaggacgaacgagaacaacagguaacgcuggacaggcuagaacuccucccgaagaacagucuacgacaacccauaguggagaaaauccucaaccaaaugauaaacuuggucaacgccauccucgaccaauacggcgagcucagcgaaauccgggucgaacuagcccgggaacugaaacaauccaaagaugaacgcaacgacgccgaccuccagaacacaaagaacaaaaagcugaacgacgaaauaggcaaacgcuuggcagagcuaggacugccgauuacaaaaagauacauccaaaaauacaaauucauauucccaucccucucuaaaaaccucaaggaugcccaugucaacaaccaguguauuuacugcggcgaaaccuucaacuuauccgaggcccucuccggagaugccuacgacgucgaccacaucgucccaaaggccuuacucuuugacgacucccagacaaacaagguccucguccaucgcaaaugcaacuccaccaagacuaaccagaccgccuacgacuacaucuccacaaagggagacgaacaaguacgaaucuacuucgaacgcgucgacgacugguucaaaucaggaaucauauccuacagcaagaugcagcgucuaaaaguaucccacaaagaauaccuggaaaggaaaaagaucggcaaagagaccgaaacagacaaaaagcucugggaaaacuucauagaccgccaacugcgagacacucaguacauaucccgaaagucccgcgaaauacugcagaaaguuugcaacaacgucaccaccacagaagggggcguaacagcaaagcuaagaaaccucugggggugggaugacguccucaugaaccuccaaaugccaaaauaccgugaacucggacaaacagugaucaaggaauggacaucugaacacgggaaacgcaaacaucagaaagaggaagucgaaaacuggacaaagcgcgacgaccaccgccaccacgccaucgacgcacuuguuauagccuguacgaaacagggcuuuauccaacgaauuaauacccuaaacucauccgacacuaaggaccucaugcucaaggagguagaagaggcaaaagucaaauucucugagaagacaacacuuuuagaaaaguaccuacgaacucaggagcccuucagcacccaagaaguaaugcgagaggcagacaaaguccuaguaucauucaaggcaggaaagaaaguggccaccauuacgaaauucaaggcgaucggcaaaaacaaagacagcggcgucauaguaccccgaggggcgcuacacgagcagagcguauacggcaagaucaaggucauagaaaaagacaaaccccucaaauaccucuucgaaaauuccgacaggaucguggaccccaaaguaaagaaacuggucgaagucagacuaucagaaaacgagaacaacuccaaaaccgccaucagcacacuaaagaaggcccccaucuuccucaacgaggagaaaaccgaagucuuagaaaaagccuccugcuacaacgacgcgacuguccugaaauacaaacuccaaaguauaaaagccucacaggcagacgauaucguugacgaaagggucaaguuucugguaaaggaacgauuagcccaauucggcaauaaagaaaaagaagccuuuaaagacauccuuugguucaacgaggaaaaacaaaucccaauaaucagcguccgacuguucgcaagacccgacgcaaacaaccuccaaguaauaaagaaagacgaaaacggaaagagcaucggcuucguccuaacgggcaacaaccaccacauagccaucuaugaagacaaggacaacaagcucauccaacacucuugcacauucuggcacgcaguugaacgcaagaaauacaacaucccgguggugaucaaaaacucaucggacguuuggucgcaauuacuggacaaacagcuaccggagucccuucugaacaagcuaccgacggacaagcucaaccuuaaguucuccaugcaacaaaacgagauguucauccucggacucucccagaaagaguucgacgaagccaucaaaaacaaccacaaaucauuccucuccaaauaucucuaccuagucuggagcauauccaacaacgacuacuacuuucgacaccaccuggaaacuaaaaacacagagcugaaaaacauaagcacagccaaagaaucuaaaagauacuuccgauucaaauccguaggugcucucgucggcaccaacccaaucaaaauccggcuaaaccaccuaggugaaauuaacaaagugggagaguacuga

SEQ ID NO: 6391 - RNA, 3807 nt, Artificial Sequence
  Cas9 variant
augaccaaaaacauauuggggcuagaccugggaaccaacucgaucggcugggcacugauugaagucgacgaaaacaauacgcccauacgcaucaucgcgauggggucccgaauaauaccucucaguacguccgacaaagaggaauuccagagaggccuaagcauaacaaaaaaccaaucucguacaguaagcaggacccagagaaagggcuacgaccggaagcaacucaagaaaagcgaccucaaaaaaauccugaauaaguacaacauauuccccucggaagagcuacugaagcuacccaugcuagaucucuggaagcuccgguccgacagcgcaaaccccaacgagaauaucucagcggaacagcuaggacgcauauuguacaugcuaaaccaaaaacgaggauacaaaucagcacgaucggaagccaacgcggacaagaaagacacagauuacguccaagcgguaaagggccguuacgcacaacugaaagaacgcaaccaaacuaucggccaguacuucuacgaagaacuauacaacgccaacacgaacaacagcuacuuucguaucaaagaagaggucuacccucgcgaagcauacacugaagaauucgauaccaucaucaacgcccagaaaaacaagcacgacuuucuaacggaugaggucguccaccaacuccggaaugagauuauauacuuccaaagaaaacuuaaaucacaaaaggggcugguaucgaucugcgaauucgaaggcuuugaaaaaacggucuucgacaaagaaaaaaacaaagacaaagugguguucguagggcccaaggucgcgcccaaaacuagccccuuauuccaacugugccgcaucugggaaguagucaacaccaucucccucaagaucaaaaacccggaagggucuaaauacaaauggggggagaaaauuccaaaccuuaaagaaaaacaaauucucgcagacuaccuauuuaagaacgacucccucagcuucacuaagcuccuggaaauccuagaccucaacaagaaugacgucuacguuaauaaacagauccugaaagggaucaagggcaacgaaaccuuuucgacccuacacaccguccucggugacaacgaguugcucaacuucgacgugagcauaauccccuccaaccauaccagcaugcucgucgacaaaaagaccggcgagauccucgaggaacgcgcgggacucgaacuggacgcaagucuggagaaagaaccacucuaccaacuguggcacaccauuuacagccucaaagaccucgacgaaugcaagaacgcccucauaaaacgcuucggcuucgaugacgagaccgccgaaaaacuuagucacauagauuucaacaaacaagcauucgggaacaaguccaacaaaagcaugcggaaaauacuuccguuccuaauggagggguacgacuacucacaauccugcagucuagccggcuacaaccacagcaacagccucacgaaagaugagagagagcaacaaaucacacuagaccggcuagaguugcuaagcaaaaacucucuucggcaaccaaucguggaaaaaauccucaaccaaaugaucaacguagugaacgccauccuagaacaguacggaaagcucucggagauucgugucgaacuagcccgugagcucaaacagaguaaagacgaacgcaacgacgcagaccuccagaauagcaagaacaaaaagcucaacgaagaaaucgggaagcgacucgccgaacucggccuaccagucacaaaacgauacauccaaaaauacaaguucaucuucccaagccuuagcaaaaaucugaaggaugcccacgugaacaaccaaugcaucuacugcggcgaaacguucaaccuaacagaggcacuaagcggugacgcauucgacguggaccacaucgugccgaaagcccugcucuucgacgacucccaaaccaauaaaguacuaguucaccgcaaauguaacucaacgaaaaccaaucaaacagcauacgacuacauuggcacaaagggcgaagaacaagugcgaguuuauuccgaacgaaucgacgacugguucaagcgcgggauaauaagcuacucgaaaaugcaacgccugaaagucagccacaaggaguaccuagaaaggaaaaaacucgggaaggaaacagaaacagacaaaaaacuaugggaaaacuucaucgacagacaacuccgcgacacacaguauauaagccgaaaggcccgcgaaauacuccaaaaagucugcaacaacgucaccacgaccgaaggaggcgucacagcaaagcugcgcaaccucuggggcugggacgauguacucaugaaucuacagaugccaaaauacaaagaacuugggcagaccguaauaaaagaauggacuuccgaacacgggaaacgcaaacaucaaaaggaagagaucgagaacuggacaaagagggaugaccaccgacaccacgcaauagacgcucuaguagucgcaugcacgaaacaaggcuucauccaacgcauaaacacccucaacuccuccgacacgaaggaccuaaugcagcgagaaauuaaagaggccaaaaagcuccuaggcgaaaacuacaacgagaaagaauucgaaaacgacaaugaauucguaaagaaccacaaagaacgccucagccaacucgacgauuaccucagauugcaaaaacccguaaaauuugacaccaaauacgucgaacaagaggcagacaaaguacucgucucauucaaagcaggcaaaaaaguagccacaaucacaaaauucaaagccacuggcaaaaacaaagacaccggugucaucgugccccgcggcgcccuccacgaggccgggcucuacgggauucgcaccaucuauagcaagggcggcaucgcggagaaacacaucaucaaaaaguacaaagugggcguuucagcacaagaccacaucuucacgggaaaagagacauauagcguuaagaaggacaagaacggaaacgaaaaagucgaugauaaaaucaaaaucguccuugacucaauagucgacaacaaggucaaagaagucgugcuuaaccgucuaaacaggggauucaacaacgaagaagauuacagaauagacguaaaaaaggcucugaauaacuucaaaaaccuagacgaggacccacucugguacaacgaauccaaaggcauaaagauccuaucaaucaaacuaaagacaggacucaaagacuccguagugccgcuucgcuuaaacgagaaaaacgaagugaucacacucguaaaaacaggcaacaaccaccauaucgcaaucuacgaagacaacgacggcaagcuaauccaauauagcugcacguucuggcaugcgguagaacgcaaaaaauacaacaucccgacugucauaaagaauuccagcgagguauggaaucaaguacuggacaagaagcuuccagaaucguuccucaaccggcuccccgcggacaaacucaaccugaaguucagcaugcaacaaaacgaaauguucauccugggacuccuugaagaagaguucgacaaagccauaaaggacaaugacaaaagccuccucucgaaguaucucuaccuggucuggaguauagcagaaggagacuacugguuccgacaccaccuggaaacaaaaaacaccgaacugaaaaaaacaaacggcgccaaggaauccaaacgcuauuuccgccuaagcacaaaagggcuuauagaccugaacccgguaaaaguaagacucaaccaccugggcgagauuacgaagauaggagaguacuga

SEQ ID NO: 6392 - RNA, 3810 nt, Artificial Sequence
  Cas9 variant
augaacaacucaauuaaguccaaacccgaagugaccaucgggcucgaccuaggcgucggcuccgugggcugggcgaucguagacaacgaaaccaacaucauucaccaccuaggcucgcgacucuucagccaagccaaaaccgccgaggaccgcagauccuuccgaggcgcacgcaggcugauccgcaggcgaaaauauaagcuaaagcgcuucauaaaccuaauauggaaauacaacucauacuucggcuucaaaaacaaggaggacauccuaaacaacuaccaggagcaacaaaaacuccacaauaccgucuuaaaccuaaaacuggaggcccuuaacgccaagauagacccgaaagccuuauccuggauacuucacgacuaccuaaagaacagaggccauuucuacgaagacaaccgagauuuuaacguguaccccaccgaggaacucgccaacuacuuuggcgaguacggcuacuauaaaggcauaauugacucgaaagaagauaaugacgacaaacucgaagaaggguuaacgaaguacaaauucucaaaccagcauuggcuagaagaaaucaaaaagguccuaagcaaccaaaccggccuucccgagaaauucaaagaagaauacgaaagccuuuucucuuauguacggaacuauucggaaggccccggcucaauaaacucuguaagcccauacggcauauaccaccuugacgaaaaggaaggaaaagugguccaaaaauacaacaacaucugggacaagaccauaggcaaaugcaguaucuuuccagacgaauaccgagccccaaagaacucaccaaucgccaugaucuucaacgaaaucaacgagcuauccacaauaagaagcuacucgauauaccuaacuggaugguucauaaaccaagaguucaagaaggccuaccugaacaaacuacucgaccugcugauaaaaaccaacuccgaaaaacccauagacgcccgccaguucaagaagcugcgcgaggaaaccaucgccgagagcaucggaaaggaaacccucaaagacguugagcgagaagagaaacuagagaaggaagaccacaaauggaaacuuaaagggcugaagcucaacaccaacgggaagauccaguacaacgaccugucgucacucgccaaauuuguccacaaacucaaacaacaccuaaaacuagauuucuuacucgaagaccaauacaccacgcucgacaaaaucaacuuccuccagucccuuuucguguaccuagguaagcaccuaagguacaguaaccgaguggacagcgccaaccuaaaagaguucucggauagcaacaaacuauuugaacgaguccuccaagaacaaaaagacgaccucuucaaacucuucgagcagaccgauaaggaugacgagaaaauccuugcccagacgcacagccucagcacaaaagccaugcuccucgcgauuacacgaaugaccaaccucgacaacgacgaagacaaccagaaaaacaaugacaaaggguggaauuucgaagcgaucaaaaacuucgaccagaaauucauugacaucacuaagaaaaacaacaaccucucccugaagcaagacaaacgcuaccuagaugaccgauucaucaacgacgccauccuaucacccggaguuaaacgcauccuccgggaagcgaccaagguauuuaaugcgauccugaaacaguucagcgaagaauaugacguaaccaaggucgucauugaacucgcccgcgaacuaagcgaagaaaaagagcuggagaacaccaaaaacuacgaaaaacucauaaagaaaaacagcgacaaaauaucggaacggcuggaagcccucgacauugcugaggacaaaauagaggacaucuugaaaucccccaccaaaucguacaaaguacugcuguggcuccaacaagaccacaucgacccauacucccaaaaagagaucgcguucgaggacauccugaccaaaacugagaaaacagaaauagaccacaucaucccauacucuaucuccuucgacgacuccagcucuaacaaacuccucgugcuggccgaaucaaaccaagccaaaucaaaucaaacaccauacgaguucauuaccagcgggaaugccgguaucaaaugggaagacuaugaggcauacuguaggaaauucaaagacggagacaccucacuccucgacucaacgcaacgcagcaaaaaguuugccaaaaugaugaaaaccgacacgaguagcaaauacgacauaggguucuuagcacgcaaccucaaugacacucgcuacgccacgauuguuuuccgcgacgcccucaaagacuacgcaaacaaccaccucgucgaggauaaaccaauguucaaaguagucugcauaaacggaggaguaaccaguuuccuccgaaagaacuuugacaaaaguugguacgcgaagaaagaccgcgauaaaaauauacaucacgccgucgaugcaucuauaauaagcaucuucucaaacgaaaccaaaacccucuucaaccaacucacacaguucgccgauuauaagcuguucaagaacacggacggauccuggaagaaaauagauccaaagaccggaguagucaccgaagucacagacgaaaacuggaagcagauacgaguucggaaccaagucucagaaaucgcaaaagucaucaauaaaugcauccaagacucuaacaucgaacggaaagcacgcuacagcaggaagaucgaaaacaagacaaacaucagccuauucaacgacaccguauacucagccaaaaagguaggauacgaagaccagaucaaacggaaaaaccuaaaaaccuuagacauacacgaauccgcagaagaaaacaagaacucuaaagugaaaaagcaauuugucuacagaaaacugguaaaugugucccuccuaaacaacgacaaacuagccgaccuguucgccgaaaaagaagauauacuaauguaucgggccaacccaugggugauaaaccuggccgagcaaaucuuuaacgaauacacagaaaacaagaaaaucaaaucucaaaacguauuugagaaauauauguuagaccucaccaaagaguuccccgaaaaguucuccgaagcguucgucaaaaguaugcuccgcaauaaaacggcaaucaucuacaacguagaaaagaaagucguccacagaaucaaacgccuaaaaauccuaucaucagagcucaaggagaacaaacuaucuaacguuauaaucagguccaaaaaugaaagcgggaccaaacuguccuaccaagauaccauaaauucgaucgcacugaugaucaugcgaucuaucgacccaaccgcgaaaaagcaauacauaagggucccccucaacacacugaaucuccaucuaggcgaccaggacuuugaccuccacaacaucgacgcauaucuuaaaaagccgaaguucgucaaguaccuuaaagcaaacgagauuggagaugaauacaagccuuggcgaguccucacauccgggacccuccucauucacaaaaaggacaagaaacucauguacauaagcuccuuccagaaccugaaagacgucaucgagaucaaaaaccucaucgaaaccgaauacaaagaaaacgacgacucggacccgaagaagaaaaagaaagcaaauagguucuuaaugacgcuaucaaccauacucaacgacuacauucuccucgacgccaaagauaauuucgacauccucggccuguccaaaaaccggaucgacgaaauccucaauagcaagcucggccuagacaaaauaaccaaauga

SEQ ID NO: 6393 - RNA, 3810 nt, Artificial Sequence
  Cas9 variant
augaacaacucgauuaaauccaagccagaagugacaaucgggcucgaccugggaguuggaucaguagguugggcgaucgucgacaacgaaacgaacauaauccaccaucucggcagcagacuguuuucacaagccaaaacagcagaagaccgucgcuccuuccguggggucagacgacugauccgccgucggaaauacaaguuaaaaagguucgugaauuuaauauggaaguacaauagcuacuucggcuuuaagaacaaggaggauauucucaacaacuaccaggaacaacaaaagcuccacaacaccguucucaaccucaagucagaggcccucaacgcaaaaauagacccgaaggcccuuagcuggauccuucacgauuaccucaaaaaucgaggccacuuuuacgaagacaaucgcgacuucaacguguaccccacaaaagaacuugccaaguacuucgacaaguacggcuauuacaagggcauaauagacuccaaagaggacaacgacaacaagcuagaagaagaacucacgaaauacaaguucuccaacaaacacuggcucgaagagguaaagaaaguccuaagcaaccaaacgggcuuaccugaaaaauucaaggaagaguacgaaucccucuucuccuacguccgcaacuacuccgagggcccuggcagcauuaacuccguaucgccauacggcauuuaccaccucgacgaaaaggaaggcaaaguagugcagaaguacaacaacaucugggacaagacgaucggcaagugcaacaucuucccugacgaguacagagccccgaaaaacuccccaaucgccaugauauucaacgaaaucaacgaacucagcaccauuagauccuacuccauuuaccuaacagggugguucaucaaccaggaauuuaaaaaggcauaccucaacaagcuccucgaccuccuuaucaaaacgaacggugaaaaaccaauagacgcccgacaauucaagaaacuccgcgaagaaacaauagcugaguccaucgggaaagaaacgcucaaggauguugaaaacgaagagaaacucgaaaaagaagaccacaaauggaagcucaaaggacuuaagcugaacaccaacggaaaaauccaguacaacgaccucucgagccuugccaaguucguacacaagcuaaagcagcaucuaaaacuagacuuccugcucgaagaccaguaugccacgcucgacaagaucaauuuccuucaaagccucuucgucuaccuuggaaagcaucuacgcuauaacaacaggguagacagcgccaaccuaaaggaguucucggacagcaaccggcucuuugaacggguauugcaggaacaaaaagacggacucuuuaaacuauucgaacaaacggacaaagacgacgagaaaauccuugcacaaacacacagcuuaucaaccaaggccaugcuccuagcgauaacccgcaugacaaaucuagacaacgacgaagacaaccagaaaaauaacgacaaaggcuggaacuucgaagccaucaaaaacuucgaccaaaaauucaucgacauaaccaaaaccaacaauaaccuaucccuaaagcaggauaaacgcuaccucgacgaccguuucaucaacgacgcaauacucucgccuggcgugaagcguauacuucgcgaagccaccaagguuuucaacgccauccuaaaacaguucucccaagaguacgacguaacgaaggucgucaucgaacuagcacgcgaacucagcgaggagaaggaacucgaaaauaacaaaaacuacaaaaagcucaucaagaaaaacucggauaaaaucagcgagggucugaaagcccuagacauagccgaggacaaaaucgaggauauucuaaagucucccacaaagagcuacaaaguacugcucuggcuacagcaagaccacauagacccuuacagccagaaggagaucgcuuucgaggauauccugaccaaaacagagaaaacagaaauagaccauauaaucccguacucaaucuccuucgacgauagcaguagcaacaaacuucuaguccucgcagaaucaaaccaggccaagagcaaccagacccccuacgaauuuauaacgucuggaaacgcaggaauuaagugggaggacuaugaagccuacugccgcaaguuuaaagacggcgacaccucccugcuagacuccacacagaggagcaagaaauucgcgaaaaugaugaaaacagacacuucauccaaauacgacauaggcuuccuggccaggaaucugaacgacacacgcuacgcaacaaucgucuuccgagacgcacucaaagacuacgccaacaaucaccucguagaggacaagccuauguucaaagucgucugcaucaacgguggggucacaucauuccuacgcaaaaacuuugacaaauccugguacgcgaagaaggaccgcgacaaaaacauccaccacgccgucgacgcauccaucaucagcauauuuucuaacaaaacgaagacccuauucgaccaacucacacaguuugccgauuacaaacuguucaaaaacaccgacggauccuggaagaaaaucgacccaaaaaccgggguagucacggaggucacagacgagaacuggaaacaaauccgcguucgcaaccaagucagcaaaaucgcggaagaaaucgacaaaugcauccaggauucuaauaucgagagaaaagcgcgcuacucgcggaaaaucgaaaacaagacgaacauuucccuuuucaacgacaccguguacucggcuaagaaagucggcuaugacgaccaaauaaaaaggaaaaaccugaaaacccucgauauugacgaauccgucgaggagaacaaaaacuccaaagugaagaaacaauucguauaccgaaaacugguuaacgugucccuccucaacaacgacaaacuagccgaccucuuugcagagaaagaagacauacucauguaucgagccaaccccuggguaauaaaccucgccgagcaaauuuucaacgaguacaccgaaaaccguaaaaucaaaucccaaaaugucuucggaaaauacaugcucgaccucacaaaagaguucccagagaaauucagcgaggcuuuugucaaaucaaugcuacguaauaaaacugcaauaauauacaacguggaaaagaaagucguccacagaaucaaacgccuaaaaauccuguccuccgaacucaaagaaaauaaacucuccaacgugauuauccgaaguaaaaacgaauccggcaccaaguuguccuaccaagacaccauaaacucugucgcccuuaugauaaugcgcuccauagaccccaccgccaagaaacaauacauacgggucccccugaauacgcuaaaucuccaucuuggagaccacgacuucgaccuacacaacaucgacgccuaccucaagaaaccaaaauucguaaaauaccugaaagccaacgaaaucggcgacgaauacaaacccuggcgaguacuuaucucggggucgcucuuaauucacaaacgcgauaagaagcucauguacaucucuuccuuccagaaccucaacgaccucaucgaaaucaaaaaccuaauagagaccgaguacaaagaaaacgucgacuccgaccccaaaaagaagaagaaagccucccaaauacugcgcucucucucaacuaucuuaaacgacuacauccuccuugaugccaaagacaacuuugacauccuuggacucuccaaaaaccgcaucgacgagauccuuaauucuaaacucgaccuagauaaaaucgccaaauga

SEQ ID NO: 6394 - RNA, 3822 nt, Artificial Sequence
  Cas9 variant
augaagaaaauacucggccuugaccucggcacuaacagcauaggaugggcacucauagaaguggaugaaaacaacuucccaauuagaaucauagcaauggggagccgcaucauaccccuaagcuccaacgacaaagacgaguuccaaagaggcuuauccaucaccaaaaaccaaagcagaacaguaagccggacccagcgcaaaggcuacgaccgcaaacagcuaaagaaauccgacgacuucaaauacagucuccggcguauacucaacaaauacaacaucuucccgucggaagaacuucucaaacucccuaugcuggaccucuggaaacuacgcucagacgcaguaaaccccaacgaaaacaucuccgccgagcagcugggccgcauacuauacaugcucaaccagaaacgcggauacaaaagcgcccgguccgaggccaacgcugauaagaaagauaccgacuacguacuagccgugaaaggccgguacgcacaacucaaggacagaaaccaaaccauaggucaguacuuuuacgaggagcugcauaacgccaaaaccacuaacagcuacuuccgcacaaaagaagaagucuacccacgcgaggcauauauagaggaguucgacacgauuaucaacgcacaaaagagcaagcacgacuuccugacggacgaaguaguccaccaguuacgaaacgagaucauauacuuccagagaaagcucaaaagccaaaaaggccucgugagcaucugcgaguucgaaggcuucgagaaaacaauauucgacaaagaaaaagacaagaacaaggucguauucgucggccccaaagucgcgccaaaaaccucaccgcuauuccagcugugccggauaugggaagucgugaacacaaucacgcuaaagaucaaaaacccggaaggcucgaaguacaaauggggcgagaagauacccaacauaaaagagaaggaagcccuggccgacuacuuguucaagaacgaaacgcucagcuucaacaagcuccucgacauucucgaacuaaagaaggagaacguguacguaaacaaacaaaucaucaagggaaucaaaggaaacgagaccuauuccgcucuccaccgcauacucggggacaacgagcuccuuaaauucgacguguccauaaucccaucaaaccacaccucgaugcuagucgacaagaaaaccggggagauacuggaggaacgggcaggacucgaacucgacgucucucucgagaaagaaccccucuaccaguuauggcacacaauauacagcaucaaggaccucgacgaaugcaaaaacgcccuaaucaaacgcuucggauuugacgacgaaauagcagagaaacucucacaccucgacuucaacaaacaagccuucggcaacaagagcaacaaguccaugcgaaaaauauugcccuucuuaauggaagguuacaacuacucgcagagcugcacccuagcgggauauaaccacagcaacucgcugaccaaagacgaacgagagcaacaagugacacucgacaaacuagaacuacuuccuaaaaauucccugcgacaaccuaucgucgagaaaauacucaaucagaugauaaauguugucaacgccauacuugaggaauacgggaaaccaucagaaauacgcaucgaacucgcgagagagcugaaacaaagcaaagacgaacgacacgacgccgaccugcaaaacuccaaaaacaagaaacugaacgaagaaaucggcaaacgccucacggagcugggguuaccagucaccaaacgcuacauccaaaaauacaaauucauauucccaucacucuccaagucauuaaaagacgcccaagucaacaaucaauguauauacugcggcgaaacguucaaccucacggaagcacuaucuggagacgccuacgacguagaccauauagucccaaaaucccuccuauucgacgacagccagacgaacaaggugcucguccacagaaaaugcaacagcaccaaaacuaaccaaaccgcauaugacuacaucgcuagcaaaggcgaggaagaagugcaaaucuacagcgcucgcguugacgacugguucaaacggggaaucauauccuacuccaagaugcagcgucucaaggucagccacaaagaauaccuggagagaaagucacuaaacaaggaaaccgaaaccgauaagaaacuaugggagaacuucauagaucggcaacugcgagacacccaauacaucucccggaaauccaaagaaauccugcagaaggugugcaacaacgucacgacaacagaagggggcgucacagccaaacuccgagaccuauggggaugggacgacauacugaugaaccuacagaugccaaaauacaaagagcuccgacaaaccgucaucaaggaguggacuucggaacaugggaagcgaaagcaccagaaagaagaaauagagaacuggaccaaaagggacgaccaccgacaccaugccaucgacgcccucgucauagccugcacaaaacagggcuucauacagcgcaucaauacccuaaacucuuccgaaacaaaggaccucaugcagcaagaaauaaacgaagccaagaagcuauuaggggaaaacuacaaagacaaggaauuugagaacucgaacgagcuagucaaaaaccacaagggccguuuauccaaauuagacgacuaccuccgccuacagaaaccgaucaaauucaacacaaaauacgucgaaaaagaggcagauaagauacuuaucagcuucaaggcuggcaagaaagucgcaacaauaaccaaauucaaggccaccggcaaaaacaaggacaccggaguaauagugccccgaggugcccuacacgaagccgggcuauacgguguaagaaccauauacucaaaagggggcaucgccgagaaacacaucauaaagaaauacaaagucggcgucagcgcacaagaccacaucuucacaggcaaagagucauacuccguaaagaaagacaaaaacgggaacgagaaaguagacgacaaaauaaaaguagugcuggacucgaucgucgacuccaaggugaaggagaucguccuaaaccgccucaauuucggcuucucggacggcgaagacuacaaaaauaacgucaaaaaggcauugaacaacuucaagaauuuggacgaguacccccugugguacaacgagaacaagggcauaaaaauccuauccaucaaguuaaagaccggcuuaaaggacucagucgucccacuccggcuaaacgagucaaaugaggucauaacgcucgucaagaccggcaacaaccaccauaucgcaaucuacgaagacaaaaauagcaaaccugugcagcauagcugcaccuucuggcacgccgucgaaaggaagaaauacaacauccccgcaguuaucaagaaauccagugacgucuggaaccaacuacucgacaaagaacucccagagagcuuccugaacaaccuccccgaagacaaccuaaacuugaaauucuccaugcaacagaacgaaauguucguacucggcuuaucccaagaagaguuuaaggaagcgauagagaacaacgacaaaucccugcucagcaaauaucucuaccuagucuggagcguaagcgaaaacaacuacugguuuaggcaccaucucgaaacuaagaacagugaccucaagaaaacggaaggagccaaagagucaaagcgcuuauacaacauacgcagcguauccagccuauucagucucaaccccgugaaggugcgucucaaucaccugggagaaaucacgaagaucggcgaauacuga

SEQ ID NO: 6395 - RNA, 3825 nt, Artificial Sequence
  Cas9 variant
augacgaagcacaucuuagggcuggaccucggcaccaacucaauaggcugggccauaauccaaguagacaacaacaacaacgucccaauccaaaucaucgcuaugggcagccgcauaaucccgcuugacaguaacgaccgcgaucaauuccaaaaaggccaggccauauccaagaacaaagaccgaacgaccgcccgaacccagcgaaaaggcuacgaccgaaaacagcucaagaaaucugacgacuucaaauacucacuaaagaaaauacucgaaaaacuggacaucuucccaaccgaagaauugaugaaauuacccacccuggaccucuggaaacuccgcuccgacgcagucagcaauauugaggacaucacacccaagcaacucgggcgcaucuuguacaugcuuaaccagaaaagaggauacaaauccgcaagguccgaggcaaacgccgacaaaaaggacaccgacuacguagccgaagucaaaggacgguacacacagcugaaagacaaaggacagacccugggccaauacuucuacaaggaacucucagacgccaaccaaaacaacaccuacuaucggguuaaagaaaaggucuacccacgcgaggccuauaucgaagaguucgacgcaaucaucaacguccaaaagagcaaacacucguucuuaaccgacgagguaauucacucccuccguaacgaaaucauauacuaccagcgcaaacucaaaucacaaaaaggccuaguaucgaucugcgaguucgaaggcuuugaaacaacauacuuugauaagaaaacacaacaggacaaaaccauauuuacaggacccaaaguggcaccucgcacauccccucuguuccaguucugcaaaauuugggaagugguaaacaacauaagccucaaaacuaaaaacccagaaggcagcaaauacaaaugguccgaccgcauccccaccaucgaagaaaaacagacgaucgccaacuacuugcaggaaaacgaaaaccucagcuucaucgagcuacuuaaaauccuccaacuaaagaaagaacaagucuacgcgaacaaacaaaucuuaaaaggcauacaagggaacacaaccuucuccgcgauacacaaaaucaucggaaacagcgaacaccucaaauucgacauugagaccauaccguccaaacacuucgccgugcucguagacaagaagacuggagaaauacuugacgagagggacucccucgagcuuaacuccgcccuagaacaagaaccauucuaccagcucuggcacaccauauacucgaucaaagaccuagacgaaugcaagaaagcacuaauaaaacgauucaacuucgaagaagagauugcggagaaacugagcaaaaucgacuucaacaaacaggcuuucggcaauaagagcaacaaggccaugcgcaaaaugcugccauaccuuaugcucggguacaaccaaucagaagcagaaucauucgcaggcuauaaccggcgccuuaccaaagaagaaaaguccaaaaaugucagcgaugagccgcuccaacuguuagccaagaacucacuacggcaacccgucguagaaaagauccucaaccagaugaucaacguaguaaacgcaauuaucgagaaguacggcaagccggaagaaauccgggucgaacucgcacgggagcuaaagcaaucgaaagacgaaagggaagacgcagauaagcagaacggcuucaacaagaaacugaacgagcuaguugccacaaaguugacggaacucggccucccgaccaccaaacacuacauccagaaauacaaguucauuuuccccgcgaaagacaaaaacuggaaggaagcccagguugcgaaccaaugcaucuacugcggugacacauucaaccuaacggaagcccuaagcggggacaauuucgacguagaccauaucgucccuaaagcacuacuuuucgacgacucacaggccaacaaagugcuaguccaccgcaguuguaacuccaccaaaaccaacaacaccgccuacgacuacauaaccaagaaagguucccaagcucuaaacgacuacguagcccgugucgacgauugguucaaacgcggcauaaucucauauggcaaaaugcagcggcugaaagucucauucgaagaauaccaggagcgaaagaaaaucggaaaggagaccgaagccgacaaacggaucugggaaaacuuuaucgacagacagcuccgcgaaacugccuacauagcaaagaaggcaaaagaaauacuugaaaaaguaugccacaacgugaccagcaccgaaggcaacgucacggcaaagcuccgacaacuguggggcugggacaacgugcucaugaaccuucaacuuccaaaguacaaagaacucgaaaagaaaacgaaacaaaccuucacacagcugaaggaauggaccuccgaccacggaaaccgcaaacaccaaaaggaagaaaucaucaacuggaccaaacgagaugaccacaggcaccacgccauagacgcccucgucaucgccugcacucaacagggguuuauacaaagaaucaacacccugucguccagcgacguaaaagacgaaaugaagaaagaacucgaggaagacaaaacuguguacaaugaacgacugacacuacuagagaacuaccuccucgaaaagaaacccuucagcacggaggaaauagagaaagaagccgacaaaauacuugucuccuucaaagcggguaagaaaguugccacacucucaaaauacaaggcgacaggaauaaaugagaucaaaggaguccuagugccccgcggcccguuacacgaacagagugucuauggaaaaaucaaagugauagaaaaagacaagccccucaaauaucucuucgaaaacuccgacaaaaucgucaacccccucaucaaacaccuagugaagacacgccuacuagagaacgagaauaacgcacaagccgcgcucguaacccucaaaaacaagccaauacuccugaauaacaaacaaaccgaaauccucgaaaaggcauccugcuacaacgaggccacaguccugaaguacaaacuacaaagccuaaaggcuagccaaauagacgacaucguagaugagaaaaucaaauuccucaucaaagaaagacugaguaaauucggcaacaaagagaaggaggccuucaaggacauccucugguucaacgagaagaaacagauccccaucacaaguauccgacuguucgcacgcccagacgccaacaaccugcaaguaaucaaaaagcacgagaaggggaagaacaucggauucguccuuagcggaaacaaucaccacaucgccauuuacgaggacaaaaauaacaaacugauccagcacaucugugauuucuggcacgcggucgagcggaagaggaacaauauuccaguccugauugaagacaccucgaccaucuggaaccaccuaauaaacgaggacuucagcgagaguuuccucaacaaauuacccaacgauucacugaaacucaaauucucucuacaacagaacgagauguucauacuaggccucccgaaggaacaguccgaggaggcuauaaaaagcaacaacaaaucccuucucucaaagcaucucuaccuuguaugguccauaaccgacggcgacuacuucuuccgucaccaccuagagaccaaaaacaccgagcucaaaaagauagacggauccaaagaguccaaacgcuaccuccgucucagcacaaaaucccuagucgaccucaaccccaucaaaguacgccuaaaucaccucggcgaaauaacuaaaauaggggaauga

SEQ ID NO: 6396 - RNA, 3846 nt, Artificial Sequence
  Cas9 variant
auggaagacgacagccagcacgacauaagggaaaucuaccuggccauccaccacauggucaaauacaggggaaacuucuuagucgaaggaacgcuagaaaguucgaacgcuuucaaagaagacgaacugcuaaaacuccugggaagaauaacacgcuacgagaugucagagggcgagcaaaauagcgacaucgagcaagacgacgaaaacaagcuaguagcaccggcaaacggacagcuagcagacgcccucugugcaacacgcggaucccgcagcaugagaguagacaacgcacucgaagcacuguccgcuguaaacgaucugagccgcgagcaacgggcgauagugaaagccauauuugcagguuuagagggaaacaaauuagaccucgccaaaaucuuugucagcaaagaauuuucaucggaaaacaaaaagauccucggcaucuacuuuaacaaaagcgacuacgaggaaaagugcgugcagaucgucgacuccgggcuccuagacgacgaggaacgugaguucuuagaccgcaugcaaggccaauacaacgccauagccuuaaaacaacuccugggaagaucaacuagcguaucagauagcaaaugugcgagcuaugacgcucacagggcaaacuggaaccucauaaaacuccaacuuaggacgaaagaaaacgaaaaagacaucaaugaaaacuacggcauccuaguuggcuggaagauagacagcggccaaaggaagucgguacggggagaaagcgcguacgaaaacaugcgcaagaaagcaaacguguucuucaagaaaaugauagaaaccagugaccucucagaaacagacaaaaauagacucauucacgacaucgaagaagacaaacucuucccuauccagcgcgacagugacaaugggguuauaccccaccaacuacaccagaacgaauuaaaacaaauaauuaagaaacagggaaaauacuacccguucuuacucgacgcauucgagaaagacggcaaacagaucaacaaaaucgagggccuauuagcguuccguguaccauacuuugucggaccauugguagugcccgaggaccuacaaaaguccgacaacagcgaaaaccacuggaugguucggaaaaagaagggcgagaucaccccauggaacuucgacgaaaugguggacaaagacgcaucaggccgcaaauuuauagagcggcuggugggaaccgauaguuacuugcucggcgaacccaccuuaccgaaaaacagccuucuguaccaagaguacgaggugcucaacgaacucaacaacguaaggcucuccguacgaaccgggaaccauuggaacgauaaaaggagaaugcggcucggccgcgaggagaagacccugcuaugccaacgucucuucaugaaaggccaaacaguaaccaaacggacagcggaaaauuugcucagaaaggaguacggacgcacauacgagcuaucaggacuaagcgacgaauccaaguucacaagcagccuuagcaccuacggaaaaauguguagaauuuucggcgagaaauacguuaaugaacaccgagaccucauggaaaagaucgucgagcugcaaacaguauucgaagacaaagagacacuacugcaccaguugcggcagcuggaagggauaagcgaagccgacugcgcgcuauuggucaacacccacuacacagguuggggaaggcuaucgcgcaagcuccugaccaccaaggcaggcgaaugcaagauaucagacgacuucgccccaagaaaacauagcauuaucgagaucaugcgggcugaagaccggaaccucauggagaucaucaccgacaaacaacuaggcuucucagacuggaucgaacaagagaaccuaggcgccgagaacgggagcagucugauggaaguagucgacgaccucagaguguccccuaaaguaaaaaggggaauuauucaauccauacggcuaaucgacgacauaaguaaagccgucgggaaacgccccuccaggauauuccuagaacuggcagaugacauccaaccaagcgggcgaaccauuagccgcaaaucgcgucuucaggaccuauaccgaaacgcaaaucuuggcaaagaguucaaaggcauagccgaugaauuaaacgcaugcucagacaaagaccuacaagacgacagacuauuccuauacuacacccaacugggaaaagacauguacacgggagaagaacuagaccucgaucggcucuccagcgcguacgauauagaccacauaaucccccaagcggucacgcaaaaugacagcauagacaaccgaguccucguagcacgcgccgaaaaugcccgaaagacagacuccuucacguacaugccucagaucgcggaccggaugcggaacuuuuggcaaauccugcucgacaacggccuaaucagcagaguaaaauucgagcgacuuaccaggcagaacgaguuuagcgagagagaaaaagaaagauucguccaacggucacucguggaaacgcgccagaucaugaaaaauguagccaccuugaugagacaaagauacgggaacagugcagcagucaucggccuaaacgcggaacucaccaaggaaaugcaucgguaccuaggcuucucacacaaaaaccgagacaucaacgauuaccaccacgcgcaggacgcacucuguguagggaucgcaggccaguucgccgcaaaccgaggauucuuugccgacggcgaagucagcgacggcgcacaaaauucauacaaucaauaccuacgcgauuaccuacgaggcuauagagagaagcucucggcggaggauagaaagcaaggacgggcguucggcuucauagucggaucgaugcgcucgcaggacgaacaaaaacggguuaacccgaggaccggagaaguagucugguccgaggaagauaaggacuaccuacgcaaagugaugaacuaccgaaaaaugcucguaacgcagaaaguaggagacgacuucggagccuuguacgacgaaacgagauacgcggcaaccgaucccaagggaaucaaaggaauaccauucgauggcgcgaaacaggacaccucccuauacggaggguucagcagcgcaaaaccagcguacgcgguacugauagaaagcaagggcaagacccgacucgucaacgucaccaugcaggaauauucacuguuaggagaccgaccgucagacgacgaacuccguaaagugcucgccaaaaagaaaagcgaauaugccaaagccaacauucuacuccggcacguccccaagaugcaacucauccguuacggaggcggacuaaugguaaucaaaucagcuggcgaacucaauaacgcacaacaacucuggcuccccuacgaagaauacugcuacuuugacgaccugagccagggcaaagguucgcuagaaaaagacgaccugaaaaagcuccuagacagcauauuaggaucggugcaaugccuauacccauggcacagguucacggaagaggaacucgcagaccuacacguggcauucgacaaacucccagaagacgagaagaaaaacgugaucacagggaucgugagcgcgcuccacgccgacgccaagacagcuaaccugagcaucguagggaugacgggaucguggcggcgcaugaacaacaaaucaggauacaccuuuagcgacgaggacgaguucaucuuccagucccccagcggauuauucgaaaaacgggucacggucggggaacugaaaagaaaagcaaagaaagaagugaacuccaaauaccguacaaacgaaaaacggcuccccacucugagcggcgcaucacaaccauga

SEQ ID NO: 6397 - RNA, 3861 nt, Artificial Sequence
  Cas9 variant
augacuaaaaacauucucgggcucgaccucggcaccaacuccauagggugggcccugaucgaggucgacgagaacaacacacccaucagaaucaucgccaugggcagcagaauaaucccacuaagcaccagcgacaaagaagaguuccaacgaggccuaagcaucaccaaaaaccagucgcggacaguaagccgaacacagcggaaggguuacgaccggaagcagcuaaagaaaucggaccugaagaaaaucuuaaacaaauacaacauauucccaagcgaggaacuccucaaacuaccgauguuggaccuguggaaacugagaagcgacuccgcgaaccccaaugaaaacaucuccgccgaacaacuaggccggauccuguauaugcuuaaccaaaaacgaggcuacaaaagcgcccgcagugaggcaaacgccgacaagaaagacacagacuacguccaagcagucaaaggccgauacgcccaacuaaaagaacgcaaccagaccaucggccaauacuucuacgaggaacuuuauaacgccaacaccaacaacaguuacuuccgaaucaaagaggaaguauacccaagagaagcauacacggaagaguucgacacgaucauuaacgcucagaaaaacaaacacgauuuccuuaccgacgaagucguacaccaacuccgcaacgaaauaaucuacuuccagcgcaaauuaaagagccagaaaggacuggucuccaucugcgaguucgaaggcuucgagaaaacagucuucgacaaagaaaagaacaaagacaaagucgucuucgucggaagcaaaguagcacccaaaaccagcccacucuuucaacucugccgaauaugggaagucgucaauacgauaucacucaagaucaaaaaccccgaaggcaguaaauacaaguggggcgagaaaacccccaaucucaaagaaaaagaaauccuggcggauuaccuguucaaaaacgacagccugagcuucaccaagcuccucgaaauccuagaccugaacaaaaacgacgucuacgucaacaaacaaauacucaaaggaauuaaaggaaacgaaacuuucucagcacuccacacgguacucggggacaacgagcuuuuaaacuucgacgugaguaucauucccagcaaccauacaucaaugcucgucgauaaaaagaccggcgaaauacucgaagaacgcgcgggccucgaacuagacgcuagccucgagaaagaaccccuauaccaauuguggcacaccaucuacucgcuaaaaguccuggacgaaugcaaaaacgcgcuaauuaagcgauucggcuucgacgacgaaacagccgaaaaacugagccacauagacuucaauaaacaggccuucggaaacaaauccaacaaaagcaugcggaaaauacugccuuuccucauggagggguacgauuacagccaaagcugcuccuuagccggcuacaaccauuccaacagccuaacgaaagacgaacgagaacagcagauaacccucgauaggcuggaacuccucucuaaaaacucgcugagacaaccuauaguugagaaaauacugaaccagaugaucaacgugguuaacgccauccucgaacaauacggaaaacuaagcgagauccgcgucgagcucgcccgcgaacuaaaacaguccaaggacgagagaaacgacgcagaccuacaaaacuccaaaaacaaaaagcucaacgaagaaaucgguaaaagauuagcagagcucggccuaccagucaccaaaagguacauccagaaauacaaauuuauauucccaagccuuagcaaaaaccucaaagacgcacacgucaacaaccaaugcaucuacuguggcgaaacguucaaucucacagaggcccucuccggcgacgccuuugacguggaccacauagugcccaaagcucuguuguucgacgacucccagacuaacaaaguccucgugcaccggaagugcaacucgacuaaaaccaaccagaccgcauacgacuacaucggaaccaaaggcgaagaacaaguacgaauuuacucggaacgcguugacgacugguucaagcgcggcaucauauccuacagcaaaaugcaacgccuaaaaguaagccacaaagaguaccucgaacgcaagaaacuggggaaggagacggagaccgacaagaaacuuugggaaaacuucaucgaccgccaacuacgagacacacaauacaucucgcgaaaagccagagagauccuccaaaagguaugcaacaacgucacgacuaccgaaggcggaaucacagcaaagcuccgaaaucucuggggcugggacgacguccucaugaaccuacaaaugcccaaguacaaagagcuugggcaaacagucaucaaagaguggacaagcgagcacggcaaacggaagcaccaaaaagaagagaucgaaaacuggacaaaacgagacgaccacagacaucaugcaaucgacgcacucgucgucgcgugcacgaaacaaggcuucauccaacgcaucaacacccucaacucaagcgacacgaaagaccuaaugcaacgggagauaaaagaggcuaaaaaguuacugggcgagaacuauaaugaaaaggaguucgagaacgacaacgaauuugugaaaaaucacaaagaacgccucagccagcuggacgacuaccuaagacuacaaaaaccgguaaaauucgacacaaaguacguagaacaggaggccgacaaaguccuagucucguucaaagccgguaagaaagucgcaacaaucacaaaauucaaggccaccgggaaaaacaaggauaccggcgucauagugcuacgaggagcacugcaugaacagucugucuacggcaaaauaaaaguaauagaaaaagauaaaccucucaaauaccuguucgaaaacagcaagaaaauugugaacccaaaaaucaaaguccucguggaggagcgacuagccgagaacgaaaacaauuccaaacuaagccugaguaccuuaaagaaaaacccuauauuccucaacgaagagaaaaccgaaauacuagaaaaagcaagcugcuauaacgacgcaacggugcucaaauacaaacuccaaagccucaaggcaagccaagccgacgacaucgucgacgauagagucaaauuccucgucaaggaacgccuagcacaauuuggcaacaaagaaaaagaggccuucaaggacacacuauggcuaaacgaagaaaagcaaauaccuaucaucaccgugcgccuguuugcccgcccagacgccaacaaccugcaggcaaucaagaaagacaaaaacgggcgggauauuggguucguccucaccgggaacaaccaccacaucgcaaucuacgaggacaaagacaacaagcuggugcaacacaguuguacauuuuggcacgcuguugaacggaagaaaaacaacguaccugcugucaucaaaaacagcuccgacguuuggaaccaacuccuggacaaagagcucccagagucauuucucaacaaauugccaauugacaagcucaaguuaaaauucagccuacaacagaacgaaauguucguccuaggccuccuccaggaggacuucgaagccgccaucgaaaacaacgauaaaacccucuuaucaaagcaccucuaucuaguauggagcauaacagacggcgacuacuucuuccgccaccaccucgagaccaaaaacacagagcugaaaaagacagaaggcgccaaagaaagcaaacgguacuuucgccucucgacaaaaggacuaauagaccuaaaucccguuaaaguacgccuuaaccaccuaggagagaucacaaagaucggagaauacuga

SEQ ID NO: 6398 - RNA, 3864 nt, Artificial Sequence
  Cas9 variant
augaaaacggucuuagggcucgaccucggcaccaacuccaucggaugggcgcuuaucgaacucgacgaaaacaacaucccaaucagaaucguggcaaugggcagccgcauaaucccgcuguccacuuccgacaaagaagaguuccagcggggccugagcauaaccaaaaaccagucccgcacagucucgcggacacaacgaaaaggguacgaccggaagcaacucaagaaauccuaccucaagaaaaucuuaaacaaauacaacaucuuuccauccgacgaacuccuaaaacucccaaugcuagaccucuggaaguuacgaagcgacagcgcaaacccgaacgaaaauaucagcgcagaacagcucggucgcauccuuuacaugcucaaccaaaagaggggguacaagagcgcacggucagaagcuaacgcugauaaaaaggacaccgacuauauccaagccgucaagggccgcuacgcacaacuuaaagaccgcaaccaaacaaucggacaauacuucuacggggagcugaacgacgccaacgaaaacaacagcuacuuccgcaucaaagaggaaguguaccccagggaagccuacaccgaggaguucgacaccaucauuaacgcccaaaaagacaagcacgacuuccugacggacgaaguaauccaccaacugcguaacgaaauaaucuacuuccaacgaaaacuaaagagccaaaaaggccuagucagcaucugcgaauuugaaggauucgagaagaccgucuucgacaaagagaaaaacaaggacaaaguagucuucguaggcccgaagguggccccaaagacguccccacuuuuccaacuaugccgcaucugggaagucgucaacaccaucacccucaaaauaaagaaucccgaaggcuccaaauacaaauggggcgaaaagaucccugaugucaaggaaaaagagauacuugccgauuaucuuuucaaaaacgaaagccugagcuuuaccaaacuccucgagauccucaagcucaacaagaacaacguguacuucaauaaacagauccucaagggaauuaagggaaacgaaacguauucaauccuccacucuauccuaggcgacucggaacuacugaacuucgaugucucaauuaucccaucgaaccacacgagcaugcuaauagacaaaaagacaggcgaaauccucgaggaacgagccggacuugaacucgauacuucacucgagaaggaaccccuaaaccaacuauggcacacaaucuacagcaucaaggaccuugaugaguguaaguccgcccuaaucaaaagauucggauucgacgacgagacggcggacaaacugucacguauagacuuuaacaaacaagcauucggaaauaaauccaacaaaagcaugcgaaaaauccucccguuccucauggaaggcuacgacuacucccaaucaugcucgcuugccggauacaaccacucaaauuccuucacuaaagacgaacgcgaacaacagaucacucucgacaaacucgagcuacuccccaagaacagucuccgccagccgaucgucgagaaaauccuaaaccagaugaucaacguaguaaacgcaauacucgaacgcuacggcaagccaagcgaaauacgcgucgaacucgccagggagcuaaagcagucgaaagacgaacgcaaugacacugaccuacaaaacuccaaaaacaagaaacucaacgaggaaaucgguaaaagauuagccgagcuaggccucccacucacgaaacgguacauccaaaaauacaaauucaucuucccaucccucuccaagaaccuaaaggaugcucaugugaacaaccaaugcauauacugcggcgagaccuucaaucucacagaggcgcuauccggagacgcauuugacguagaucacauaguccccaaagcgcuacucuucgaugacucacagacuaacaagguacugguccaccgaaaaugcaacuccaccaaaacaaaccagacagcuuacgacuacauugccacaaaaggcgacgaacagguccgcgucuacuccgagcgggucgacgacugguucaaacgagggaucaucucauacuccaaaaugcagcggcugaagguaagccacaaagaguaccuagagcgaaagaagcuaggcaaagaaacagaaacagauaagaaacucugggagaacuucaucgaccgccaacuaagggacacccaguacaucagccgaaaaucacgggaaauccuccaaaaagugugcaacaacguagcaaccaccgaaggcggcgugacagcaaaacugagaaaccuauggggcugggacgacgugcuaaugaaccuccagaugccgaaauacaaagaacucgggcagaccgucgucaaagaguggacgucagagcacggcaagcgcaaacaccaaaaagaagaaauagagaacuggacaaaacgagacgaccaccgccaccacgccaucgacgcccuuguaguggcuugcacuaaacaaggauucauccaacgcaucaacacccugaacuccuccgagaccaaagaccuuaugcagcaagagauaaaagaagcaaagaaacuacuaggagagaacuacaaugaaaaggaguucgaaaacaacaacgaaagcguaaagaaucauaaagaacgauuaucacaacuagaugacuaccuccgacuccagaagcccgucaaauucgacacgaaauacgucgaacaagaggcugauaagguucuagugucauucaagagcggcaagaaagucgcaaccauaacaaaauucaaagccacggggaaaaacaaagacaccggcgucaucgucccccguggcgcacuccacgaacagaacguauacgggaagauaaagguaaucgaaaaagauaaaucauuaaaauaccuauucgagaacagcgagaaaaucguaaaccccaaaauuaaaaacauagucgaaaucauccuaagcgaaaacgagaauaacagcaagauggcgcuaucaacauuaaagaagaaccccaucuuccuaaaugaagagaaaaccgaccuacuggagaaggcaagcugcuacgaauacguaaccguacgcaaauacccucucaacaccaucaaagcgucgcaagcggaugacaucguugacgaacgagucaaauuccuggucaaagagcggcugacacaauucggaaacaaagaaaaagaggcuuucaaagacacccuaugguucaacgaagaaaaacaaaucccgauaaucacaguccgucucuucgcacggccagacgcgaacaaccuccaagcaauaaagaaagacgaaagcggaaaagagauaggguucguagucaugggcaacaaccaccacaucgcgauuuacgaggacaaagacggaaaacucgugcagcauucaugcacguucuggcacgcagucgagcgcaagaaguacaacauuucuaccguaaucaagaacaguucagacgcauggaaccaguuccuugacaacgaacugccugagccauuucuuaacaaacuccccgcugauaaccugaacuugaaauucagccugcaacaaaacgagauguucauucucggucucagccaagaggaguucgacaaagcccuaaaaagcaacgacaagucucuacugucuaagcaccuguaccucguauggagcaucagcgaaaacaacuacugguuccgccaccaccuagaaaccaaaaacucagaucucaagaaaacgaacggcgucaaagaaucaaaacggcucuauaacauacgaagccucggaagccucuucucgcugaaucccaucaaaauacgacugaaccaccugggggagauaaccaaaauuggcgaauacucauga

SEQ ID NO: 6399 - RNA, 3867 nt, Artificial Sequence
  Cas9 variant
augaggcuauucgaagaaggccauacagccgaagacaggcggcucaaaaggacagcccgccgccgcauaagccguagacgcaaccgccuucgcuaccuccaagccuucuucgaggaagcuaugaccgaccucgaugagaacuucuucgcgcggcuacaggagucauuccuaguccccgaagacaagaaauggcaccgacacccaaucuucgccaaacuagaagacgaaguugccuaccacgaaacguacccaaccaucuaccaccuccguaaaaagcucgcggacuccagugaacaggccgaccuacgcuuaauauaucuggcccucgcacacaucgucaaauaccgcggucacuuccuaauagaaggaaaacucagcaccgaaaacacgucagucaaagaccaguuucaacaauuuauggugaucuauaaccaaaccuucgugaacggcgagagccgacucguaagugcgccacuaccagaauccguacucaucgaggaagaacuaaccgagaaggcaagccggacgaagaaguccgaaaaaguccuucagcaauucccccaagaaaaggccaauggucucuucggccaguuccuaaaacucauggucgggaacaaagcagacuucaagaaagucuuuggccucgaagaagaggccaaaaucaccuacgccagcgaaagcuaugaagaggaccucgaaggaauccuagccaaagucggagaugaauacuccgacguauuccucgcggcaaagaacguguacgaugcaguggaacuauccaccauacuugcagacucggacaagaaaucacacgccaaacugagcuccuccaugauaguucgcuucaccgagcaccaagaagacuugaagaaauucaaacgauucaucagggaaaacugccccgaugaauacgacaaccucuucaaaaacgaacagaaagacggcuacgcuggcuacauagcccacgccggaaaaguaagccagcuaaaauuuuaccaauacgucaagaaaaucauccaagacaucgcuggugccgaauacuuccuagagaaaaucgcccaagaaaacuuccuccggaaacagcgcaccuucgacaacggcguaaucccacaccaaauacaucuagccgaacuccaagccauaauccaccgccaagcugccuacuaccccuuccuaaaagaaaaucaagaaaagaucgaacagcugguuaccuuccggaucccauacuacgucggaccucugagcaaaggcgacgccucaaccuucgccuggcucaagagacaaagcgaggaacccauacgccccuggaaucugcaagaaacagucgaccuagaccagagcgccacugccuucaucgagaggaugaccaacuucgacaccuaccuaccgucagaaaaagugcucccaaaacacucgcuccuauaugaaaaauuuaugguauucaacgagcucaccaaaaucuccuacaccgacgaccgagggaucaaggccaacuucagcggaaaagagaaagagaaaaucuucgauuaccucuucaagacccgacgaaaggucaaaaagaaagacauaauacaguucuaccggaacgaauauaauaccgaaaucgucacacuaucaggacucgaagaagaccaauucaacgccucuuucucaacguaccaagaccucuuaaagugcggacuaaccagagccgaacucgaucacccagacaacgcagaaaaacuagaggacaucaucaaaaucuugacaauauucgaagaccgccaaaggauccgaacccaacucagcacguucaaaggacaauucagcgccgaagugcucaagaaacuggaacgaaaacacuacacgggauggggccgcuuauccaagaaacucauaaacgggaucuacgacaaagaaagcggcaagaccauccucgauuaccucgucaaagacgacggcgucucaaaacacuacaaccggaacuuuaugcaacuaauuaacgacucccagcucagcuucaagaacgcuauccagaaagcgcaaucgucagaacacgaagaaacacuaucggaaaccguaaacgagcucgcagggucccccgcaaucaaaaagggaauauaccagagccuuaaaauagucgacgagcuagucgccaucaugggcuacgcacccaagcgaauagucguagaaauggcacgcgaaaaccagaccacaagcaccggaaaacgucgcagcauacaacgccuaaagaucguggaaaaggcgauggcagaaaucggcagcaaccugcucaaagaacaaccaaccacaaaugaacagcucagagacacgcgccucuuccucuacuauaugcaaaacgguaaagacauguacaccggcgacgaacucucccuccaccgccucucacauuacgacauagaccacauuaucccccaguccuucaugaaggacgacucccuagacaaucuuguccucgucggcagcacugaaaaccggggaaagagcgacgacgugccguccaaggagguugucaaagauaugaaagcauacugggagaaacuauacgcagccggucucaucucacaaaggaaauuucaacgauugaccaagggcgaacaaggaggacugaccuuagaagacaaggcgcacuucauacagcgacagcuaguagaaacacgucaaaucacgaaaaacguagcugggauccuagaccaacgcuacaaugcaaaauccaaagagaagaaaguacaaauaauaacacucaaagccagccucacaucccaguuccguagcaucuucggacucuacaaagugcgcgaggucaacgauuaucaccacggccaagacgcauaccucaacugcgucguggcaacaacgcuacuaaaagucuaccccaaccucgcgccugaguucguguacggcgaauacccgaaauuccaaaccuucaaagaaaacaaagcuacugcgaaagcaauuaucuacaccaacuuacuccgcuucuucacggaagacgaaccgcgguucacuaaggacggagagauucuauggagcaauagcuaccuuaagaccaucaagaaagagcucaacuaccaccaaaugaacauagucaagaaaguagaaguacaaaaaggaggguucagcaaagagagcaucaaaccaaagggacccagcaauaaauuaaucccugucaaaaacggccucgacccacagaaauaugggggauucgacagcccaguaguggccuacacaguccuauucacacacgaaaagggcaaaaagccccucaucaaacaagagauacugggaaucaccauaauggaaaagacacgauucgagcaaaaccccauucucuuccucgaagaaaaaggcuuccuacggccucgaguccucaugaaacuaccgaaguauaccuuguaugaguucccugaaggcagacgacgacuacuagccucagccaaggaggcacaaaaagggaaccagaugguucuccccgaacaccuacuuacccuacuauaccacgccaaacaaugccuccucccgaaccaauccgaaucccuagccuacgucgaacagcaccagccagaguuccaggaaauccucgaacgcgugguugacuucgcggaagugcacacccucgcgaaaaguaagguacagcagaucgucaaacuauucgaagcaaaucagaccgcugacgucaaagagaucgccgccagcuucauccagcucaugcaauucaacgccaugggagccccaucuaccuucaaguuuuuccaaaaggacauugaacgcgcacgauauaccuccaucaaggagauauucgaugcaaccaucaucuaucagagcccgaccggccuguacgaaacccgccgaaaggugguugauuga

SEQ ID NO: 6400 - RNA, 3903 nt, Artificial Sequence
  Cas9 variant
auguggggagucagccuauucgaagccgggaaaaccgccgcagaacgcagaggcuacagaagcacccgacgccgccucaaccaccggaaguuucguuuacgccuccucgaggauauguucgagaaagagauacuauccaaggaccccuccuucuucauccgacuaaaagaagccuuccugucaccaaaggacgaacagaagcaauucaaagggaacauccucuucaacgauaaagacuauaccgacgcagacuacuaugaacaguacaaaacgauuuaccaucugcgcuacgaccucaucucucaacaccgccaguucgacauacgcgaagucuacuuagccauacaccaccucaucaaauaccgaggccacuucaucuacgaagaccaaacauuuaccacagacggaaaccaauuacaacaucacauaaaagccauuauaacaaugaucaacuccacucuuaaccgaauaaucauaccagagaccaucgauaucaacguuuucgagaaaauacuccucgaccggaugaugaaccgcuccagcaaagucaaguuccucaucgaacuaaccggcgaagacaaacaagacaaaccccuacucaaagaacuauuuaaccuaaucguaggauuaaaagccaaaccagcauccauauucgaacaagagaaccuagccacuaucgucgaaacgaugaacaugagcacagagcaaguucaacucgaccuacugacacuagccgauguccucgccgacgaagaauacgauuuacuauuaacagcccagaaaaucuacagcgccaucauacucgacgaaagcauggacggcuacgaauacuucgccgaagcgaagaaagaaagcuaccgcaagcaccaagaggaacucguccuagucaagaaaaugcugaaguccaacgccaucaccaacgaugaaagagcaaaauuugaguauuuuuacacagacuacauaggcgcaaagucauccaacuaugaagaaagcaaaaacauuaagaaaggacucucagcagccuacggcaaauacucaaaagaagaacgccuguucaaacacaucgagcuacuuuuggccaaagagaacguccucacaaccguagaacacgcccuucuugaaaagaacaucaccuucgcuucgcuccucccauuacaacguucgucccgaaacgccguuauacccuaccaaguacacgaaaaagagcuagucgccauccuggaaaaccaggcuacguacuaccccuuccuacuagaacaaaaagauaacauccacaaacuacucacauuucgcauaccuuacuacgucggaccacuagccgaccaaaaagacucugaauuugccuggaugguacguaaacaggccgggaaaaucacgccuuucaacuucgaagaaaugguugacaucgacgcaagcucagaagccuucaucaagcgaaugacuaacaagugcaccuaccuaauccacgaagacgucauaccgaagcacuccuucuccuaugccaaauucgaaguacuaaacgagcucaacaaaauccgacucgacggcaaacccauagacauaccacucaagaaacgcaucuucgaaggccuauuucucgagaaaacgaaagugacgcagaccagccuuaagaaauggcuagccgaacacgagcacaugacagugagcguagugcaaggaacgcaaaaagaaaccgaauuugccacgucacuccaggccuuccaccgcuucguaaaaaucuucgaccgagaaaccguaucuaaccccgccaacgaagaaauguucgagaaaaucaucuauuggagcaccgucuucgaagacaagaaaauaaugagacggaaauuaucugaguacccucagcucacagaacaacaacaagugcagcucgcccagguaagauucaggggcuggggccgccuaucgcaaagacuuauaaacagaaucaagacgcccgucucaggcgacgaagaccacaaacuguccaucaacgagauccuauggcagacaaacgaaaacuucaugcagaucauaaggaacaaagacuaccucuucaagaaaauuaucgaagaacaguucgagaacgaaacugcccuucuaaauaaacaacggaucgacgaacucgcugcuagcccggccaauaagaaaggcauauggcaggccauaaagaucgugaaggaacucgaaaaaguccuccaacaaccagcagagaacaucuucauugaguucgcgcgaucagacgaggaguccaaacgcuccacgccacgcgauaaauucauagagaaagcguacgcccagcucaaaaaggagaccgacacguucaaccucgaacacuuaaaagaacugaagcaacguagcaaacagcuaucaucccaacgccucuuccuauauuucauucaaaacgggaaaugcauguacagcggagaacaccuagacauagaacgccuagacucauacgaaguugaccauauccucccccaaagcuacaucaaggacaacagcauugaaaaccuagcacuggucaagaaagucgaaaaccaaagaaagaaagacagucuucuacuaaacagcagcaucauaaaccaaaacuauucccgcugggagcagcucaaaaacgccggccuaaucggcgaaaagaaauucagaaaccuaacccgaacuaaaauaaccgaccgagacaaagaaggauucaucgccagacaacuggucgaaacucgccaaauuacgaaacacgucacccagcuucuccagcaagaauacaaggauacaaccaaaguauucgcaaucaaggccacccucguuuccggccuccgucgaaaauucgaguucaucaaaaaucgcaacgucaacgacuaccaccacgcccaggacgccuuucucgucgcauuccucgggaccaauaucaccuccaacuacccaaaaauagaaauggaguaccucuucaaaggauaccagcacuaccucaacgagguaggcaagucggcugcaaaacccaaauucacauuuaucguagagaaccuaagcaaacaacaguacaacagcaccaccggugaagugaaauggaaccccgaagucgauaucgccaaacucaagcgaauccucaacuucaaacaaugcaacaucguucggaagguggaggagcagucaggugcccuauucaaagagacgaucuacccaguagaagaauccuccucaaaaaccauaccauuaaagaaacaccuagacacagccaucuacgggggcuauaccgcgguaaacuacgcaucguacgcccuuauacaauuuaagaaaggccgcaaacuaaagcgagagaucauuggaauaccccucgcgguccagacacguauagacaacucagaaacaagccuacaagcauauaucgccgaacaaauaaaauccgaagucgaaauccucaacggccgcauacucaaauaccaacuaauuucaaacaacggaaacaggcuguacaucgcuggccccuccgaacgacacaacgcacgccagcuuauaguuucggacgaagcugccaaggucauauggcugauaucgacaaagcaagcggacgaggcgauguuccuaaaguauuaccgacucgaacacuuagaagcagucuucgaagaacuaauccguaaacaagccgccgacuaccaaauauucgagaaacugaucaagaaaaucgaaguuaauaaagucuacuucuacucauguacauacaacgaaaaagucaaggucauagaggaacugcucaaaaucacacaagccaacgcaacuaacggcgaccuuaaacuacuuaaaaugagcaacagagagggccgccucggauccguaagugucgcgcucgacuuuaaaaucaucaaccagucagucacgggccucuaccaauccaucgaagacuacaauaacuga

SEQ ID NO: 6401 - RNA, 3930 nt, Artificial Sequence
  Cas9 variant
auggggagcgucggcuucgccgggaucgauaaccaauacaaccuaguccggacaaaggggaaaaacgucaucggcguaaggcucuuugacgaagcggacagcgcagccgaacgacgaggucaccgcaccaacagacgaagacuucaacguagacgcuggcgcuugcgccuacuagacgacauuuucgccaagccccuccaagcagucgauccgaacuuccuagccaggcugaaguacagcuacgucaacaagaaagaccagggccagcaggaccacuacuacggcggcuacgucuuuggaucuaccgcagcggaccaagcauaccaccaagccuauccgaccaucuaccaccuccgaaaacgacugauggaagacgaccagaaacacgacuuacgcgaaguguaccucgcuauacaucacaucgucaaguauagaggcaacuuccucaacccccaguccagccucgacaucgaucaacaauucgacguaacagacuucgcccaagcacuagcacgcuucgcggaccaccaagcacuaagcugggcucucgaagcacccauccgauuucucgaggcagaacuggcuaccggacuuagcaauagcgcccggguggacgcugcaauugaagcauucucguuugacacuaaaguagaccgcgcagcgaucaaggaaaugcuaaagggccuaagcggaaaccaaauagacuuuacuaagcucuuugucaacgucgacagugccgacugggaccaggaggagcgcaaacaauggaagaugaagcucagcgaagaagauuucgacgaacaggcucuacccauccuagaacgccugagucaagacgaaacagaguucuuccucgcaaucaagcgcgcauaugacggaaucgcccugaugcguuuccugggagacgaacaaagccuguccuccgccaugauaaaagccuaugaagaccacagacgggaccuuacuuuccuuaagacacaaguccggacaccccaaaaucgacaagcccuaagcgaaggcuauaccaacuaccucagcguagacgacaagaaacacaaacgcggcgcaaaagaacucgcucaacuaauagaagccagugacgccucagaacaggacaaagcaaccauguuagaccgcaucgccaacgaucaguucgcacccaaacagcgaaccaaggcaaacggucucaucccuuaccaacuucaccucgcugaacucaagaaaauucucgcaaaacaaggacaauacuacccauuccuccuggacaccuuugccaagcaaggucaauccgucaacaaaauagaggagcuaguacaguucaggguccccuauuacgugggcccgaugguccccaaaucagaaacggccggcaacgcagaaaaccacuggguagaaaagaacgacggacagaccaaaguaucugugacacccuggaacuuugaccaagucuucaaccgcgacagggccgcuaaaucauuuauugaccgucuaacaggaacagacaccuaccucauaggugagcccacccucccccgccacagcuuaacauacgaaaccuucaccgugcucaacgagcuuaacaacauccgcaucgauggcaaaagauugcccguagaaacaaaacaggcgaucguagaagaccucuucaagaaauaccgccuaguaaccaagaaacgacuacaagauuacuucgccagcuucgguaaacgagaagucgaacucacagguuuagcugacgaaagccgcuucacuuccagccucacaucauaccacgaccuacaagggcucuuaggcaccgacuucaucaccaacccucaaaaccacucacuccuagagaaaauaguagaaauccagacagucuucgaagacagugacaucgccgaaagagaacucggcaaacuuggccucgaacaaaaacucaucccccgccucgcaaagaaacacuauacaggguggggcaaccucuccagaaaacuacucgauacuagcuucauccacgaccccgaacgcccagaagaaccggucucuauaauggacuuacucuacaccaccaacaaaaacuucauggaaauacuucacgacagcgaauacggagucgaagaauggcucaaaagccaaaacaugauagacgaccaaaaagauauacagaugagaauagacgaacuaaccaccagccccgcaaacaagaggggaaucaagcaagcauuuaacguccucgaugacaucacgcaagcaaugggcgaagaaccugccuacgucuaccuggaguucgcgcgcgaaaaacaagcgagccgacgcacagugucccgcaagaagcgccucgaaacauuauauaaaaacgcagcacucaaaacggaguucaaagcaauaaaagaagcauuagcggaagaaagcgacgaccgaaugcaagacgaccgcuuauaccuguacuacgcacagcucggucgagacauguacacgggacaguccaucucaaucgaccagcugaguucacacuacgacaucgaucauauugucccccgcgccuucaucaaggacgacagccucgaaaauaaggugcucguaaaccgaacggacaacgcccgaaagaccgacucggccacauucaccgccgacguaaaagccaaagccuucccccucuggcaacagcucaaaaagcuaggacugaucagcgcaaagaaauuccgccuccucacacgaacaggcgauuucaccgaaauggaaagagaacgguucaucgcacgccagcuaguagaaacacgacaaaucaucaagaacguggcagcccucauagaaggccauuucucccagacacaagccgucgccauccgcgccgaaguaaccggcgagcuaagacaacuaacacaaauaaagaaagaccgcgacauaaaugacuaccaccacgcccaagacgcucuccuagucgccacggccggcacauaccuccacagacacuucccaaaaagggacgcccguuucaucuacaacgaguucgacuacuacacccaacauuggcuuaaaaaccaaggagaaaaccggcgccggcaucccuauucguucguggugggaaccaugucaaaaggaaaugaggacuggacgccagacaaccuaaacuaccuacgaaaagucaugcaguacaaaacaaugcucaugacacgcaaaccggucgguccugagggagcacuguacaaagaaacgcuuaucgccgcggaccccaagaaacgccucguaggggccagcaaggaaagacaagacccaacuaucuacggcgguuacacaaaagagucauccgccuacaugagcuuaguccgagcaggcgggaaaaaccaacuggugaaaaucccggucagaaucgccaacgaaauacacagcggucaacgcaaacucgaugauuacguccaagccaaaguaaagaaguucgaacggauccuccuccccaaaauaucgcucggacaacugguagaagacgaaggccaacgauucuaccucgcaaccaacgaaaugaaacacaacgcgaaacaacucuggcucgaccagaaaguaguaacgacauacaagagacucacagcagagucuccagucgaagacuuccuuacgguauucgacgcccuaaccagcuccgcaacgauacaccacuucaaauucuaccaacgcgaucucgaacuuuuaagagacaacagagccggauuccaagacuuggcuaaggccacccaacuuaaaguccuaaaagaugugcucuacgaacuucacgauaaugccggauggcgcgaccccaucaaacaguauuucaaagaaaucggccuaaaaguccgcauguggaccaaacuacaaaaagaaggugggauaaaacucacugaccaagccgagcucaucuaccaguccccauccggccucuucgagaaaagacggcgagugcaagaccuucucuga

SEQ ID NO: 6402 - RNA, 3939 nt, Artificial Sequence
  Cas9 variant
augcaaaacggauuccugggcauuaccguaucuucagaacaagucggcugggcaguaacaaacccaaaguacgagcuagaacgagccagccggaaggaccuauggggagugcgucucuucgacaaagccgagaccgccgaggaccgccgcauguucaggaccaacagaagacuuaaccaacgcaagaaaaaccgcauacacuaccugcgcgacauuuuccacgaagaggucaaccagaaagacccaaacuucuuccaacagcucgacgaauccaacuucugcgaagacgaucgaaccguagaguucaacuucgacaccaaccucuacaaaaaucaauuuccaacgguauaccacuuacgaaaauaucucauggaaaccaaagacaagccagacauccgccugguauaccuagcauucucgaaguucaugaaaaaucgggggcacuuccucuacaaaggcaacuuaggagagguaauggacuucgagaacucgaugaaaggcuucugcgaaagucuagaaaaauucaacaucgauuuucccacacucucggaugagcaagucaaggaaguccgagacauacugugcgaccacaagauagccaagacaguuaaaaagaaaaacaucauaacaauaacaaaagucaagagcaaaacggccaaagcauggaucggccuauucugcggaugcuccguaccggucaagguccucuuccaagacaucgacgaggagaucgugacggauccagagaaaauauccuucgaggacgcgucauacgacgacuauaucgcaaauauagaaaagggcgucggcaucuacuacgaggcaauagucagcgcaaaaauguuauucgacuggucgauaaugaacgaaauacugggggaucaccaacuacucucagacgcuaugaucgcagaauacaacaagcaccacgaugaccucaaacgccugcaaaagauaauaaagggaaccggcagccgagaacuguaccaagacaucuucaucaacgacgucagcgggaacuacgucugcuacgucggccacgcuaagacaauguccucggccgaccaaaagcaauucuacacauuccucaaaaaccgccuuaaaaaugucaacggcaucucaucagaagacgccgaguggauugacacggaaaucaaaaacgggacccuacuaccaaagcagacaaaaagggacaacagcguaauaccacaccaauuacagcuaagggaguucgaacugauccuagacaacaugcaggaaauguacccauuccucaaagaaaaccgugaaaagcuacucaaaaucuucaacuucguaauucccuacuaugucgggccacucaagggggucguucgcaaaggcgagagcacgaacuggauggucccaaagaaggacggaguuauccaccccuggaacuucgacgagauggucgacaaagaggccagcgccgaaugcuucauaagccgcaugaccgguaacugcuccuaccuguucaaugaaaaaguccugccgaagaacucacuccucuacgaaaccuucgaaguacucaacgaacucaacccccucaagauaaacggcgaaccgauaagcgucgaacuaaagcaacgcauauacgaacaacuauuccuuaccggaaagaaggucaccaagaaaucucuaaccaaguacuuaauuaagaacggauacgacgaggacauagaacuauccggcaucgacaaugaguuccacagcaaccugaaaagccacaucgauuucgaagauuacgacaaccucucggacgaagaaguagaacggauaauuuugagaaucaccgucuucgaggacaagcaacuccugaaagacuaccuaaaccgggaauuuguaaaacuguccgaggacgaacgcaaacaaaucugcucucugucauacaaaggauggggaaaccuaucagaaaugcuccuaaacggaaucacagucaccgacuccaacggcguagagguguccguaauggacaugcucuggaacaccaaucugaaccucaugcaaauauugagcaagaaauacggcuacaaagccgaaauugaacguuacaauaaagagcacgagaaaaauauauauaaccgagaagaccuaauggacuaccucaacauaccaccagcgcaacggcgaaaagucaaccaacuaauaaccauaguuaaaagccucaagaaaagaugcggaguccccaacaagaucuucuucaaaguaucaagagaacaccaggacgacccgaaacgcacuuccuccaggaaagaacagcugaaauaucucuauaagagccucaaaucggaagaugaaaaacaccucaugaaggagcuagacgaacuaaacggacacgaacugagcaacgacaagguguaccucuacuucuugcaaaaaggacgguguaucuacucggguaagaaacucaacuuguccaggcuccgcaaauccaacuaccagaacgacauagauuauaucuacccccuauccgccgucaacgaccgcuccaugaacaauaaaguccugacgggaauccaggagaaucgggccgacaaauacaccuacuucccgguagacccugaaauccagaaaaagaugaaggguuucuggauggagcucguacuucaaggcuucaugucgaaagaaaaauacuuccgucuaagcagagaaaacgacuucagugaaaaugagcuagucucauucaucgagagggagauuucggacaaccaacaguccggccgcaugauagcgucugugcuucaauacuacuuuccagaaucaaaaauaguguucgugaaagaaaagcucaucuccagcuucaagcgggacuuccaccugaucagcucauacggccacaaccaucugcaagcggccaaggacgcauacauaacuaucguuguagguaaugucuaccacaccaaauucaccauggacccagccauauacuucaaaaaccacaaaagaaaagauuacgaccuaaauagacuguuccuagaaaacauuucccgcgacggacaaaucgccugggaaucgggaccguauggaagcauccagacaguaagaaaggaauaugcacagaaucacaucgcggugaccaaacgagucgucgaagucaaaggagggcuauuuaaacaaaugccacuuaagaagggccacggagaauacccgcuaaaaacaaacgacccccgcuucgggaacauagcgcaauacgguggauacacgaacgucaccggaaguuauuucguccuggucgaguccauggaaaaagguaagaaacgcaucucccucgaguacguaccgguauaucugcacgaaagacuggaggacgacccgggacacaaacuacugaaagaguaccucgucgaccaccgaaaacucaaccaccccaaaauucuacucgccaaaguccguaaaaauagccuccuaaagauagacggguucuacuauagacucaacggcagauccggaaacgcacugauccuuacaaacgcggucgagcucaucauggacgacuggcaaacuaaaacagcaaacaagauauccggcuacaugaaaagacgggcuaucgacaagaaggcacgcgucuaccagaacgaguuccacauccaagaacucgaacaacucuacgacuucuaccuggacaaacuagaaaacggagucuacaaaaaucgaaagaacaaucaggccgaacuaauccacaacgagaaggagcaauuuauggagcucaaaacagaggaccaauguguccuccucaccgagaucaagaaacucuuuguuugcucaccgaugcaagcagauuuaacucuuauaggcggaaguaaacacaccggcaugaucgcaaugucuaguaacgugaccaaagccgauuucagcauaaucgccgaagacccccucggccuccgaaacaaagucauauacucacacaugggcgagaaguga

SEQ ID NO: 6403 - RNA, 3939 nt, Artificial Sequence
  Cas9 variant
augcaaaauggcuuucucggcaucaccgucaguucagagcaaguaggcugggcgguaaccaacccgaaauacgaacuagagcgagcgagucgcaaagaucuauggggcgucagacuguuugauaaagcagaaacagcagaagaccgccgcauguuccgcacuaaccggcgccucaaccaacgaaagaaaaaccgaauccacuaccuccgagacaucuuccacgaagaggugaaucaaaaagaccccaacuucuuccagcaacuagacgaaucgaacuucugcgaagacgaccgcacgguagaauuuaacuucgacacaaaucucuacaaaaaucaauuccccacagucuaccaucugcgaaaauaccucauggagaccaaagacaaaccagacaucaggcuagucuaccuugcuuucuccaaauucaugaaaaaccgagggcacuuccuauacaaaggaaacuuaggcgaaguuauggacuucgaaaacaguaugaaagguuucugcgaaagucucgagaaauuuaacauagacuuccccacccuaagcgacgaacagguaaaggaggucagggacauccucugcgaccacaaaaucgcgaagacgguaaagaagaaaaauaucaucacuauaacuaaagucaaauccaaaaccgcaaaagccuggauagggcuauucuguggaugcagcgucccggucaaagucuuguuccaagauauagacgaggaaaucgucaccgaccccgagaaaauaucguucgaagacgcuucauacgacgacuacaucgcaaacaucgagaaaggcgucgguauauacuacgaggccaucguaagcgccaagaugcuauucgacugguccauccuuaacgaaauccugggagaccaccaacugcucuccgacgcgaugaucgccgaguacaacaaacaccacgacgaccucaaacggcuucagaaaauaaucaagggcaccggcucccgcgagcuguaucaagacaucuucaucaacgaugucagcgguaacuacgucugcuacguugggcacgccaaaacaaugucuagcgcagaccaaaagcaguucuacaccuuccuaaagaaccgacucaaaaauguaaacggcaucuccagcgaggacgcagaguggaucgacacagagaucaaaaacggcaccuugcuacccaaacaaaccaaaagagacaacuccguuaucccucaccaacuccaacuacgagaguucgaacugauccuggacaacaugcaagaaauguaccccuuccugaaggaaaaccgcgaaaaacuucucaaaauauucaacuucgucauccccuacuacgugggcccacucaaaggcguaguccgcaaaggcgaaucgacgaauuggaugguccccaagaaggacggcguaauccaccccuggaauuucgaugaaauggucgacaaggaagccuccgcagaaugcuucauuagccgcaugacggguaacuguucauaccuauucaacgaaaaaguucuuccuaaaaacagccuccuauacgagaccuucgagguccucaacgaauugaacccccucaaaauaaacggagaaagcaucuccgucgagcuaaaacaacgcauauacgaacaacuauuccucaccggaaagaaggucacaaagaagucacucacaaaguauuuaaucaaaaauggauacgauaaagauaucgaauuauccgggauugacaacgaguuucacuccaaccuaaaaucccacauagacuucgaagacuaugacaaccuuucugaugaggagguagaacaaauaauccuucgaaucacagucuuugaagacaaacaacugcugaaagacuaccuuaaucgggaguucgucaagcucagcgaagacgagagaaaacaaaucugcagccuaucauacaagggguggggcaaccucucagaaaugcuauuaaacgguaucacaguaacagacucaaauggcgucgaagugucggugauggauauguuauggaacacgaaccuaaaccuaaugcaaauacugagcaagaaauacggcuacaaagccgaaauugaacacuacaacaaggagcacgagaaaaccauuuacaacagggaagaccuaauggacuaucucaauauacccccggcacaacgccgcaaaguaaaccaacuuaucaccaucguuaaaucacucaaaaagacauacggggucccaaacaaaaucuucuucaaggucucgcgcgaacaccaagacgauccaaagaggacaagcucccgcaaggaacagcucaaauaccucuacaaaucacucaaaagcgaagaugaaaagcaucuaaugaaggaauuggacgaacugaacggccacgaacucuccaacgacaaagucuaccucuacuuccuccaaaaaggaaggugcauuuacuccggcaagaaacucaaccucucgcgguuaaggaaaagcaacuaccaaaacgacaucgacuacauauauccccuaucggccgucaacgaccguucuaugaacaacaaagugcugacaggcauccaagagaaucgcgccgauaaauacacauauuucccaguggacccggaaauccagaagaaaaugaaaggcuucuggauggagcuaguccuccaaggguucaugucgaaagagaaauacuuuagacucagccgagaaaacgacuucucggagaacgagcuagugagcuucaucgaacgcgaaaucagcgacaaucagcagagcggccgcaugaucgcuagcguccuccaauauuacuucccggaauccaaaaucguauucgucaaggaaaaacucaucuccucauucaagcgagacuuccaccucaucuccagcuacggacacaaccaccuccaagccgcuaaggacgccuacauaaccauaguuguaggaaaugucuaccaugcaaaauucaccauggaccccgcgauauacuuuaaaaaccauaagcggaaagauuacgaucugaaccgacucuuucucgaaaacaucucccgcgauggacaaauagcuugggaauccggccccuacggcucaauacagacaguaagaaaagaauacgcucaaaaccacaucgccguaaccaagagaguagucgaagucaagggcggauuauucaaacaaaugccacucaaaaagggccauggcgaauacccccucaagacaaacgacccgcgcuucggaaacaucgcacaauacggaggguacaccaacguaaccgguuccuacuucguccuagucgaaucgauggaaaaagggaagaaaagaauuucgcuagaguacguaccagucuaccuucacgagaggcuggaggacgacccaggacacaaacuccucaaagaguaccucguggaccaccgcaaacucaaucaccccaaaauccuauuagccaaaguccguaaaaacucccuccucaaaauagacggcuucuacuaccgccuaaacggucgcuccggcaacgcacucauccucacgaacgcagucgagcucaucauggacgacuggcagacgaaaacagccaacaaaauauccggauacaugaagcggcgggcgaucgauaagaaagcacgcguguaccaaaacgaguuccacauccaagaauuggaacaacucuaugacuucuaucuagacaaacuagaaaacggcguuuacaaaaaccguaaaaacaaccaagcggagcucauccacaaugaaaaagaacaauuuauggagcucaaaaccgaagaccaguguguccuccucaccgaaauuaagaaauuauucgugugcucccccaugcaagccgaccucacccucaucgggggcagcaaacacacaggcaugaucgcuaugaguagcaauguaacaaaggccgacuucgccgucauagccgaggacccccucgggcuccgaaacaaaguuaucuacagccacaugggcgaaaaauga

SEQ ID NO: 6404 - RNA, 3942 nt, Artificial Sequence
  Cas9 variant
augcacuaccuagacgagauauucgcuccccaccuacaagaagucgacgagaacuuccuccgccgccucaagcaauccaacauccaccccgaagacccggcgaaaaaccaagccuucauuggcaagcuauuauucccggauuuacugaagaaaaacgagcgcggcuaucccaccuuaaucaaaaugagagacgaacucccaguugagcaaagggcacacuacccggucaccaacauuuacaaacugcgcgaagccaugauuaaugaagauagacaauucgaucuacgggaagucuaucucgccguacaccacaucaugaaauaccgcggacacuuccucaacaaugccucgguagacaaguucaaggugggacgcaucgacuucuauaagagcuucaacguacucaacgaagccuacgaagaacuacagaacggagaaggaucauucaccaucgagccaagcaaaguugagaaaauagggcaacuacuccuggacaccaaaaugcgaaaacuaaaccgacaaaaagcuguggccaagcugcuggaagucaaaguagcagacaaggaagagaccaagcggaacaaacagaucgcaacggcaaugucaaaacucguucucggguacaaagcagacuuugccacaguagcgauggcaaacggcaacgaauggaaaauagaccucagcucagaaacaucugaagacgaaaucgaaaaauuccgcgaagaacuaucugacgcacagaacgacauacuuaccgaaaucaccagccucuucucccaaaucaugcuaaaugagaucguccccaacggcaugagcauaucugagucgaugauggaucgcuacuggacucacgaacgacaacucgcagaggucaaagaauaccuggcaacgcagcccgccagcgcccgaaaggaguucgaccaaguauacaacaaauacauagggcaagcuccuaaagaacgcggauucgaccuagaaaaaggccuuaagaaaauccucaguaaaaaggaaaacuggaaggagauugacgaacuccucaaagccggggacuuccuacccaaacagcgcacauccgcaaacggcguaaucccacaccaaaugcaucaacaagaacuggaccgaaucauagaaaaacaagcaaaauacuaccccuggcuggcaacagagaaucccgcgacaggcgagcgggaccgucaucaagcgaaguacgagcucgaccaacucgucucauucagaaucccguauuacguagggccccuagucacaccggaaguacaaaaagcuacaucgggagccaaauuugcgugggccaaaagaaaagaagacggagagaucacaccguggaaccucugggauaaaauagacagagcggaaucagccgaagcauucaucaaaagaaugacagucaaagauaccuaccuacugaacgaagacgugcuaccagcaaacucgcuccuauaccaaaaauacaaugugcuuaacgaacuaaacaacgucagaguuaaugggcgacgccucagcgucgggauuaaacaagacauauacacggaacuauucaaaaagaagaaaaccgucaagguaagcgacgucgcaagccucgucauggccaaaaccagaggggucaacaaaccguccgucgaggggcugucagaccccaagaaauuuaacucuaaccuagccaccuacuuagaccucaaaucgaucgucggagacaaaguggacgacaaccgcuaccagacagaccuagaaaauaucauagaguggcgcagcguauucgaagauggcgagaucuucgcugacaaacuaacagagguagaauggcucacggaccaacaacgcagcgcccucgucaaaaagcgguacaagggcuggggccgacucagcaaaaaguuacucaccggcaucgucgacgaaaaugggcaacggauaaucgaucuaauguggaacacagaccaaaacuucaugcaaaucguaaaccaacccguuuucaaagagcagaucgaccaacugaaccaaaaggcaauaaccaacgacggcaugacccuucgggaauggguggaaucagucuuagacggagcauacacaucgccucaaaacaagaaagcaaucuggcaagucguccgagucguugaagacauaguaaaagccguaggcaacgccccaaaaagcauuagcaucgaguucgcaaggaacgaagguaacaaaggagaaaucacccggagccgaagaacacaacuccagaaacucuucgaagaccaagcccacgagcuagucaaggauaccucccucacggaagaacuagaaaaagccccagaccuaucagaccgcuauuaccucuauuucacgcaaggcggcaaagacauguacacaggggacccaaucaacuucgacgaaaucucgaccaaauacgacaucgaccacauucucccgcaguccuucguuaaggaugacucgcucgacaaccggguacuggugucgcgcgccgaaaacaauaaaaagagcgacaggguuccggccaagcucuacgccgccaaaaugaaacccuacuggaaccagcuauuaaaacaaggacuuauuacccaacgcaaauuugaaaaucuaacaauggacguugaccaaaacaucaaguaccgcagccucggauucgucaaacgccagcuaguggaaacccgccaagucaucaagcucaccgcgaauauauuagggagcauguaccaggaagcuggcacagacauaaucgaaacacgcgcaggccucaccaagcagcuaagagaggaguucgaccucccaaaaguacgggaagucaacgacuaucaucacgcagucgacgccuaccucacuaccuucgccggccaauaccuaaaccgccguuauccaaaacucagguccuucuucgucuacggcgaauacaugaaauucaaacauggcucugaucucaaacuacgcaacuucaacuucuuccaugaacucauggaaggagauaaaagccaaggaaaagucguagaccaacagacgggcgaacuaaucacgaccagagacgaaguagcaaaaucauucgaccgccuacucaacaugaaauauaugcucgucucuaaagaaguccaugacagauccgaccagcucuacggcgccaccauugucaccgcgaaagaaagcggcaaacuaacuuccccaaucgaaauaaagaagaaaagaccaguagaccuauacggcgcauacacaaacggcacuucagcguuuaugaccaucauaaaauuuaccggaaacaaaccaaaauacaaagucaucggcguaccaacaaccagcgccgucgggcuaaaaagaguagguaagccgggaagcgaauccuacaaccaagaacuccaccgcauaauuaaguccaacccaaagguuaagaaagacuucgagaucguagucccucacgucucguacucccaauuaauuguagacgaugacugcaaauuuacacucgcauccgacacguaccaacaccccgcaacucaacucguucucuccaaagaaucgauggaaaucauugccgacgacuuuaaauucguaaaagaaaacacagcgaccgccgaugagcaacucguccgcguuuucgaugaaauugucaaccagaugaaccacuacuucaccauauucgaccaaagauccaaucgacaaaaagucaccaaagccagggauaaauucgugucccuccccaccgaauccgaauacgaaggagccaaaaagacacaagugggcaaaacagaggucauaacgaaccuccucaugggacuccacgcaaacagcgcacaaggagaccuaaagguccuggggcuaucaacguucggauucuuccaguccagcggcgggcugaaccucagcgaagacgcaaugaucguauaccaaagccccacaggacuauucgagcgccgaaucugccuaaaggacauauga

SEQ ID NO: 6405 - RNA, 3942 nt, Artificial Sequence
  Cas9 variant
augagcuucaaagaaaacucgaaaaucuacuacggacucgacaucggcacugacucagucggauggucgaccacuaacgaaaaauacgagcuccuacgauacaaaaacaaccuaauguggggaguaucccucuucgaggccgcgagcuuggcagaggaacgacgcggccaccggacccaacggcgccgguacgaccgccgccaacagagggucgcacuccuaggcgaacucuucgccaaagagauccugaagacagacccugacuucuuccuucgacucaaagaaucgagccucuauccagaagaccguaccaguaaaaacgugaacacauacuucgacgacgcagacuucaaagacucugacuacuucaaaauguacccuacgguacaccaccucauaaaagaacucagcgaauccaacaagccacacgacguuaggcucgucuaccuagccugugccuuuaucgucgcacaccgaggccacuuucuuaacggcgcggaugaaaacaacguccaggcaguccuagacuucgacagcuccuauugcgaguucaccgacugguucaagucuaacgacauagaagacaaccccuucuccgaguccgucaaaaacgaguucagcgugauccuuagaaagaaaaucggcaucaccgcgaaagagcgcgaaauuaaaaaccuucuauucggaacaacaaaaacuccggauuguuacaaggacgaggaauacccaauagacaucgacgugcugaucaaauuuauaucagguggcaagacaaaccucgcgaaacuguuccgcaaccccucguacgaugaacucgacauccaaaccgucgaagucggaaaagccgacuucgccgacacaauagaccugcuagccagcuccauggaggacaccgacgucccccuccugagcgcggucaaggcgauguacgacuggagccugcucaucgacgugcuaaaaggacagaagaccaucuccgacgcuaaggucugcgaguacgagcaacacaaaucagaccuuaaggcguuaaaauacaucguccgcaaauaccuggaucgcgcucaauaugacgagauauuccgcaccgccggggagaaaccgaacuacguaucauacucauacaauguaaccgacguaaagcucaaacagcugcccagcaacuuuaaaaagaaaaacagugaagaguucugcaaauacauuaaaaguaaacucgaaaagauaaagcccgaaucagacgaugaagccguauacaacgagcugaucgaaaaauguaauucgaagacccuaugcccaaaacagguaaccgacgaaaaccgcgucauaccuuaucaacuauacuaccacgaacugucaaugauccucgacaaggcauccgcauaccuugacuuccucaacaaaacugaagacgggaucucgguaaaacagaaaauacugacgcucaugaaguucagaauccccuacuucgugggcccauuaguuaagcgcaacgaaaccgauaacguguggauagugcgcaaagccgagggccggaucuacccauggaacuucgagaacauggucgacuucgacaaaucggaagacggauucauaagacggaugaccugcaaaugcaccuacuuggcgggcgaagacguccuccccaaguacucucugcucuacucaaaauacaccguccucaacgaaauaaacaacaucaaagucaacggcgagaaaaucuccccggaacugaagcaagacaucuucaacgaacucuucaugaagacauccaggguaacagucaagaaaaucacagaacuacucaagaggaaaggagcguuuagcgaggaaaaaggggacucacucagcggaguagacauaaacaucaagucgagccucaaaaguuaucucgacuucagaagacugcuggaaaacggaagucuaagcgaaaacgacguagaacgcauaaucgaacgcaucacagugacaaccgacaagccaaggcucguauccuggcucaaggccgaguacagcgaccuacccgcugaggacaucagauacauaucacggcuaucguacaaagacuacgggcgacugucagccaaacugcuaacgggaugcuacgaacucgacacaaauaccggcgagauaggcggcagauccaucauagacuucaugugggccgaaaauauaaaucuaaugcaaauccuguccgacucauacgguuacaagagcuucauagaggaagagaacaagaaauacuacaugauaaaccccaccggaucgaucgcgcaaacacucagagaaauguacguguccccgagcguaagccgagcgaucauccgaaccauggaaaucgucaaagaacuuagaaaaaucacgaagaaagacccagacaaaaucuucgucgaaauggcucgcggaggcaaacccgaagaaaaaggaaaacggaccagcagccgccgggagcagaucgaaaaauuguacgacucagcgaaagccuucguaucagacgaagacauaucgcauaugcgaagccaacuaggcucccugagcgacgagcaacuacgccgagaaaaauacuaccucuauuucauacaguucggcaaaugcauguauucaggcgaagcgaucgacuucucccgucuaggcgacaaccacugcuacgacauugaccacaucuucccacaauccaaaauaaacgaugauagucuccauaacaagguccucguaaaaucgcagcuaaacggagagaaauccgacgacuaucccaucaaagccgagauaaggaacaagaugcauccccuguggaaaaaccucuucuacagagaccccaaaaaccccgcagacaaggucaaguacgagagauuaacccgaagcacccccuuuacggaagacgagcuggccggcuuuauagaacgacagcuaguagagacgcgccaaucgacaaaagccguggcgacccuccucaaggagauguucccggacucaaaaauaguauacgugaaagcaggucaagucuccgaguuccgacacgacuuugacaugcucaaaugccgcgaaauaaacgaucuucaccacgcgaaagacgcauauuuaaacauagugaucggcaacguacacgacgucaaauucacgaguaaccccaugaauuuugucaagaacgcggacaagcacuauaccaucaagguaaaggaaacccucaaacacaaagugagccgcaacggugaaacagccuggaacccagaaaccgacuucgacacgguaaagcgaaugaugaguaagaacagcgugcgcuacgugcgauacugcuacaaaaggaaaggcggauucuucaaccaaaacccagaccgcgcgggcaaccccgaccucgcgcgacucaaaaaggaccucgacccagugaaguacggcggauacaacagcaagucaaucuccuguuucaguuugauuaaaugcaccggcgucggagcaguaaucaucccagucgaacuccuuugcgagaaaagauacuucucagacgauucguuugccucggaauaugcauacucuguauugaaaaacgcgcuuccagccaagaacaucgccaagaucagcauagacgacaucagcuucccccugaaaagacgcccaauaaaaaucaacacccuauucgaguucgacggauacagggucaacauacgcaguaaagacuccuaucacuacuucacgauuucaagugccauggcagcaauauacagcaaagacaccagugacuacaucaaggcggucaguucauacauagacaaaagcgacaagggcagcaaauucaagcccggagaagcauucgacgugcuuucgaaccuaaaagucuacgacgaaauagccaagaaaugcaucuccgaaccauuuuccaaaauuucaaaacuagcugaggcuggaaaacgguggaagaaagaagaaaucagccuacaaaacugccuacucuga

SEQ ID NO: 6406 - RNA, 3945 nt, Artificial Sequence
  Cas9 variant
augcucaaaaaggauuacagcaucggccucgacaucggcacaaauucuguaggccaugcaguagugacagacgacuacaaagucccgaccaagaaaaugaaagucuucggcgauacguccaagaaaaccauaaagaaaaacaugcucggcguccuacuguuuaacgaaggccaaacagcagcugacacacgacuaaaaaggggagcaaggcgcagauacacccgacggaaaaaccgacugagauaccuccaggagauauucgccccagcacuggcgaaaguagacccgaacuucuuuuaccgacucgaagaguccucgcuaguggcugaagacaagaaauacgacguuuaccccaucuucgguaaacgagaggaagaacuacuauaccacgauacccacaaaacaauauaccaccuccgaucagagcucgcaaacaacgaccgaccagcugaucuacgacucguauaccuagcccucgcucacaucaucaaauaccgcggcaacuuccuccucgagggagaaaucgaccugcgcacaacagacauaaacaaaguauucgcagaguucagcgagacucuaaaugaaaacuccgacgaaaaccuaggaaaacuggacgucgccgauaucuucaaagacaacacauucucgaaaaccaagaaaucagaagaacugcuuaaacuuucgggggccaagaaaaaccagcuggcucaccaacucuucaaaaugaugguaggaaauaugggcagcuucaagaaaguccucggcaccgacgaggaacacaaacucuccuucggaaaagacaccuacgaagaugaccuaaacgaucugcuugccgaagcuggagaucaauaccuagacaucuucgucgcugcuaagaaagucuacgacgccgccauacuugccuccauccuggacguaaaagacacgcagaccaaaacagucuuuagccaagccaugauagaacgcuacgaggagcaccaaaaagacuugauagaacuaaaacgcguauucaaaaaguaccugccugaaaaaugccaugacuucuucagcgaacccaaaaucaguggauaugcgggauacauugauggcaaagugucggaggaagacuuuuacaaauacaccaagaaaacccucaagggaaucccggaaacagaagagauccuccagaaaauagacgcgaauaacuaccuccggaaacaacguaccuucgacaacggagcaaucccucaccaaguccaucugaaagaacucguggcaaucgucgagaaccaagguaaguauuaccccuuucugcgagaaaacaaagacaaguucgagaaaauccuaaacuuccgcauucccuauuacgucggcccacuagcaagaggaaauucaaaguuugccuggcucacccgggccggggaaggcaaaaucacccccuacaacuucgacgaaaugaucgacaaagaaaccuccgcggaagacuucauaaaacgaaugaccaucaacgaccuauaccugcccacagagcccguacugcccaaacacucgcucuuguacgagcgguauaccaucuucaacgagcucgccggcguccgguacgucaccgagaacggagaggcaaaauacuucgacgcccagaccaaacgcagcauauucgaacuguucaaacuagaccgaaaggucagcgagaagauggugauuaagcaccucaaaguaguaaugcccgcgaucaggauccaggccuuaaaaggcuuggauaacggcaaauucaacgcgagcuacggcaccuauaaggaccugguggacaugggagucgcccccgaacuacuaaacgacgaagugaacucggagaagugggaagauaucauaaaaacccucacgaucuucgaaggaagaaaacuuaucaagagacggcucgagaacuaccgagauuuccuaggagaagacauccuacgcaagcuaucgcgcaagaaauacacaggcugggggcgccuaagcgcaaaacugcuggacggcaucuacgacaagaaaacgcacaaaaccauacuagacugccucaugacggaagacuacucccaaaacuucaugcaacugaucaaugacgacacauacagcuuuaaagagaccaucaaaaaugcucaggucauugagaaggaagaaacgcuagcaaaaacuguccaggaacugcccggcagccccgccaucaagaaaggcauucugcaaucucuggagauaguggacgaaauaaucaaagucaugggcuauaaacccaaaagcauagucguagaaauggcacgggagacacagaaaacccacgguacacgaaaaagggaggaccgcguccaacagauagugaagaaccucaaagacgccaacgaacucccgaaaaagcugcccucaaacgcagaacucuccgacgagcgcaaauaccucuauugccuccaaaauggcagggacauguacaccggcgcaccacuugacuacgaccaucugcaguucuaugauguagaccacaucauaccccagaguuuccucaaggacgacagcaucgaaaacaagguucuuacaaucaaaaaggaaaacguaagaaaaaccaacggccuccccucagaagcagucauacaaaagaugggcuccuucuggaagaaacuccuagacgccggcgccaugacuaacaagaaauacgacaaccugcgacgcaaccugcauggcggccuaaacgaaaaacuaaaagaacgcuucauagaaaggcagcuagucgagacccgccaaauaaccaaauacguagcacaacuacuggaccaaaggcugaauuacgacggcaacggaguagaacuagacgagaaaaucgccauaguaacccugaaagcccaacuagcaucgcaguuccgaagcgaguucaaacugcgcaaaguacgcgcacuaaauaacuuacaccaugcccacgacgcuuaccugaacgcagucguggccaaccuaauaauggccaaguacccugaacucgaacccgaguucgucuauggaaaauaccgcaagaccaaauucaaaggacugggcaaagcaacagcaaagaacacacuauaugccaacguccuguacuuccucaaagaaaacgaaguguaccccuucugggacaaagcucgggauuuaccaacuauaaagcgauaccucuaccgcgcucaggucaauaagguccguaaggcagaacgacaaacgggaggcuucucggacgaaaugcuagucccuaaauccgacuccggcaagcuccuaccacguaaagaaggccuagacccaguaaaauacggcggguacgcaaaagccgucgaaucauacgccguccucaucacagccgacgaagucaaaaaggggaaaacuaagaaaguaaaaacccuggucaacauccccaucauugacagcaagaaauacgaagccgacccaaccgcauaccuagccagcaggggcuacacaaacguuacuaacuccuucauccuuccaaaauacagccuccuagaagauccggagggccgcagacgguaccuagccucauucaaagaguuccagaaagcuaacgaacugauccucccccagcaccucguagaacugcuauacuggguaaacgcgaaagacggggaacaaaagcuagaagaccacaaggccgaguucaaggaacuuuucgacaagauuauggaguucgccgacaaauacgucgucgcccccaagaacagugagaaaaucagacgacuauacgaagaaaaccaagacgcgacccccauggaauuaggcaaaaacuucgucgaacugcugcguuacaccgcugacggggcugcauccgacuucaaauucuucggcgaaaauaucccccgaaagagguacaacucagcaggaucgcuacuaaacggaacacucaucuaccagaguaaaaccgggcuguacgaaacaagaauagaccucgggaagcucuga

SEQ ID NO: 6407 - RNA, 3948 nt, Artificial Sequence
  Cas9 variant
augggauauuccgucggacuggacaucgguaccgguucugucggcugggucguaacaaacgaagauggaaaauuagccagagcaaaggggaaaaacuuaauaggaguccgccuguucaagacggcggaacccgcagcugaucgccguacaaacagaacgacaagacgacgccugagccggagaaaguggcgucuccgccugcucgacgaacuauucgcaaacgagcuagguaagauagacagcaacuuccuuacccgccucaaauacuccuauguacaccccaaagacgacgccaacagggcgaacuauuacggcgguuaccucuuuccaacccaagaagagacaaagaaauuucacgccaaguaucccacuaucuaccaccuccgucuggcauugaugacagagucccggcaguucgaccuccgagaaauauaccucgcaaugcaccagaucgugaaauaccgcggacacuuccugaacucccaguccaaaaugaccaucggaaacacguauaacccgcaagaccugcaaacggcaauggagaacuacgccgaggcgaaaggacuaagcaucgaacuaaaacaacccgaagagauggucgcaauccucacuggcgaagcuggcuucggccucaguaaaaaggcgaaggccgaaaaacuccucaacaacuucuucuucgacacgaaagaagaaaaagcaacgguacaagcgauccucgccggcauugucggcaacacaaucgacuucacaaaagucuucaaccgccaacuaacaggcgacacccuaaaagcauggaagcuaaaauuagacagcgaaaccuucgauguagauuccgaacccauccugucagacuuagacgacgacgaaacggaacucuucuucgcaauacgccaggccuucgauggguucacgcuaaugaaccuccucggagaccaaaccucgaucuccgccgccaugguugaacgguacacacaacaccacgacgaccuucucaccgucaaacaagucgcaaagaaacaaggacucucucacaaagaguucuccaacaucuacuccgcguuccucaaagacgacaccgacaagggaaugaagaaacuccuagaagaauccaaccucagcaccgaagacgucaacggaauacaacuccggauggacucccacgauuuucucccucagcaaagaacaaaagccaacagugucauaccacaccaauugcaccuagccgaacucgaggcaauaauagaaaaccagggacaauacuaccccuuuuuguuagagacguucgaaaaagaagggaccgcugccaacaaaauugcugaacuacucaaauuccgcauaccguacuacguuggcccaaugguaaccaagaaagacguagaaaacgcaggaggagaugccaccaaucacuggguuacccggaacgagggcuacgaaaagagcgccguaacagcauggaacuucgaccaagucuucaaccgcgaccaagcggcgcuugacuucauccaacgucuuaccggaacagacaccuaccucauaggcgagccaacccucccacaaaacucgcucaaguaccaaauguucacaguccugaacgaacuaaacaacguaaaagucaacggccgacgcaucgacaaccagaccaaacacgaccuaauccaagaccuauucaaauccaagaagacugugucacuaaaagcguuccaggacuacuaccaaucccaggguaaaagcgacauccaaguaguagggcuagccgacaagacgaaguucaacagcaaccuguccacauacauugaccuaucgaaaacguucuccgccgaagaaauggagaacccccaaaaccaagaccuccucgaacaaauaguugaaauacagacuguauucgaagacuccaaaaucgcggaaagggaacugucuaaacuggaacugacaccagaacaaguaacuaagcuagcaaagacccacuacacaggguggggaaaucucagcaacaaacuccuaacuacgccgauaguggauguaucaggaaagaaagucucaauacuagaucaacuugccaaaacguccaaaaacuucaugucaauaauaucaaacgaacaauacggaguccaggacuggaucaaagagcaaaauacaacagagacgaccggcacccuggaagacaaacucgccgaucuaacgaccucaccagccaacaaacgcggcauaaaacaggcuuucaauguacuuuucgacauccaaaaagccaugaaauccgaacccgaccgcgucuaucucgaguucgcacgugaaacgcaaacuucaguacgcaccaugagccgcuauaauuaccuaaaaggacuauaccaaagcaaaucccucgacgcagaagcuaaaaaccugaaaaaggaacuagccgaaaccgaccaaaagaaauuugacaaugacagacuauaccuauacuuccagcagcaaggcaaagacauguacaccggacaacccauaaauaucgacaaacucucaagcgacuaugacauagaccacaucauaccacaagcguucaccaaagaugacuccauagacaaucgcguccuggugagccgaccagaaaacgccagaaaaagugacagcggaacuuacacgacugagguucaagccgccgcgagcggccuguggaaaacacugguccaguccggauucaucagccgcaagaaauacgaccgauuaacacaugcuggagacuacuccgagggacagaaaaccggauucauagcacgacaacucguggaaacacgccaaauuaucaaaaacgucgccgcacugauagagagcgaguucgaccaaacccaagccguagccauacgagccgaaauaacaggagacaugcgccgccuaguagcaauaaagaaacaucgagaaauaaacaguuuccaccacgccuuugacgcccuucugaucaccgcagcgggccaguacaugcaaaaacgcuaccccgaccgcgacuccaacaacgucuacaacgaguucgaccgcuacaccaacgacuaccugaagaaacuacgagaaucgucaucaaaagacgaaguccgaaaacucaaacccuucggauucauaguaggcaccauggccaaaggcaacgaagacuggacaacagaacaaacggaguaccuucgacacaucaugaacuucaaaaacauacucaccacuuacaaaacuggaccagaccgcggaccgcuaucaaaagagacaauauacgcagucgacccgaaggcuaagcucaucggcacaaacaaacacaggcaggaugucucccuguacggcgguuacacauaucccuacuccgccuacaugacauuaguccgcgccaauggcaaaaaucaacucguaaaggucagccgaagcgcagcaagccuaaugaaguccggacagcugaaguuagaggacuacguacaacagcaacccgaggugaagaaguucgagaaaauccugcucgaacaucuccccuugggacagcuaguagacaacgacggaaaacucauguaccuaaccuccuaugaguucuaccacaacgccaaacaacuaugguugagcacagaaaacgcugaccucaucagcucucucuccaucgauucagaugaccagaagcucaucaaggcuuuugauauauuaacggccgacucaguaaucgaacgauuccccuucuacgaaaucgaccuaaagaaacucauagaacuacgagacaaauucguacuaauagacaacaagcucgacguccuccgggucguacuaaaggcacuucaacucgacagcgcccaacaaaaaccacuaaagcucaucgacaaggcagcaaccgacuggaaaaacuaccgccaagccggagggauaaaacuaucagacaacgcagaaauaaucuaccaaaguacgaccggcaucuucgagaagcgaauuaaaaucagugaccugcucuga

SEQ ID NO: 6408 - RNA, 3951 nt, Artificial Sequence
  Cas9 variant
augcuacagaagaacuacacaaucggccuugacauaggcacaaacuccgucggcuacgccguaaucaacgacaacuacaagguccccgcaaagaagaugaaaguccugggaaacacagauaagaaaaccaucaagaaaaaccuuaugggcguauugcuauucgaugcaggggaaacagcggccacaacgcgacucaaacggggcacccgacgccgauacacccggcgccgaaaccgccuacgauaccuacaagagauauugggccccgaacuagccaaaguagacgccaacuuccuacaccgccucgcggaauccagccuaguaaccgaggauaaagaguucagcgccuaccccauauuuggggaucgagaagaggaacuacuauaccacaagaccuacaaaaccauauaccaucugcgcucugcccucgccaacaaagacgaaaaggcagaccuuagauugaucuaccuagcacucgcccacauaaucaaguaccgaggcaacuuccucaucgaaggugagauagaacuaucggauaccgacaucgacaaaguuuacgcagauuucugccgcagcuuuaacgaacucuucgauacagaagugcuacaagaaauugaagucgaagccauauuuaaagacaaaacccuaagcaaaaccaagaaagcagaggaacugguuaaaguaagcggcgugaagaaaaaccaaguggcgcaccaauuccuuaaaaugaugguaggcaacacagucaacuuuaagaaagucuucaaccucacagaagaccaaaaacucagcuucggcacugacuccuacgaagacgagcucaacgaccuacuagcgaaaucagacgaccgauaccuagacguauucguugcagccaagaaaguauacgacaccgccauccuggccaacauccuaaacaccaaaaacuccgucgcgaccaaaacaaucuucagucaaucaaugauagagcgauucaaggaccaccagaaagaccucaaagaacugaaacaacucuucaaaacauaccuaccagaaaaauaccccgauuucuucggcaacucaaaggaggacggcuacgcaggguacaucgaaggaaaaacgaacgaagaaaaauucuauacacacacaaagaaaauucucaaaaauauaccucaggcugcauccguacuagcccagauagacgugggaaacuaccuccgcaaacaacgcaccuucgacaacgguguaauaccacaccaaauccaacucaaagagcugcuugcaauaaucgagaaccaggguaaguacuacccauuccuauuagaaaacaaggagaaaaucgcgaaaauacucaccuucaggaucccguacuacgucggaccccuagcacggggaaacucccgauucgcauggcucaaacgaguaggaaaagagaaaaucaccccuuuuaacuucgaaaacguaguagaccucgaaagcuccgcagaacgcuucaucgaacggaugacccucaacgaccuguaccucccggaagagaaagugcuacccaagcacagcaugcuguacgaaaaguucucgaucuucaaugaacuggcgggcauccgcuacaucacggacaacggagagaugaaauuccuugacgcccaaacaaagcagucaauauucgaguuauucaaacaggagagaacugugaaggaaaagaaaguacuagaccuucucaaaacccugaugccgucagagagagucguggccauaaaaggcaucgacaacggaaaauucaacgccucauucgggacauaccacgaccuaagcaagaugggauucaagacggagaaaaucgcguccgaaagcaaccaagcucggugggaagaaaucauuaagaccuuaacaaucuuugaggaccggaaacucauaaaaucacgacuacggaaguacgacgacuuccuuaaugaaaaggaaauaggggcacuaucaaaacgaaaauacacaggaugggggaggcuuucagcgaaacucauugacggcaucuacgacaagaaaacacaccaaaccauacucgacuuccucaugaacgaagacuacaaccaaaacuucaugcagcucaucagcaacgacaacuauagcuucaagaaaaucaucgaagacucccaggugauaaaagaggaaggcucgcuaaccgaggugauccaggagcuucccgggucccccgccaucaagaaagggauacuccagagcaucgaaauaguagaugagcugguuaaaguaaugggcggcaaccccaagaaaaucgucgucgagauggcccgugagacccagaaaacccacggcacgacaaggagggaagcccgaauuaaggaaaucaucaagaaccucaauaagcucaaacucaacgaauuaccuaaagaucucccauccaacgaagaacugucagacgaaaaagucuaccuauacugccuccaaaacgggcgggacauguacacaggcgccccgcuggaucucgacaaccucagccaauacgagguagaucauauaauaccacaaucguuccugaaagacgauagcaucgaaaacaagguucucacggccaaaaucgaaaacucccggaagaccaacggacugccaucaguagaaaucgccaagaagaugggagccuucuggcgaucgcugcuaaagguaggcgccauuagcgaaaagaaguaccgcaaccuccgccgcucccugcacggcggaaugacggagaaacucaaggaaacguucgugaaacgccaacucguggagacccggcagauuacaaaauacguagcccaaauacuuaacucgcgauucaacgaggagaaaaacgaggacaaagucgccaucgugaccuugaaagcccaacucaccucccaguuccggaaagacuucgaacucuacaagguccgagaaaucaacaacuuacaccacgcccacgacgccuaccucaacgcuguccucgcaacacucuugaugaccagcuucccagaauuggagccagaguucguauacggcaaauacaggaaaaccaaauucaaaggccuuggcaaagcgaccgcuaaaaacaaccuauacaccaacauccuccagcuucuaaaagaagaguccgcacaguacugggacacaaaggaaagggaccuagcaaccauaaagaagaacgucuaccaggcacagguaaacaagguccgaaaggucgagcgccagaccggguccuucuacgacgaaaccgucgccaagaaauccgcaucccaaaaacucuucccgagaaagaacggacuagacccugucaaauauggaggauaccaacgagcuaacgaaggcuauagcuuacucuuccgcgcggacaugcucaacaaacgcggcaaaaccaagagcguaaaaacccuaguaaaaauacccaucaucgaaagcgcucaauauuuagcggacccgaccgaguaccuggccaagcguggguacuacaaugucagcgagcauucccugcugcucccgaaguucagcuuacuggaaaacaacaacggccuacgccgcuaccuugcaagcagcaaugaguuccaaaaagcaaaugaacuuauccuacccaaacaccugguccggcuacuauacuggucucaaucaaaacaacgcaaagaggaauuaaacaaacacagagccgaguucgcagaacucuucacuuacauaauggacuucgcggacaaauacgucguggcuccgaaaaacagcgaaaagaucaaaaacauauacgaaaacaacaaagacucuuccgucgaaguccuaggcaaaaacuucauagaacuucucaaauacacagcugauggugcagccagcgacuucaccuucuuugacacaaagauaccgcgcaagcguuauaauucggcgggcgacuuacucgacggaacccucauauaccaguccaaaaccggccucuacgagacgagaauagaccuuggugcaaucuga

SEQ ID NO: 6409 - RNA, 3957 nt, Artificial Sequence
  Cas9 variant
augaugauaaaacuaaauaacaugaagaaaauacucggauuagaccuaggcaccaacagcaucggaugggccgucguagaaaccgaggacaacaagaaauuugaacuccucgacaaaggggugagaauauuccaggaaggcguaaaaaucgaaaaaggcaucgaaagcagcaaagcggccgaacggaccggguaccgcucggccaggaggauaaaauuccgaagacgacuucggaaaaucgaaacccucaaaguacucaucgaaaacaacaugugcccacugucaauggacgaacuaaucgucuggaaagagaacaaaaacaacuaccccaaaaacaaaauauucuacaacuggcucaaaaccaaagauccaaaagaagggacgaacgggaccuacaucaaccccuacuauuuuaggacggaagccauuaagcggaaguuagagaacaccaacgacgucggccgcgccuuauaccaccuggcccagcgcaggggcuucaaaagcaaucggcuggaaagcaccgacgagaaaagcagaggcaucguaaagaccgaaaucaacaagcuaagcagcgaacuaaacggacgauaucuuggggaauacuucuacgaacuuuaccuaaaaggugagaaaauccgcaaacgccauaucagccgcgaggaacacuaccucaaugaguucaaaaagauuugcgaaguucaaaacuucaacaaagaacucgccgaaaaacucgaacgcgccaucuucuaccagaggccacucaaaagccaaaaaggccucguuggcaaaugcacgcuacaaaacaauaagcaucggugcccgaucagccgccccgaguucgaagaguuccgcauguggcaauucaucaacucgauuaaauacaaaaauagcgacggaaaguucgauuuccuaaacaaggaacaacgagaaaacaucauacccgcguucgugagcaacaaaaacgcaacuuucgaguucucaaagauagaaaagauccuaaacaagggcgugcauauuuaccaguucaauuauaaaagcaaccacaccauaggcuccaaccaaaccaugaucaacuuuauggacgucuucgacaucgaccggaagcugacaaacgccuggcuacucugcgucaacaaaauuuacgaacucuauaccgccaagaccaaaaaggauggcagccugaagucgaaaagcgaggucauaacagacguguggcacguccuguucacauucgacaacgaagagaaccugaaagaguucgcuagaaacaaacuucuccuagacgagagcucugcccaaaaauucagcaagaucaaccuaaaacaggauuacucucaacuaucacugaaagcgaucaacaagauacuccccuaccuccaagaaggucuaaucuacuccuaugcggucuucaucgcgaacauugaaaacgugauaggaaaauccauuuggaauauaaaggagaaccagcaaauuauccgcacauccauaaagaaaaucauugauaaccacaaaacagaguuagauauaaacaccauaaccaacagucucaucaacgacuucaaagucaauuacaacaacgcgcacaaagaauacaaagucgacgauaucgaccugaaaaacauaagagagaaaauaaucaaauauuacggcaacaagaccuggaacugccuacccgaagacgaaaaacuauacgucaaggaaaaaguugagaaacuguacgaaaaacaauugaaaucuggaaaacgcggcaucuuuaucgagaagauccgccucgacgaccggauagaaaacuucuugaaggacaauuucgacucuagcgaacuaaaccucaaaaagcuguaccauccgagcgacgucuccguguacaaguccgucaagaucaccgaucucggacuaagauuacucggcagccccaugauaccaagcaucaaaaaucccauggccaugcgcgccaugcaccaacuucggaaacuaauaaaccaccucauaaucgagggcgugaucgacgacagcacaauaauuaauguagagaugagccgcgagcucaaugacgcaaacaugcggaaggccaucgaacgcuaccaacgccagcgcgcaaccgaaaacgaagaguucaaaacaaagaucaaggaacucuacaagaaagaaugcggaaccgacuucgagccgaacaaugacgacaucaugaaauacagacugugggaagaacagaaucauaaaugccuauacaccggcaaaucaauaggcaucugugacuucauagguaguaacccagccuuugaaaucgaacauacaauaccccgaucacucagcuacgacaacucccucgaaaacaaaacccuaugcgaaaaggaauuuaaccaacaggucaagaaaaaccgcaucccguucgaacugagcaacuacaaggaaauaaucagccggauaaacaacugggaaauaaaggccgaagaacuauuuaagcaaauacaaaaaguuaaaauacaaagccggauggccgcgacaaaagagaucaaagacaacgccauccaacggaagcaccuccuucagauggaguucaacuacuggaacgggaaacugagccgguucacccgcgaggacgucccagaaggguucaaaaacucgcagcucguggacauaggaauaauuaccaaauacgccagggccuaccugaagaccgucuucaacaacguaaacacgguaaaaggaucaaccgucgccgaauuuagaaacaucugggggcuacaagaguacuucgaaaagaaagaccgcucgaaccacauccaccauugcaucgacgccauaaccaucgccugccuaaccaaagacaaauacgacuuucuggcccacuuguaccaucucgacgaacagaacaaccgggacgcaguccaccgcgccaugauuaaaucgaaacccugggagaacuucguccaggacguuaaagagauagaaaaccagauccucguaagccacuacacacccgacaaccucccuaagcaaucgaagaagauacuucggaaacgugggaaaauccagaaaaacgagaacggggaccucauuuaugaaaaaggagacgcaguccgcgguagccuacacaaagagagcuucuacggggccauaaaacgagaaauaaucaacaagaagggggagacggaagaaaaaguccuuuaugucaaacgcaaaccacucgaguucagcgaccugggauucaaaaccauaagugaacucgaaaacaucgucgacgacgcggugagggacaaaguccuaaacgcaguaaaggacaaaggccugaagcaagcacugaacgagcccaucuggaugaacgaagaaaaacaaaucccuauaaagaaaguacgcugcuacaccccguccgucacaaaccccauaaaccucaagaaacauagagauaaaucaaagcacgaauacaagcaaucguaccacgugacaaacgacggcaacuaccuaauggucaucuacgaaggcaaagacucacaggaaaaggucaaaagggacuacgaaaucguguccaaccuccaagccggagaauacuucaaacaaucaguccacggggugcucaaagcucagggaauaaacaaccuggaaggccugaucccaaaauucaaggagagugguaagaacauccucccacugaaguauauccuaaaaacgggaacgauggucauuuucugggagaauuaucccgaagaaauaugggacaucgacaaaaaccaacuauacaagagauuauucaaaguuacccaauucgagucggacggccgcauacaagcacgcuuccaucaaaucgcgaaacccgauaacgagcugacuaaggucuccgaacucgauuucucgaacaucgcugagaaaauccggcugagcaaaggcaaucucaacaugcuggucaacggcuacgacuucaaaauuaacguucucggucauaucgaaaaauuauccuga

SEQ ID NO: 6410 - RNA, 3957 nt, Artificial Sequence
  Cas9 variant
augggcucaaacaugcuaaagaaagacuacuccaucggacuugacauaggaaccaacagcgucggccacgccgucguaacagacgacuacaaaguacccacgaagaagaugaaagucuucggggacacgagcaaaaagaccaucaagaaaaacaugcuaggaguacuccuauucaacgaaggccaaacggcugcagacacccgccuaaaaaggggcacgcgccgacgauacacccgcaggaaaaacaggcugcgcuaccuccaagaaauauucgcccccgagcucgcgaaaguagacccgaacuucuuauaucgccucgaagaaucaucgcuaguggccgaagacaagaaauacgacgucuaccccaucuucggcaaacgggaggaggagcucuuauaccacgacacuuacaaaaccaucuaccaccuacgaagcgcccucgcgaacaacgaucaacccgccgaccuccgccucguauaccuagcccuagcccauaucaucaaauaccguggcaacuuccuacuagagggagaaaucgaccuccgaacgacagacaucaacaaagucuucgccgaguucagcgaaacccucaacgaaaacagugaugaaaaccucggcaagcuggacgucgccgacaucuucaaaaacaauaccuuuagcaagacgaaaaagagcgaagaacuccugaaacuaagcggcgccaagaaaaaccaauuagcccaucaacuguucaaaaugauggucggaaauaugggaaguuucaagaaaguccuagggacggacgaggaacacaaacuuuccuucgggaaagacaccuacgaagacgaccucaacgaccuucucgccgaagcgggcgaccaauaccucgacaucuucgucgcggcaaagaaaguguacgacgcagcgauucucgcuucgauacucgaugucaaagauacccaaacgaagacagucuucucucaagcgaugauagagcgauaugaagaacaccagaaagaucugaucgagcucaaacggguauuuaagaaauaccucccagaaaaaugccaugacuuuuucucagagccaaaaaucagcggauacgcaggcuacaucgaugggaaagugagcgaagaagacuucuacaaauacacaaagaaaacccucaaaggcaucccagaaaccgaggaaauccugcagaaaaucgacgccaacaacuaccugagaaaacaaagaaccuucgacaauggggcaaucccacaccaaguccaccugaaagaacuuguugcaaucguggagaaccaagguaaauacuacccauuucuccgcgaaaacaaagacaaauucgagaaaauccuaaauuuccguauacccuacuacguaggcccccuagcccgcgggaacucaaaauucgcauggcuaacacgggccggcgaaggaaagaucacaccauauaacuucgacgaaaugaucgacaaggaaaccuccgcagaagauuucauaaaacacaugaccauaaacgacuuauaccucccaacugaacccguacuacccaagcacagccuacucuaugagcgguacaccaucuuuaaugagcuagcaggcgugcgauacguuacagagaacggggaagccaaauauuucgaugcccagacaaaaagaaguauauucgaacuguucaaacucgaucggaaaguguccgagaagaugguuaucaagcaucuaaaaguagucaugcccgccauccgaauccaagcacuaaagggacucgacaauggcaaguucaacgccuccuauggcacguauaaagaccucgucgacauggggguagcccccgaacuccugaacgacgaagugaacuccgagaaaugggaagacauaauaaagacccuaacgaucuucgagggacggaaacugaucaagcgcaggcucgaaaauuaucgugauuuccucggcgaggacauucuccggaaacugagccgcaaaaaguauacaggcuggggccgacugucggcaaagcuacucgacggcauauacgacaagaaaacccacaaaacaauacuggacugccuuaugacagaggacuauucgcaaaacuucaugcagcugaucaacgaugacaacuacucauucaaagaaacuauuaaaaacgcacaaguaauagagaaagaagaaacacuggccaaaaccguucaagaacuaccuggcucgccagcaauaaagaaaggcauccuacaguccuuagaaauaguggaugaaaucauaaagguuaugggcuacaaaccaaaaaguauugucgucgaaauggcccgagagacacaaaagacccacgguacacgcaagagagaagacagaguccaacagauagucgagaaucuaaaagacgccaacgagcugcccgaaaaacuccccaguaacgcagaacuguccgacgagcgaaaauaccucuacugccugcaaaacggacgagacauguauaccggcgcgccccucgauuacgaucaccuccaauuuuacgacgucgaccacaucauaccccaguccuuucuaaaagacgacuccaucgaaaacaagguccuaaccaucaagaaagaaaacguacgcaagacgaacggauuacccucggaagcaguaauacagaaaaugggcagcuuuuggaagaaacuccuugacgcuggcgcgaugacuaacaagaaauaugacaaccuccgccgaaaccugcacggcggcuuaaacgagaaacugaaggaaagauucauagaaaggcaacugguggaaacacggcagauaaccaaauacgucgcacagcugcuagaccaacgccuaaacuaugacggaaacggcgucgaacuugacgagaaaauagcgaucgucacgcugaaagcacaauuagcgagccaguuccgcucagaguucaaacucaggaaagugagggcacuuaauaaccuacaucacgcucacgaugccuaccugaacgccauagucgccaaccucauaauggcaaaauaccccgaacuggaacccgaguucguuuacgguaaauaccgcaaagcaaaguucaagggucucggaaaagccacugccaaaaacacccucuacgcuaacgugcuauacuuccucaaagaaaacgaaguauacccauucugggacaaagcucgcgaccucccaacaaucaagcgcuaccucuaccgagcacaagugaacaaaguaaggaaagccgagcggcaaaucggaggcuucagcgacgaaaugcuagucccgaaaagcgauuccggcaagcuccuaccccgcaaagagggccuagacccgguaaaauauggcggcuacgcaaaagccgucgaaucuuacgcaguccucauaaccgcagacgaggucaagaaagggaaaaccaaaaagguaaagacccucgugaacauacccaucaucgacagcaaaaaguacgaagcugaccccaccgcuuaccucgcgucacgcgguuauaccaaugugaccaacaguuucauccuucccaaguauuccuuacuggaagacccagaaggcagacguagguaccucgcauccuucaaagaguuccagaaagcgaacgaacucauacucccccaacaccuggucgaacuccuguacugggugaaugccaaagacggggaacaaaaacuagaagaccauaaggccgaguucaaagaacucuuugacaaaaucauggaauuugcugacaaauacguagucgcaccgaaaaacagcgagaaaaucagacgccuguacgaggaaaaucaagacgccacgccgauggagcucggcaaaaauuucguagaacuacuacguuacacugccgacggagcggcaagcgauuucaaguucuucggcgagaacaucccacgcaaacgcuacaacuccgcgggcucccuccugaacgggacccuuauauaccaaaguaaaaccgggcucuacgagacacgcaucgaccucggcaaacuauga

SEQ ID NO: 6411 - RNA, 3960 nt, Artificial Sequence
  Cas9 variant
auguuuucccaacgcaacaacccguacugcgaacugcuauuuaaaauuauaguaacaaacaucgaagagaaaaaucuagaaguaauuauggggauucgcaauagcgauauauucuuuaucagcaacuucaugugguaccagaaacuuaucaugaugauuaaaaacauacugggccucgaccuagggacaaacucaaucggcugggcccucaucgaaguagacgaaaacaauaucccaauccgcaucaucgcaauggggagccgcauaaucccccuaucaaccagcgacaaagaggaguuccaacgcgggcuaucgaucaccaaaaaccaaaaccguacaguaucgcguacacagcgaaagggauacgaccguaaacagcuacgacgcucggauuuaaagaagauccucaaaaaguauaacauauucccaagcgaagaacuccuuaagcugcccaugcuggaccuauggaagcucagauccgauucagccaaccccaacgaagacauauccgcugaacaacucggccgaauacuguacaugcucaaccaaaaacgaggauauaaguccgcacgcagcgaggcaaacucggacaagaaagacacagauuacguacaagcagucaagggacgauaugcacaacugaaagaccgccgccagaccaucgggcaguacuucuacgaggaacugagcaccgcguuuagcgacaaaaacaaccagcaauacuuccgagugaaggaggaaguguauccaagggaagccuauaucgaggaauuugacacaaucauaaaugcgcagaaggacaaacacggguuccucacagacaagguuauacaucagcucaggaacgagauuaucuacuuccagagaaagcucaaaucccaaaaagggcuagugucaauaugugaacucgaaggauucgagaaaacaguuuacgacaaagagaaaaacaaaaacaaaguuguguucguaggaccaaagguagccccgaaaaccucaccacuguuucaacuaugccgaauuugggaagugguaaacaccauaucccucaagaucaaaaacccggaaggcagcaaguacaaauggggcgaaaaaguccccaaccucaagcaaaaagaaauccucgcggauuaucucuucaaaaacgaaaaccuaucguucucaacacuacucgaaauccucgagcuaaagaaagaggacguuuacgucaacaaacaaauccuuaaagggauuaaaggcaacgaggcuuacgccgcacuacauaauguacucggcgaccacgaacuauugaacuucgacguaucgaucaucacgagcgaccacaccgcaaucuuaguugacaagaaaaccggggaaauacucgaagaacgagccggccuagagcuagaugcgucacuagaaagagaacccuuauaccaauucuggcacacgauauacucgcugaaagaccuagacgaaugcaaaaacgcccucauaaaacgcuucggacuggacgaggacauugcagagaaauuaucccacaucgacuucaacaaacaggccuucggcagcaaauccaacaaaagcaugcgcaaaauccuccccuuucugauggaaggcuacaacuacucagagagcugcucgcucgcaggcuacaaccacuccaacagccuaaccaaagacgaaagagagucccaaaucacacucgagcgcuuagaacuucuccccaaaaacaaccuacgccaacccaucguggagaaaauccucaaccagaugaucaacgucgugaauacaauccuggaaaaauacggaaaaccauccgaaauccgcgucgagcucgccagggaauuaaaacagucaaaagacgagaggaacgacacagaucuacaaaacagucgaaauaaaaagcuaaaugaggagauaggcaaacggcucgccgaacuaggacugccagucacgaaacgauauauccaaaaguacaaguucaucuucccgagccugucgaaaaaccugaaagacgcacacguaaacaaucaaugcaucuacugcggugaaaccuucaaccucaccgaggcccuuaacggagacgccuacgacguggaccacauagucccaaaagcgcuucucuucgacgacagccagaccaacaagguccuaguacaccgcaagugcaacagcaccaaaaccaaccagacugccuacgacuacauaacggcuaagggcgaggaagaaguacguaucuacucagaacgagucgacgacugguucaagaagggcauaauaagcuacuccaagaugcaacggcuaaaagucucccacaaagaauaccucgaaaggaagaaacucgggaaagaaaccgagacggacaagaaacucugggaaaauuucauagaccgccaacugagagacacacaauacauaagccgcaagagcagagaaauacuacaaaaaguaugcaacaacgucacaaccaccgaaggcggaguaacagccaaacuacggaaccuuuggggcugggacgacauccuaaugaaccuacaaaugcccaaguacaaagagcuaggccaaaccaucaccaaggaauggaccagcgaacauggaaagcgcaagcaccaaaaggaagaaaucgaaaacuggacuaagcgcgacgaccacagacaccaugccaucgacgcccucgucgucgcauguacaaaacaaggcuucauccagcgcaucaacacccuuaauagcagcgagacgaaggaucuaaugaucaaggaaguggaagaggcgaaaaucgaguucaacgagaaaacuacacuacucgagaaguaccucaaaacccaaaaaccguucacaacgagagaaguaaugaaggaagccgacaaaauccucaucuccuuuaaggcagggaagaaaguggccacgaucaccaaauuuaaagcuacaggcaagaauaaagaaaccggaguuauugugccgcggggcgcucuacacgaacaauccguauacggaaaaaucaaagucaucgaaaaagacaaaccccuaaaauaccuauucgaaaaucccgauaagaucguaaacucaagaauccgagaccuagucgaaacccgccuaagcgaaaacgagaacaacucgaagaaagcacuguccaccguaaagaaaaacccaaucuucuucaacgaagagaaaaacgagauccucgaaaaagccucaugcuacaacgacgcaaccguccucaaauacaaauuacaaaaccuuaaagccaaccagguagacgauaucgucgacgagagaguaaaauuccugguuaaagagagacuuacucaguucggaagcaaagaaaaagaagccuucaaagacauccugugguucaaccaagaaaaacaaaucccgauaauaaccgugcgccuuuuugcgcgccccgacgcgaacaaucuccagauuaucaaaaaggacaaaaauggcaaggacauaggguucguacucacgggcaacaaucaccacaucgccaucuacgaggacaaagacuccaaacuuguccaacacagcugcgcguucuggcaugccgucgaacgcaagaaguauaacaucccugccguaauaaagaacagcgccgacguuuggagccuacugcucgacaaagagcucccgguccucuuccuagacaaguuacccgcagaugaacugaaucugaaauucuccaugcaacaaaacgagauguucauacucggccuuucccaggagggcuucgacgaagcgauaaagaacaacgacaaaucccuguuaagcaagcaccuauaccucguguggagcaucaguaacaaugacuacuacuuccgacaccaccuagaaaccaaaaacaccgaacucaaaaauauacccacugccaaagacuccaaaagauacuuccgauucaaaucggucggagcccuagucggcaucaaccccaucaaaguucgccucaaccaccucggugaaauaaccaagaucggcgaguga

SEQ ID NO: 6412 - RNA, 3960 nt, Artificial Sequence
  Cas9 variant
augggcuacaacauugggcuagacaucggaaccggcucagucggcugggcggcccucacugacgaaggcaaacuggcuagagcuaaaggcaaaaaccuaauaggaguacgacucuucgacucugcgcagagcgcggcccagcgccgcagcuaccgcacgacacgccgaagacuauccaggagaaaauggcgccuucgccuacucgaaaacaucuucuccgaugaaaugggaaugaucgacgaaaacuucuucgcacgacucaaauacagcuacguccaccccaaggacgaagucaauaacgcccacuauuacggcggauacuuauuccccacccaacaagagacccacgacuuucacgagaaauuccagacaaucuaucaccucaggcucaaacuaaugaucgaggacugcaaauucgaccuccgcgagauauaccucgccaugcaccacaucguuaaauaucggggacacuucuuaaacagucaauccaaaaugacaaucggagacagcuauaacccacgagacuuccaacaagcgauacagaacuacgcagaagcaaagggacucaucuggucgcuaaacgacgcacaagaaaugaccgacguccucgucggccaagcgggcuucggucuuuccaagaaagcaaaagccgaacggcugcuaucagccuucuccuucgacaccaaggaagacaagaaagcgauacaggccauauuagccgguaucguggggaacaccaccgacuucacgaaaaucuucaaucgggaaagguccggagacgagcugaagaaauggaaauuaaaacucgacucagaagccuucgacgaacagucccaggcgauagucgaugagcucgacgacgacgaaauggaacuguucaacgccaucagacaagccuucgacggauuuacgcugauggaccuucucggcgaucaaacauccauaucagccgccauggugaaaagauaucaacagcaccacgacgauuugaaaaugguuaaagagauagccaagaaacaaggccuaucacaccaagacuucucgaaaaucuacacggcuuuccucaaagacgacaccgacaaaggcaugaaagcauuacuggacaaagcagaccuagcagacgacguccucguagaaauccagcagcgcaucgaaucgcacgacuuccuccccaaacaacgaaccaaagccaacucagucaucccguaucaacuucaccucgcugagcucgagaaaaucaucgaaaaccagggaaaguacuacccauuccucuuagacacauucaccaacaaggcuggcgaaacaauaaacaaacucguggaacucguaaaauuccggguucccuacuacgucggcccaauggugaccgccgccgacguagaaaaggccggcggagacgccacaaaccacugggugaaacgcaacgaaggcuacgagaagucucccgucacgcccuggaauuucgaccaagucuucaaccgggaccaagcagcgcaagacuucaucgacagguugaccggaacugacaccuaccuuaucggagaacccacccuccugaaaaacucgcuuaaguaucagcuauucacaguacucaacgaacuaaacaacgucaaaauaaacggccacaagaucgacgagaaaacaaagcauguccuaauccaggaccucuucaaauccaagaagacagucucggaaaaagcaaucaaggacuacuaucucucccaaggaaugggagagauacaaauagucggacuagcggacaaaaccaaauucaacagcaaccugucuuccuacaucgacuugagcaagaccuucgacgcugaauuuauggagaacccggcgaaccaagaacugcuagaaaacauaauccaaauccagacgguauucgaagacguuaaaauagccgagcgagaguuacagaagcuagcucuccccgacgaacaagugcaacagcuagccaaaacacacuacacuggaugggggaaucucuccgacaaacuccugagcacacccaucauacaagaaggcagccagaaaguaucaauccucaacaagcugcagacaacaucgaaaaacuucaugaguauaaucaccgacaacaaguucggaguccaacaguggauacaagaacaaaacaccgccgaaaccgccgacagcauccaagaucgcaucgacgagcugaccacugccccugcaaacaagcguggcauaaaacaggccuucaacguccuauucgacauacagaaagcgaugggugaggagccgaacagggucuaccucgaguucgccaaagaaacucaaaacaguguccgcacaaauucccgcuacaaccggcuaaaagaccuauauaaauccaagacacuauccgaugacguaaaagcgcucaaagaagaacucgaaucccagaaaagcucccugcaauccgagcgaauaggcgaucggcuuuaucuguacuuccuacaacaaggcaaagauauguauaccggacaacccaucaauauagacaagcuguccacagacuacgacaucgaccauaucaucccccaggcguacacgaaggacgacagcaucgacaauagaguucugguaagccgacccgagaacgccagaaaaucggacucggcuaccuacaccaccgaaguccagcaaucugccgggggacuauggaaaucccucaagaaugcaggguuuauaucccaaaagaaauacgaccggcugaccaagggcggcgacuacuccaaaggucagaaaacaggguucaucgcccgccagcuagucgaaacgcgacaaauaauaaagaacguugccagccuaauagagagcgaguucucccaaaccaaagccguagccauucgcucagaaaucacagcggauaugcgccgguuagucgccauuaagaagcaccgggaaaucaacuccuuucaccaugccuuugacgcccuccucauaacugccgcuggccaauacaugcaagcgcgcuaccccgacagggacggugccaacgucuacaacgaguucgauuacuacacuaacacguaccucaaggaacugcgacaaucuucaucaucgagccaaguacgccgccuaaagcccuuuggcuucgucgucggaaccauggccaaaggaaacgaaaacuggagcgaagacgacacccaauaccugcgacaugucaugaacuuuaagaacauacugaccacucgcagaaaugacaaggacaacggagcgcucaacaaagaaacaauauacgcugucgacccgaaagccaaacugaucggcacuaacaagaaacgacaagaugucagucucuacggcggauacaucuaccccuacucagccuacaugacccuaguccgugcgaacggcaaaaaccuacucguaaaagugacaaucagugcagccgagaaaaucaaauccggacaaauagaacuuuccgaauacguccaacagcgccccgaagucaagaaauucgagaaaauacucauaaacaaacucgccaucggccagcuagugaauaacgacggcaaccugauuuaccugacauccuaugaguucuaccacaacgcaaaacaacuguggcuacccaccgaagaagcagaccuuaucucacaacugaacaaagacagcuccgaugaagaccucauaaagggcuucgacauccugacgagcccagccauccucaaacgcuucccguuuuaugaacuugaccucaaaaagcuagucaacauacgagauaaauucauagcagucgaaaacaaauucgauauacuaaugguaauacucaaagcccuacaacuggacgccgcacagcaaaagcccguaaagaugauagacaagaaaagugcagacuggaaagacuaccgccaacgaggcggcaucaaacucucggacacauccgaaauaaucuaccaaagcaccaccgguauauucgaaaagcgcgucaaaauaucaaaccucuuauga

SEQ ID NO: 6413 - RNA, 3963 nt, Artificial Sequence
  Cas9 variant
augacggagcagcagcguccguacaacaucggacucgacauugggaccuccucgauuggaugggccgucaccgaccagaacgauaaacuacuacauaucagagggcauaacgguauagggguccgccucuucaaggaaggugaguccgcggccgagcgaagaggcuuccgcacuacacgucggcgccucucucgcagacguuggcgccuacgguuccuagaucgcaucuucgaugcggaacuggccaaaguugacccaaacuuccuggcgagacuaaaacaaaguaacauuucaccccuagacccaaacaaacagauguuuggcaacauucuauucgacgacgcccaauucgacgaccaaaaauuucaccagcaauaccccacgaucuaccaccuacgaagugcgcucgcacagcccgacgccccacaagccgacguccgacucaucuaccuagccuuacaccauaugauaaaauuccgaggccauuuccuaaauggcgccgcaguagaaaaguuucacggcgggcaacuacaucuagaagcagaguuccaagaacuuaaucaaaucuucagcaaccagcagcgcgaucacguucagcugcaaacgucgagccucgacgaaguugccacaauccucaaagacaaucagcgcacucccagcgaccgccaacgagaacucucagcccgacucuucguccccgucgacaaaacaaucgacaaagaaaacaagaaacuugccacagaauuacucaaagccguacucggccuaaaagccaaauuugacgugauccuuggaguagaagccaccgacccccaagcauucaaacuacaauuuagcuccgaugacuucgacgacaaaaucgcugaacuagcauccgaacucaccgaugaggcuaacgaaauccuuacuguccuccaacgccucuacuucucgcucaaccuggcagacauccucacaaaccgccagacuaaacaaguagcggacagcaucuccacggcuaugauuaacagauacgacgaccacaagcaccacuuaaagaugcuuaaagaacuugaaacccaggucacccaagaacaaagagacggacucaagaaagcauacgacgaauacauugacggcgacaaacccaccauagacacauucuacacaaauguaaagaaaaaccuagacgacagcgaacucgccaaccaaauaaaaucgcucauagaccuccaagcguucaugcccaagcaacgcucuaaagagaacggauccaucccccaccaacuacaccaacgcgaacuagaccaacuaaucgaaguucaaggaaaauauuaccccuggcuccucgccgcgaaagacaagcucgacgcccucaucgccuuucgaguaccauacuacgucggccccaugaucgauccuaacgaauccgacgacccucagaacacgaaauucgccuggauggugagaaaggaagcaggcgaaaucacccccuggaacuuugaagaaaaaguagacaaaaccgggucggcgacuaacuucauaaaacgaaugaccaccacagacaccuacuugcuaggcgaaccgguacugcccaagaacagccuccuguaccagcaauucacaguccucaacgaacugaacaaacucaaaguagacggcaaagcacuaaccgucgaucagaagaaauacuuguaugaacacgucuguaaaaagcagcgccgcgucacccucaaaaagcucucugauugucugauggcacgaggcgacuuccccaugggcgccaucuucacggggaccacagaccaaaagaauaugaacaacacccucaaaaccuaucaggacuuccaagaaaucuucggcgacgaaauagacaaccccgaccgccagguggacuucgagaaaaugauagaauggucgaccaucuuugaagacagagaaauauucaaacucaaacucgcggagcuaaacuggcucaccagcgaacaacucgaacgcgucuccaagaaaagauaccaagguuggggccgacugagccaaaaacucuuaacccacaucguaaacgaaaacggagaacguaucauagaccagcuguggaacaccaaccaaaacuucauggagaucauggggcaggauggcguaaaacaggcuauccaagaacauaacggcgcaaacgucgcacaaaccggcauaaaugaaacaaucgacgaacucuacaccuccccucaaaacaagaaagcgauccggcaaauccuccucgucguugacgauaucaagaaggcgguaggguacgcgcccgcaaauaucaugauggaauuugcuagggaagaucgggacgaccaccgccucaucgcguccagggcacgacagcucgagaaaaccuaccaagagaucagcaagaacugguucgacaacgaaagcgucacccaggaacucaaagaccaaaucaaaaacaaaaccaaauucaccgaccgccuauaucucuacuuuauccaagggggaaucgaccuguauaccggccacccccuaaauauagaccaacuaucgagcuacgacauagaccacauccuaccccagagcuuccuccuagacaacucgcugaacaaccgaguccugaccucccaaagcgagaaccgcgugcauaaagaagaccgacuccccggcgaaaccguagccaacaaaaugagaccaaccuggaagaugaugagagaacagggguugaugacacaaaggaaguacaacaaccuuacacucaagccggaccaaaucuccaaauucaauaacagaggccaguuuaucaauagacagcucguagagacuagacaagucaucaaacuagcugcugacaucaugaaccaaaaauaccaggccgaccaaacaaagguagucaccguuaaagccaaccucacccaucacaugcgagaaaaauucaacuucuauaaaucccgcaacgucaaugacuaccaccacgccuucgacgcauaccugaccguauuugucgggaauuggcuacucaaagaauauccaaaacuacaaccauacuucgucuacggagacuucgcuaagacaggaacgaacaaucuuaagagcuucaacuuccuauaccgcuuugaacgcgaccauaaacuuaacgauaaaggcgcaauagacaccgacaaagaccagcaguuaggauacaugaaacgaaucuaccgcuucaagaaaaugcuugucacaaaacaacucgaaacaaacgaaggagcacucuacaaacaaaccauauacaaagcaccggcaaaugaaaagaacaccaagaaaaaucggucacuuaucaacacaaagaaaaaucgccccagcgacaucuacggaggcuacucccaauccgucacagccuacaugucccuaguguucuucaaaaacaccuucaaacuaauaaaaaugccgcucgucgcagcaaaugccaucaaaaacucacucagcagcuaccacgacacgaucuuaaaaauccucgggucgaacgaguucaaaguccuaauacccaaaguuaagaugaaccaacugaucaaagaaggggacagucucuacacugucgucggcguuuacaagcacaacgcccagcaacuaauccucucagacaacagcaugggcaucauaacuaaacccauaagagaaauaugcgacucugacuuagacagugucuucaacgaauuaguggauaacauagauaaauaccucaaccuuuacaaaauugaagacaaacucacaaucaaagaaaaauucuacgcgcucaagaacaaagaaagcaaauuuaaaugcauaucagacauacucgugggcacgcacugcaaugcuggccgcucuaaccucaagauaauaggauuaucaucuuacugggguauguucucaggaaacaacgacgggcuaaaaaucaacgaaaacucacaacucauauaccaaucccccacagggcuauucgaacaccgugugaaagugucagaccuauga

SEQ ID NO: 6414 - RNA, 3972 nt, Artificial Sequence
  Cas9 variant
augaaagacuucuacaucggucuugacaugggcaccgacuccguaggcugggccguagccgacgaggacuacaaccucugcaaauuuaagggaaaggccauguggggaguccgccucuucgaugaguccgccaccgcggccgaacgcagaggcuuccgcacagcccgacgacgggcccaacgaaagaggcaacgaauacuauggcuucaaaugcuauucaacgaagagauauccaagaaggacaucgccuucuuccaacgacucaacgaaucuaaacucuaucuugaagacaaaagcacuaacgugcccuacgcggucuucgcugacgagagcuucaccgacgucgacuaccacaagcucuacccaacuauauaccaccucaggaaagaacuuguacaauccgacgaaccucaugacguacggcuaguauaccuggcauuacaccacuuaauaaagaaucguggccacuuccucuucgagaacguggggucagacuucgagaaagaaucguccuucgagguccucuucaagaacuuacaaaacuacauacuaggcgaguacgagcuugcgcuggaaugcauuucaccgcuacaaaucgcggacauacucaaagacaaaagcaagcgcaaaacuacgaaaagcuccgagaucugcaaacuacuaggaaucuccaagaaagggcaaccccgccugaacgcaauagugcuccucaugugcggacaauccgugaaacucgccgaccuauacggagacgaaaacuacaacaaggaggagaagucgagcauaucauucgagaaaggcuacgaagacaacgaagaaaccuaccgggaacuccuucuggagagauucgaacugaucgagaaaauaaaggcccuauaugacugggccauccucgcggauauccugaagggcgaaaccuacaucagcuuugccaaggugaaaacguacgaugaacaccgacacgaccuccaacaacuaaaagccuuuguaaaagaacgcuguagaucagacuacaacgaaaucuuccgcgaaacuucggacaagcucaacaacuacaccgcguacugcgguaaguucaaggaaaacggcaggaacgguguaauacugcacucagccaaccaaacggauuucugcaaguaucuuaagucaaaauuugacaaacuagacaaguccggauacgaggacauguucgagaaaauagaaaacgggagcuucaugcccaaaauagugguaaaggacaacggaguaauccccaugcaagucaacgaaucagaggucagagcaauacuuaaaaacgccuccggauacuuggauuuccuuaacaaccaggacaaagauggaaucacagucgccgacaagauacuccaaaucuucgaguuccgaaucccguacuacguuggcccucucaacguccacuccgacaacagcugguuaguccggaaggacggaaagaucuacccauggaacuucaacaagauagucgacguggacaaguccgccgaggaguucaucaacaagcugacugccaagugcaccuaccuacccgaccgagacgucauccccaagaacucgauccuauacagcagauauaugguccuaaacgaacuaaacaaucucaagcuggacgggaagaaacccgacgucaguuucaaacaagccgucuucaacgaccuauucaugcacagacgaaaaguuacacaaaaagcccuccgagaauacauaaaagcccaaaccggcacagagccggaaauaacggguaucgacggcgacuucaaagcuaauaugcggccagcuauagagcuagccggcuacaaccuaucagaaccugacaaagaagaaauaauaaaagccauaaccaucuucggggacgacaaaaagcuccuaaaacgacgaaucaaagacaaguacuccgagaugcugagcgaagaugagaucaagaaaaucugcaaacuaaaauacaaagacuggggucgccuauccagagaguuccuaacagagauauuugacgucgauacagcaacuggcgaauguaaagacaacauaauuaacacccuuuggaacacaaaugacaaucucauggaacugcuaggcgcaaaauacaacuucacccaaagcauagagcaagccauaagcaagagcacccacaaggcuuccauagagaaaaugguagaagacauguacguaagcccaaaggugaaacggaccgucuuccaguccuuaaagaucaugaaagaaauaguuaagaucaagggccaugcgcccaaaaagguguucguagaaaugacacgacacgauggaaccaagggagauaauggacgaacgaagucgcgcaagaaacagcuagaagaacucuacaagaaaugcaaagaagacuccacagagcuaugggacgaacuggagaaaaccgacgacgaugaguucagacaagauaagcuguucuuauacuacacccaaaugggaagaugcauguauagcggagaacgcauugaacugcgugaccuguuuaacaaaaaucuauacgacaucgaccacauauuucccagguccaaggugaaggacgauagcauagacaaccgaguccucgugaagaagcaaaucaauucucacaaagauaacgacuacccacuggauuccacuguacgggaaaagaugcgcggccacuggcaauaucuucuccgccacggcuucaucucuaaaaagaaauacgaccgccucacccgcgucacgccacugaccgacgacgaacucgcagacuucauagcgcggcaacuuguagaaacuagccaaagcaccaaggccguagccacccuccuaaagacgcucuacccaacaaccgaaauaguguacgucaaagccgaauuaguuucucgcuuucgaacagaauacaaauucauaaaaugccgggaaguaaacgaccuccaccaugcuaaagacgccuaccucaacauuguaguaggcaaugucuacaaugugcgauacacacacuccaaggcaaucuucauuaaaggccugcagaccaagaaguacucucuaaaccgcauguucgcauucgauacccccggcgcauggaacauugaaaaugagaaaucacuuagcauaguaaagaagacggugaugaaaaacaauauacuauacacgcguuacagcuacaugaagaaaggcggccuauuuaaaauccagccacucaagaaaggcaaugggcaggcaccccugaaaaaggaccucccacucucggacauuggaaaauacggcggguacgacaaaccaacggcgagcuacuucucauacauaaaguacgagggcaagaaagggaaagagugccgucaacucguagccauagacaacuaccucaagaaauacuacgaagaaaaccccauugaauaucuaacuaaccggcuaggccucaaaaacccagcaguccucauccccgugaucaaauauaacagcugcauagagaucgacggcuuccgcaugaacauaucaagcaaaucaaacgagggcaaaaccaucguauacaagcccgccguccagcuaguauugggcgcagaaaaagaagccuacgucaaaaagauaucgaaaguccucagcaaaccggaggaacagaaaaucacaaguuacgaugggguaucugccgaagagaacauagagcuauucgacgcauugaccgccaaaaugacgaacacaauauucaaaaucaagcuagaagacaucggcaacaaaaucaagagcgggcgcgauaaauucgucacccuagacguaaagaaacaauguuacgucauaaacgaaauacuaaaaaucaugcacugcaaugucgucacgggagaccuaucccugauaggggcagcaaagaaagccggcaucguauccacgaacucggcccucagcgaaauaaagaaagucuccucgaucaugcuuauaaaccaaucagugaccggccuguucgagacuaaaaucgaccugcucaacaucuga

SEQ ID NO: 6415 - RNA, 3975 nt, Artificial Sequence
  Cas9 variant
augcgcgcaaaaggcaaaacccucauaggcaccagccuauuucgcgaggguaacaccgcggcagaacggcguggauaccgcacaacgcaacgacgccuaaaacgccgcaagcgaagacucaagcuacuagaggcuuucuucgaccccuacaucuucgaaguagacgaaaacuuccucgcccgacuccacgaagcagacauauccccaaaagacgaaaacaaacgauucuggggcucccuacuauuucccaacgaaaaagacgccaauuuuuauaggaaguacccaacaaucuaccaccuccggaaagcgcucauggaggaggacagaaaauucgacguacgagcaaucuuccuggcaauccaucacauaaugaaguaccgaggcaacuuccugucaccccuguccguugacucuuucaaacaggaaggccuggagcucaaagaacaacucgacagacaacuaaagcgcguggcagaacucuacaaugaacucaacaccgaugucaagaucaacguuucagacguagagaccauacaagacaucauaaucgacaaaaacaagagucgucgagacaaagcgggggcccucaagaaacugcuugcagugaguagcgacagaaaagaaauaaacaagcugaacgcaucguuagcaaaagaacuuagcaacgcgauacucggcaugaaagcccaguuugcgaaccuccugcuagccgacgacuuggaaauagacaagaacaagaaaaacuucucccugcuggacacaaacgcggaagaaaacguuucuggccuacuagagcuagugaacgagaagcaggccgagcuuuucgacgccauaaaaaccauccacgaccagauuauccucaacgaaaucguaccggacggaaagagcaucucccaaagcaugguagacaaauaugaggcccaccgcgaacagcuacaaguccucaaggcacucuacgaaaagauggacgccaaacaaaucaaggcaaucaagaaggcauacucacuauauauugacggcaaagaucccaaagccaagaaaguagacaaacgugcacaucaaaaccgcgccgacuucuacaaagaagucaagaaaguccuagucgagcuggacgacucccgcgcugaaaaacuccuaggccuaaucgaaaugggccaauuccuccccaaacaacgaacagcaaugaacggagugauccccaaucaacuccaccagguagaacuggacaaaaucauagaaaugcaaagcaaguacuaccccuggcuagccgaaaagaaccccguaaaaucgcaccaaaagagagcuccuuacaagcuggaugaacuucucacguuccggguucccuacuauguaggcccaauggucacauccaagaaacaacaacaaacuucaaacuccaacuucgcauggauggucaggaaacaagagggggagauaacaccguggaacuucgaagaaaaaguggacaccauagcaucugccaacgacuucaucaaacgcaugacagccaaagacaccuaccucgucggcgaagacguccugccagcgaacucccugcucuaccagcguuauaaaguccucaacgagcuuaacaauauaaaagugaacggccgccgucuaccagucgaauuaaagcgcgaagcauacguagcccucuucgaaaacggagacucgaaaacggucuccgcgaagugcuucaaaaacuggcucaacgucaagcucaagaaccuuaacucucugaaauuggagggauugucaaccggaaccaaauucgacaacaaccucuccacauaucacgaccucaagaaaauuuucggaaaagccgucgacgacgcaggucggcagaaagacuucgagcaaaucaucgaauggcuaacaauuuucgaagacaagaagauccuaagaaucaagcucaaagagauugaauggcugacggaagaaaacauaacccaacugacgcgccucaacuacaacgggugggggcgccugucacgccggcuacucaccggaauaugcgauucgaacggccaacggaucauggacuggcuaugggacaccaccaacaacuucaugcagauccaaucucaaccugacuuccaaaaagcgaucguagaguacaacucugacaaacucgaacaaggcgacauagaacagauacucggagaagccuauacgaguccccagaacaagaaagcaauccgcaaaguaaucaaagugguccaggaugucgaaaaagcgaugggcgcuaagcccacguccaucagcauugaguuuacccgcuccgacggacgcagcgagcugacaaacucacggaugacccaacugcagaaaacacucaugucccucagcgaagaaaugaccgaccaagcgcuccuagcugaguucaaagacuuccaagccagcaagaagaaacuuaccaacaaauacuaccucuacuuuacacaacuuggccgagacauguacaccggugaacccuuaaauauagaccaacugucccucuauuccgacggagaccauauccugccccgcuccuucaucaaagacgacagccuugauaaccgaguauuaacuaaaagagcggugaacaacgaaaagagcgacacgguccccgucugcgaauauggggcaaaaaugaaagacuucuggaacgauuuauacgacaacggccuaaucucaaaacaaaaacuggcgaaccuccuaacugacccggacgaaaucgggccauacaaggcuaacggguucauccgacgccaacugguagaaaccucccaaguaaucaaacucagcgccgaaauccugcagacgcuguaccaagacacgaagauaaucgaaguacggcaaaaauauacccaugagcuccgcgaacacuucaacuucgucaaaauucgccagcuuaacgacuaccaccacgccuucgacgccuaccugacagccuucuccggucguuaccuguaccaaagguauccuaaacuacgcggguacuucgucuacggcgauuacaacaaguucgacgcaaagaaagaccgcaacuaucucaaaucguacaauuuucucuacgaccuagaagaggguaaaaccgaccagauagucgauaacguagaacacaagguauucaugaaccgacaagacgccauaaaccaacuaaagaaagcauacgaauacaaauacauguuagucagccaagaaacauauaccaauagcggggccauguuuaaggagaccaucuaccccgucaauccaaagcagaaguuaauucaaaagaaaaacgacaaacccgucgacauauacggcggauacuccaacaacuacgacgccuaccucuccaucgucaggcuugaagacaagaaaggcauuaaauuucgggucgucggaauccccaugcgcaacaaagcggagcucgacaaccuagccaaagaagaccauaacggcuacaugcaacgccuuaacgaaaucguggacgagcaaaucaacucaagugggaaaaagaaaaccuucagaauuauccuccccaagguccacuuuaagcaauuagucgaagacgacuccgguaaauucaugcucggaucagccgcauaccccuacaacgcaaagcagcuaguccuaagcguaaaguccauagagagccuagcaaacaaggaugccucagaccgcgagcucgucgcaguuuacgaggaaauccuaaacgucgucaacgacaaauucacucuauacgacgcccgacaauuucguaauaaacuuacaagcagcaaagacaaauucguugaacuaaacacagcggacaaaguaacugaacuccucgacauccucgacggccuccacgccaaccccguuguuaagaaauuaaaaauuaucagcggaaguccauucggguucuugcaacgcccauccggaaucguacuaaccgagaacgcuaaacuaauauaccaauccccgacgggaaucuucgaacgagucguauaccugcgcgaccucuga

SEQ ID NO: 6416 - RNA, 3984 nt, Artificial Sequence
  Cas9 variant
auggaagggcaaaugaaaaacaacggaaacaaucugcagcaaggcaacuacuaccucggacuugaugucgguacauccagcguuggaugggccgucaccgauaccgacuacaacguacugaaauuccgcggcaagagcauguggggggccagguuauucgacgaagccuccaccgccgaggaaagacgcacucaccgaggcaaccggcgccgucucgcgcgccggaaauauagacucuuacuacucgagcaacucuuugagaaagagauacgaaaaauagaugacaacuucuucguacgccugcacgagucuaaccugugggccgacgacaaaucuaagcccucuaaauuccuucuauuuaacgacacaaacuucaccgacaaagacuaccuaaagaaguacccgaccaucuaccaccuccgcagugaccucauccacaacuccacagaacacgacauccggcucguauuccuggcucuccaccaccucauaaaauaccgcggacacuucauuuacgacaacagcgccaacggcgacguaaaaacccuugaugaggccgucagcgacuucgaggaguaccucaacgaaaacgacaucgaguucaacaucgaaaacaaaaaggaguucaucaacgugcuguccgacaaacaccuaaccaagaaagaaaaaaagaucagucucaaaaagcuauacggcgacaucacggacuccgagaauaucaacaucagcguccuuauagaaauguugagcggcuccucaauauccuuaucaaaccuauucaaggauauagaauucgacggaaaacaaaaccuaagucuagacagcgauaucgaagaaacccucaacgacgucgucgauauccuuggcgacaacauagaccugcugauacacgcaaaagaaguauacgauaucgccgugcucaccucaagcuuggggaaacacaaguaucucugcgacgcgaagguagagcuguucgaaaaaaacaaaaaagaccucaugauccuaaaaaaauacaucaaaaagaaccaccccgaagacuauaagaaaauauucuccucccccacagaaaaaaagaauuacgccgcauacagccaaaccaacucaaaaaaugucugcagccaggaagaauuuugccucuucaucaagccauauauccgcgacauggucaaauccgagaaugaggacgaaguccgcauagccaaagaggucgaggauaaguccuuccuaacuaaacuaaaaggcaccaacaacuccgucguucccuaccaaauccacgagcgcgagcugaaccaaauacucaaaaacauaguagcguaccuacccuucaugaacgacgagcaagaagacauaucagucguagacaaaauaaaacucaucuucaaauuuaaaauccccuacuacguuggcccccucaacacaaaauccacccgcuccugggucuaccgcagcgacgaaaaaauuuaccccuggaacuucagcaacgugauugaucucgacaagaccgcgcacgaauucaugaaccgccugaucggccgcugcaccuacacaaaugaccccguccucccuauggacucccuucucuacuccaaauacaauguccucaacgaaaucaacccuauaaagguaaacggcaaagccauccccgucgaggucaaacaggcgaucuacaccgaccuauucgaaaacuccaaaaagaaagugacccgcaaauccaucuacauauaccugcugaaaaacgguuauauagaaaaggaggacaucgugucaggaauugacauagaaauuaaaagcaaacuaaagucccaccacgacuuuacgcaaauaguucaagaaaacaaaugcacaccggaagagaucgaacgcauuauaaagggcauccuaguauacuccgaugacaaaucaaugcugcgccguuggcucaagaauaacaucaaaggacuaucggagaacgacgucaaauaccuagccaagcuuaacuauaaggaauggggccgucucucuaaaacccuccuuaccgacaucuacaccaucaaucccgaagacggagaagccugcucaauccuagacauaauguggaacaccaaugcaacccuaauggaaauacugucgaacgaaaaguaccaauucaaacagaacauagagaacuauaaagccgaaaacuacgacgagaaacagaaccuacacgaagaacuagacgauauguacaucagcccagccgcccgccgcucgaucuggcaagcccuaaggauaguagaugagaucgucgauauaaaaaagucagcacccaaaaaaauauucauugagauggcaagagaaaaaaaaagcgccaugaaaaaaaaacgcacggagagucggaaggacacccuccuugagcuguacaagucaugcaaaagccaggcggacggcuucuacgacgaagaacucuucgaaaaacucucgaacgagucaaacuccagacugcgccgcgaucaacucuaccucuacuacacccagauggggcguagcauguacacgggaaaacguaucgacuucgauaagcucaucaacgauaaaaauacguacgacaucgaccacaucuauccccguucgaaaaucaaagacgacuccaucaccaaucgaguucuaguggaaaaagacaucaauggcgaaaagacagacaucuaccccaucucugaggacauucggcagaagaugcaaccguucuggaaaauccuaaaagaaaaaggauuaauaaaugaggagaaauacaaaagacucacacgcaacuacgaguuaacagaugaggagcucucuuccuucguggcccgacaauugguggagacccaacaaagcacaaaagcacucgcaacucuacucaaaaaagaauaccccucugcgaaaaucguauacuccaaggccggcaacgugagcgaauucagaaaccgaaaggauaaagaacucccaaaguuccgcgaaaucaacgaccuacaccacgcaaaagacgccuaucucaacaucguagucgggaacguauacgacacaaaguucaccgaaaaauuuuucaacaacauacgcaaugagaacuacucgcugaaacgcgucuucgacuucuccgucccgggcgccugggacgccaaaggcucaacuuucaacacaauuaagaaguacauggccaaaaacaaccccaucauugccuucgcaccauacgagguaaaaggggaacuauucgaccagcaaauaguaccaaaagggaagggccaguuccccaucaaacaaggaaaggacaucgaaaaauacggcggcuacaacaaacuauccagcgcuuuccucuucgccguugaauacaaaggcaaaaaggcgcgcgaaagaagccucgaaaccgucuacauaaaggacguagaacuuuaccugcaagacccgauaaaauacugcgaaagcguucucggacuaaaggaaccccagaucauaaaaccgaagauccucauggggucacucuucagcaucaauaacaaaaaauuggucguaacgggacgcuccggaaaacaauacgugugccaccacauauaucagcucuccaucaacgacgaagauagccaguaccugaagaauaucgcuaaauaucuucaagaggaacccgauggaaacauugagaggcagaacauccucaauauaacaagcgucaacaauaucaaauuauucgacguacuaugcacaaaauucaauagcaacacauacgaaaucauucucaacagccuuaaaaacgacguaaacgagggccgcgaaaaguucuccgaacuagacauacuagaacagugcaacauacuccugcaguuacucaaagcauucaaauguaaucgggaaagcagcaaccucgagaagcuaaacaauaagaaacaagccggugugauagucauuccccaucuguucaccaaaugcucgguauuuaaggucauccaccaaucaaucacggggcuauucgaaaaagagauggaccuacucaaauga

SEQ ID NO: 6417 - RNA, 3984 nt, Artificial Sequence
  Cas9 variant
augaagaauuacucgauugggcuggacaucggcaccggcuccgucgggugggucugcaucgacgaaaacuaccaaauccuccgcuauaacaaucgagcagccuucggcgugcacgaguucgaaaccgcacacgucgccgaggaacgccguaucaagcguggagcccgccgccgcuacaaccgccgaaagaaacgaauccaacuccuucaaucucuguucgucccacacaugcaacaaaaagccuucuucgccccuacaauaacagaacacuacuggaaaaacgauaaccaauucgaaaaccggacccucagcgaagucuuaaugucccucggcaugaacccgaacacauaccccaccaucuuccaucugcgccacgaacucaucgaaucaagcgucaaaaaggaugcccgucuaaucuaccuagcccuccacaaccuaguaaaguuccgaggacacuuccuccaggagggaucaacauggaacgccaacauguccgacgccaaccuauccgaacaauucgaacaacuacuccacauauacaccgaaauggaggaacucccccaagucucccuuacggcccaacaaagcaccgacgucgaacacauccuucuuaacaaucacaucagcaaagcugaacgagccagacaacuuacagcauuauucgaacgcaccuacgaacccuucuucaagcuaaucguaggacucgauauagcggcggcccagcuguucaagcaauccgagcaacaacuccucuacaaggagagcaaaacaaaagucaaccucacugcggagacacugcccgaaguacuccaaacaaugcuugagccggaagucgccuucaucgaagccguacaacccuucuaucaacaaacagugcucuuugaucuccugaaaggccaaagcuacgucgcagccgcaaaggucgaggcauucaaccaguaugaacgcgaccucgcccuacugaagucaguaauuaaugaagucggcuccgaaaaacaauaccgggcauucuucauuacuuccaagcagaagaaacgacaauucgaacaaaaaccaaacauggagcuccuaugucaccuagaccgcuucaaucgcgagaagaaauaugaggaaacauucuauaaagaagugagcaaacuccucacugcccuuaucaaggaagcgaccggcgaggucaaggagcacauagaacagauuauacaggccauggagagucagagcuuccucgucaaacagaaaggcauccaaaacgcaagcauacccuaccaaaacucccucuacgaagcugaaaugauucuucggaaccagcaagccuacuaccccuggaucaccgacgaguucaucgaaaaagucaaacagcucaucgccuuccgaauccccuacuacauuggaccccugguccaaggcgacgaacaaccauuuggcuggcugcaacgacaagcggacggaaacaucacaccuuggaauuucgaugaaaaaguaaacaaggccgcaagcgcagaaucuuucauaacgagaaugaccaaaaacugcacauaccuuaaggaagaaaagguacugccaaaacaaucccucauguacgaaaaauucacgcuccuaaacgaacugaacucgguacagauccgcucaucccucgaacaaccgcauaaaaagcaccggcuaugcgaagacaugaaacaguggaucauagagcacguguucaaaaagacaaaaaccgucacccacaaaacccucauccaggcacuaaagaaaagcccauacaaagacgagcucuaugacgaaucaacgggcaacuggaaagacgucuacggcacccagaaagaagacagauucgcuagcagccucucgaccuacauuucccucaaagaaauagucggggacauagucgacaacgcauucauggaagaaaucaucuacuggcugaccguguucaccgaccgcgacaucaucacccucaaaaugaacgauaaauacccguucauaaccgaacaacagauccagcgacuucucagucuaaacauaagcggcuggggccaacugucacaaagacuccugcaauccauaccaguggacgacaugaaccgcagugucaucgaauacauggaaaagcacgccgucaacuucauggagcuccuaagcccccgccagucagaccuagccuauaaaaucgagcaagugaacaagcaacacagcaagaagauccacaagaucagauacgaggacaucgaacaacucaccggaucgcccgcccucaagagaggaaucuggcguucaguaaagaucaucgaggaacucacugccauauucggagaacccaaaaauauuaugauagaaguggcgcgggaagaccaagcgucgcaccggacaaagagccgaaaggaacaaugggaaucgaucggaaaaucacuagcaaaggaagagaaagaacuaaaagcauucuucaaagaaauggcccaauacccaaaacagcaguucgacaggacucgguucuggcuauacgucacccaacagggaaagugccuguacacaggaaaaacacuacgccucgaggaccuaucguccuacgagaucgaccacauccuccccaggaauuucguaaaggacgauagcaucgacaaccucgcccucguuuauccuauggcaaaucaggagaagaacaaagcgggcaacaacaagaugccacuugagauaaucgacgccaagcaacaacccgcaaugauggcacacuggaagcggcucaaccaacucaagcucaucucagacucgaaacugcacaaguugaugaaaccuagcuucaacgacguugauaaagagaacuucauugcccgccagcugguagaaacccggcagaucaucaaacacguccgagaucuguuacaagaacgcuucgagcacacagacauacacguugucaaagccaagaugguaagccaauuccgaaaauucucgcggauccccaagauacgagacuacaauaauaaacaccaugcaauggacgcacuauucacaaccguucuuauccaauucauacuccaaaaguacggcaagaacuuccuccaauuugaccuccaacacaaagacaucuccaaaaagugguccaagauagcccaauccaccaaacacuucuuccuuuuccaacaguucgccgagcaacagauaaaauccccaguaacgaaagaacuugugagugggguucaauacuucgagcacaucuucuaugaacaaaguuggcaaacaacuaagaugacccaaacaaucgacaguaauuucuacaaagaaacuauauucagcccaaaauuaaagacagcaaaauacaccucagcaaaagcggaaaaguucguccaugacgcaaucgucaaauaugccgucugcgggauccaauacacgagccucaagaaaaacaaagaacagcaccacguacuccucaccgacauaaacgucaucgaacacuaccaacuaaaagaagcaagccucaacgaacucgcccuccaccuagccaagcgagagagcaaagacgacgucaucgacgcccaaaugcuaguggucauacccaaauacaagaaaauuaugcucaauggguccccauacuacugcauuuccagcgacgagcggcacauagcaacacaauucgucuuacgcaaagaccuacucgaagccgugcuccacguaaacgacgagacuucaguagacgagcuacgaacacuguucagaucgaucgucgaggaaaugaugacucaauacaaaguauacaacaaagacacaauccgcaacaagauagacgcguucaucgagaccgagcucaucgacgucgaaacauuccaagucggguucacagagauaaagaaaauggucgcugcaaacgcgcagagaucggauaaauucggaggccgacuacgccaaguuaugaaaguggaggacaucuacaucauugaugaauccauaaccggacuacgguaccgaaaaccccgcaaacuugucaaauga

SEQ ID NO: 6418 - RNA, 3984 nt, Artificial Sequence
  Cas9 variant
augaagaaaaacuacacgaucggccuggauaucggaaccgccagcguaggcugggcuguccuaaccgaagacuaugagcuaauaaaacgaaaaaugaaaauaagcggcaacacccaaaagaaagcaguuaagaaaaacuucuggggaguccgacucuucgaacagggcgaaacggccgaaggccgccgacuaaaacgaacaacgaggcggcgcauagcgcgacgcaggcagcgaauacaauaucuucgaaccaucuucgacgaaggcaugaaucaagucgacgcaaacuucuucgcgagacucgacgagagcuucagcaucaucgacgagaaagagaacgagaggcaccccaucuucgggaacguggccgaggaagcugccuaccacgaacaauuccccaccauauaccaucugcgugagcaccuagccaacuccagcgaacaggccgaccuacgacucgucuaccucgcacucgcccacaucaucaaguuccgcggacacuuccuuauagaaggcgagcucaacaccgaaaacagcucaguaagcggaacguucgaacaauucauaaaagucuacaacgaaaccuuuaacguagaaaaggcccuagaccucaccguagaccucgacggcaucgcggagcaaaagaucagcagaaugaagcgugcagagcuaauccucagccuauuuccagaagaaaaaucuacgggugacuucgcccaauucaucaagaugauaguaggcaaccaaggaaaugugaaaaagacauucucacuaaaugaggaugccaaaauucaauuuagcaaagaagaguacgaagaaaaccucgagacccuacuagcggaaaucggagaagauuuccgcucagucuucgacgcagcgaaaagcgucuacgacgcgauaagccuggcaaacauacugaagguaaccgacgccaccacacgggcgaaacuaucauccagcaugguagucagauucacugaccacaaagaggaccuaaagacacuaaaacgcuucguccgggagaacuuaccugacgaguacgacgacuuauuuaaaaacaagaaggucgcggguuacgccggcuacaucgacggcaacgaaacacaagaagcguucuacaaauaccuaaagaaaaccuuggccaaagccaccggggcagaaggcuuccuagccaaaauggaacaggaggacuuccugcgcaaacaacgcaccuucgacaacggggucauacccuaccagcuccaccuugaggaacugaaagcgaucaucaagaaccaaaagagcuacuacuccuuccuagaugaggagaaaauaagucaacugaugacguuccgcauacccuacuacguaggaccgcucgccaaagaaaaaggccaauucgccuggcuuacaagaaaggaaaugggcaaaauaacgccguggaaucucaacgaaaaaguagacauagagaaaagcgccaccgacuucguggaaagaaugaccaacaaugacagcuaccugccaauggaaaagguacuacccaaacacagucuccuauacgaaaccuuuacaguauacaacgagcucacgaaggugagauacauagacgacaacggcagagcacaaaauuuuucgagcaaggagaagagacagauuaucaacgaauuguucaaacagcaaagaaaaguaaagaaagaaaugcuggaagcauuccucaaaaaugaauacggaaucgagaauccaaaaguagaaggaaucgaaaaauccuucaaugccugccuggguacauaccacgaccugauuaaacuugguauacgucccgagcuguuugaacaacccgaacaugagcagcaguucgagcaaaucgucaaaauccugacaguguucgaagaccgaaagaugaggcgaaagcaguuggaaaaauucuccaacauccuaaccgaagaagaacaaaaacaacuagaaagaaagcacuacaaaggcugggggcgccugagcgcgaaguugauccacggcauugucgaccagaaaacacagaaaaccauacucgacuaccuuaucgacgacgacgaucuccccaaaaaccguaacagaaacuucaugcaacuaaucaacgacgagaaccuauccuucaaagaagaaaucgagaaaaucgcauucgacaacgacaaaucgaccgaagaaaucguacaagagcucgccggauccccagccaucaaaaagggcauacugcaaagccugaaaaucgucgaagaaaucauagacaucaugggagaacuacccacaaauauagugguagagauggcccgagaaaaccaaacgacagcccagggcaaccgcgcaucgaaagcccgaaugaaauaccucgaggaauccaucaaaaagcucggcucaucgauacuugaagacgaaccaaucagcaaagacgcgaaccugcuacgcaacgacagacuauuccuguacuaucuacagaacggaagagacauguauaccggcaaugagcucgacaucaacaaccucucgucauaugacaucgaccacaucgucccccagagcuucgucaaggacgacuccaucgacaaccgggugcuuacaacaagcucgaugaacagaggaaagagcaacacagugcccgcugaaucggucgugaagaaaaugcgccccaccugggagcgucuacuagccagcggacugaucagcaaaaagaaauucucauaccucacaaaggccacaaacggcggcuugacggaggaagacaaagcccauuucauacaaaggcaauuaguagaaacccgacaaauaacgaaaaacguggcccaaauccuccaccaaaaguacaacaacgagcaacuaagcgaaaaaccgguacgcgucauaacccuuaagagcgcacucgcaagccaauuccgaaaagacuucucccucuacaaaauaagagaacuaaacgacuaccaucacgcgcaggacgccuaccucaacggcgucauagcccaagcauugcugaaggucuacccaaaacuagagcccgaguucgucuacggugaauaccaaaagguguccauccgcgcgcucaacaaagccacugccaagaaggaguucuacucgaacauaaugaacuucuuuacgagcgacgaaaugguugcgaacgaagaaaccggggaaguccuguggaacagacaacgcgauaucaaaacaauaaagaaagucaugaacuaccaccaaaugaacaucgucaagaaaguagagauacaaacgggcgcauuuacgaaagaaucgauccucccgaaagggcccagcaaaaagcuaauagcacgcaaaaacaacugggcgccgguaaacuacgggggcguggacucgccgaccgucgcguacuccgucauaauuacccacgagaagggcaaagccgcaaaaguaguacagcaacucguaggaauuaagaucuuagaaagacaggcuuucgagcaggacgagguagcguuccuugaggaaaaaggauuuauccacccgaaaguacaacuaaagcuacccaaauacagccucuaccaguucgccgauggcaggagaaggcuauuagccagcgcagaggaaucccaaaagggcaaucaaaugguacugccuguacaucucauagaacuucucuaccacgccaagcacguauccgauagcaguggcaaaucccuugaauaccugaacgaacaccgacacgaguucgccgagcuccuggaagcaauacuucaguucacggaacaguacauugacgccgggaagaaucagaagaaaguccgcgaccuauacgagaaaaaccaggacgccgacaugcgggaacuugcgagcaguuucauccaacuccuccagcucaauaaacaaggcgccccagccgacuucaaauucuucggagagacgaucccgcgacgacgcuacaaaaacaccgcagaaaucgucgacgcaaccuucaucaaccagagcaucacaggacucuacgaaacacagaagcgccucguguga

SEQ ID NO: 6419 - RNA, 3984 nt, Artificial Sequence
  Cas9 variant
augacagaacaacaacagccauacaacaucggccucgacauaggcacaucguccauaggcugggccguaacggaccaaaacgacaaacuacugcacauccgaggccauaacggcaucggugugcgacucuucaaagaaggagaguccgcagccgaacggcgcggguuccgaaccacgcgccguagacuaagccgccgccgcuggcgacuccguuuccuagaccgcaucuucgacgcggaacucgcaaaaguggauccaaacuuccuugcccgccugaagcaauccaauaucaguccucucgacccaaacaaacagauguuugggaacauccucuucgaugacccccaauucgacgaccagaaauuccaccagcaauacccuaccaucuaccaccuccgaagcgcccucgcacagccagacgcaccccaggcagacguaaggcucaucuaccuggcgcuccaccacaugaucaaguuucgcggacauuucuuaaacggcgccgccgucgaaaaauuccacggcggccaacuacaccuagagagcgaguuccaagagcuuaaccaaaucuuuagcaaccaacaacgagaccacgugcaacuccaaaccucuagccuugacgaagucgccaccauccucaaagacaaccaacggacccccagugacagacaacgcgaacuaucagcgcgacuguuuguccccguagacaaaacgauugacaaggaaaacaagaaacuugccaccgaacugcucaaagcgguccucggccuaaaagcgaaauucgacguaauccuuggugucgaagcaaccgacccccaagcauucaaacuacaauuuuccagcgacgauuucgacgacaaaauagcagagcucgccagcgaacugacagacgaggcuaacgagauccucaccguccuccaacgacuauacuucucgcuaaaccucgcagacauccuuaccaacaggcaaacaaaacaagucgcugauucgaucucgaccgccaugaucaaccgcuacgacgaccacaagcaccaccucaaaaugcuuaaggagcucgaagcacaaguuacccaggaacaacgcgacggcuuaaagaaagccuauaacgaauacaucgacggagacaaaccuacgauugacacauucuacacaaacgugaagaaaaaucuggacgauucggaacuugcuaaccaaauaaaaagucuuauagaccuacaagcauucaugccgaaacagcgaagcaaagaaaacggcagcaucccccaccaacuccaccaacgagaacucgaucaacuuaucgaaguccagggcaaauacuaccccuggcuccuugccgccaaagacaagcucgaugcccugaucgcuuucagggucccauacuacguaggacccaugaucgauccgaaccaaagcgacgacccccaaaacaccaaauuugccuggaugguaaggaaggaagcaggagaaauaacccccuggaacuucgaagagaaagucgacaaaaccucaagcgcaacaaacuucauaaaacgcaugacaacgacagacacauaccuccuaggugagccuguccuucccaaaaacucucuucuuuaccagcaauucaccguccuuaacgaacugaacaaauuaaaagucaacggcaaagcacucacaguagaccagaagaaauaccucuacgaucacgucugcaagaaacaacgacgcgucacccucaagaaacuuuccgacugucucguggcgaggggcgacuuuccaaugggggcgauauucacagggacgacagaccagaaaaacaugaacaauacacuaaaaacguaccaagacuuccaggagaucuucggcgacgagauagacaacccagaccgacagguggacuucgaaaagaugaucgagugguccacgauauucgaagaccgagaaaucuucaaacucaagcuagccgagcucaauuggcucacgagcgagcaacucgagcgcgugaguaagaaacgauaccaaggauggggacgucuaagccaaaaacucuugacccauaucguaaacgagaacggcgaaagaaucauagaucaacuguggaacacgaaccaaaacuucauggagauuaugggacaagacagcguuaaacaagcaauccaagaacacaauggcgccaacguagcccaaacaggcaucaacgagacaaucgacgaacuauacaccagcccgcagaauaagaaagccauucgccagauacuucucguaguugacgauauaaagaaagccgugggcuacgcacccgccaacauaaugauggaguucgcccgagaagaccgagacgaucaccgccucaucgccucccgagcacggcagcuggagaaaaccuaccaagaaauuuccaaaaauugguucgacaacgaauccguaacccaagaacucaaagaccagauuaaaaacaaaaccaaauucacugaucgacucuaccucuacuucauacaaggaggcaucgaccucuacacaggccacccccugaacauagaccagcugagcuccuacgacaucgaccacauacucccgcaauccuuccucuuagacaacucgcuaaacaaucgaguacugaccagccaagcggagaaucgcguccacaaagaagaccggcuccccggcgaaaccgucgcaaacaaaaugcggcccaccuggaaaaugaugagagaacaaggucucaugacacagcguaaauacaacaaccucacacuaaaacccgaccagaucucaaaguuuaacaauagaggccaauucauaaaccgccaacuuguagaaacccgacaagucaucaagcucgccgcagacauaaugucccagaaauaccaagccgaucaaacgaaagucgucacaguaaaagccaaccucacccaccacaugcgcgagaaguucaauuucuauaaaucacggaacgucaaugacuaucaccacgcguucgacgccuaccuaacccucuucgucggaaacuggcuccucaaggaauacccuaaacuccaacccuacuucguauauggugacuucgcgaagacggguaccaacaaccuuaaguccuucaacuuccuauaccgauucgagcgcgaucacaaacuuaacgacaagggcgccaucgauaccgacaaagaccaacaacuaggcuacaugaaacgcaucuaucgcuucaagaaaaugcucguuaccaaacaacuagaaaccaacgaaggagcucuguacggacaaacucuauacccagcacccaagaaugacaagaaaacccggaaccugaucaacaguaagaaaaaccgacccagcgacaucuacggcggcuacagcaacgaaaacggcagcuuccuuacgcucgucaaacugaagaaaggcuccaaauacgacuaccgacuggucgccgugccaguaucaaaaauaagcgaaauuaaagagagugaacucgccaccaucgaaaaagccauagcgccccaauuccugaaaagcucaggcaaauaccgcgacuuccaagucguacucucaaaaauacuuauaaaccaaaaggucaucgacgauggcaugauauucacuauagguagcaaaucguacaaacacaaugccaaacaagucguguugucggacaacucaauacagauagucucgacccuaucccgaauaagcgacaaggaaaaacugauuacuguguucgacgaaaucguagacaucaccuccaaauaccucccaugguacaaagucaacgaugucgagaaaacaaaaaugcuauucagacaaaugcaagacauagacgagaugaagaaaauaaucgacaacucgcucaucggccuacacuguaacgccuccaucacagacuuagggaaagucggccuuagcaaauacuggggccgguucguccugaccgccgggauuucccucacagucgaugcccaacucauauaccaaagccccacaggccuuuucgaacaccgcgugaaagugucggaccucuga

SEQ ID NO: 6420 - RNA, 3990 nt, Artificial Sequence
  Cas9 variant
augaacaagcagccguacaacaucggacuggacaucggcaccagcagcgucggcugguccgccaccgaauuggacaaccggcuccuacacauaaaaggccacaacggcaucggagugcgacucuucaaagaaggagaaucagccgcugaccggagaggcuuccgcacuacgcgcagacgccucgcaaggcgcaaauggcggcuccgucuauugaacgaaaucuucgccacagaaauagcaaaagucgaucccucuuucuuugcgagacucaaacaauccaacguuucccccaaagaucccaacaaaacaauguuugggaacaucuuguucgacgacgaaaaccuggacgaccagaaauuccaccaugacuacaagacgaucuaccaccuacgccaagcaaucaucaaucaccccgaacagaaauucgacauccggcucauuuaccuagccaugcaucauaucaucaaauaccgcggccacuuccugaaccaggcaaacguccaggacuuuaaaggaggcaaaauagaccucgaaaaaucauucaaagcucucaacgacauauucgagaaccaaggacgugaccuccgccuggucacagacgaagccaaccaguaugugaagguucuauccgacaacgccaagacccgcucugaccgcaagaaagaacuuucuaaguuacuauacguacccaucgacaaagauaccgacaaaaacucgaaaaaggucacgggugagauccuuaaagcaauacucggcaauaaagcgaaauucgauguuaucuuuggcaucgaggucgaaaaccccaaggaauggguccuaaccuucaacagcgacgauuucgacgacaagauagaaggacucucaucacaaaugaccgacgaggacuccgagauccugcuaauucuuaaggagcuauacuucgcccucaacuuauccgacauccucaacaacuccgucacggacaaaaacgccaagacgcuauccgaagccaugaucaacagauacgacgaccacaagaaccagcuagcaaugcuaaagaaaguaauagacucaucagacaaaaagcacgcaaaagaacuaaaggaggcauacuccgccuauauagacggcgagaacaauaagaagauauccuuugaggaccucaagaaacggauucaaaagaaccuggucgacuccgagcugucccagaaaauaaaugaccuccuagaucaugacuacuuccuaccaaaacaacgcucaaaagagaacggcgcaauaccccaccaacuacaacaacaagagcuugaucagauaauagaaagccagaagcaguacuacccuuuccuugccgaacugaauccuaaugaaaaacgcagccgccaggccaaauauaagcucgacgagcucgucgcguuccgcguauccuacuacguaggccccaugguagaggucaccgauucaaaccaagagaacaauggcaaauucgccuggaugauucgaaaggaacaaggggaaaucacccccuggaacuucgaugaaaaggucgaccggaccgagacggcaacgaaauucaucacacgaaugacgacuaccgacacauaccuaaucggagaacccguccuacccaaaaacucacuucucuaccagaaguucguagugcugaacgaacucaacaaccucaaaaucaaccaagaaaccauaaccccaggccaaaagcaauacuuauaugaacacguaaugaagaagaacaaacgcguuacauuaaagaaaauagccgacgcccuugucaucaaaggagauuauccguacgccccagagguaaaaggcaccaccgaccagaagaaccucaacaacggccuaacuacauacauagaccucgccaaaaucuucggcaacgaacucgacgacguggacagagaggccgacuucgagaaaaucauugaauggucaacuaucuucgaagaucagcacaucuucgucuuaaaacuccaggaauugaaguggcucacagagaaacaacgcaaccaaguagucaagcuccgcuaccaagguuggggaaaacucagcaaagaacuacucgcaggccuaguggacgauaacggccagcggaucauagacuuacucugguccgauaaccaaaacuucaugcaaaucgucaaccagaaguccuucaaagaauccaucgcggaccacaacggcgcccaccucgaagagaaaaacuuaaaagacguaaucaacgaucuuuauaccagcccccagaacaaaaaggccauccgccaaguaauucuaguagucgacgacauaauaaacgcagugggcuacgaaccugcgaacaucaugauggaguucgcccgagaagauuccaacgaccaccgacucacaaacucgcggagccgacaacucgaaaacgucuacaaagacauuacgaauagcugguucgacaacgacucaguaaaagacgaacucgaagacaagaucaaaaauaaagacaaguuuacugauagacuguaccuuuacuucacccaaggcggcaaagaccucuacacgggggagccacucaauaucgaugaccuaagcagcuacgacaucgaucauauacucccccaauccuucauccuagacaauucccucgacaaccgagucuugaccagccagcgcaauaaccgagugucuaaagaagaccaacugcccggcgaacuauucggaaccaaaaugcaugccuucuggaaacgccugaaagccgcccaccucauauccaacaagaaguauuacaaccuaacacuaacccccaacuccaucucuaaauucaauaaccaaggaagguucaucaaccggcagcucguagaaacacgacaaguaaucaagcuagcggcggagauucuccauaaccgguacagugaagaaaaagggaccaacaucgucacuauaaaagccaaucucacccaccacaugcgcgaaaaauucaacuucuacaagaaucgaaacguaaaugauuaccaccacgcauucgacgccuaccucacggcguucguggguaacugguuacuccaacaauaccccaagcuaaaacccuacuucgucuauggagacuucgccaagaccgaaauaaacaaccuuaaaucauucaacaugcuauacaaauucgaacaagcucaccaacugaacgaaaaggauggaaagauagccaaggacacagacgcccuccucggcuacaugaaaaacguauaccacuucaagaaaaugcugguaacaaaagaacuagaaacaaaccauggagcccucuucaaccaaacccuauauccaucaccagcccacgauaucaagaaacgccagcucauaaaaccgaaagacaaccgccccacagacaucuacggcggauacacccacgaggaacggaaauacaugucccuuguaaagguaaucggaaagaaagacaacgaauaccggauggcaaacgugccccuucuaaaaaucaacaaaaacaacgacauaaaagagauacucaaaucacaguuuucuaacaagaaauucgaaauaguacuccccaaagugcucaaaaaccaacucuucuccgaaaacggagcucuuuucgugauaggguccaaaggcuacaaguacaaugccaaccagcuagugcuauccgaccuggacaugaagcuacuaaacgacuugucaaacaacaaguccaucgacgaagugaccauaaaucaacuauucaagaauaucgucgacagcacaaacaaguauaugccucucuacgaaaucaaaaaucucaacgaggugguagagaaguucaacaaccucgaguucaacgacaagaagaaaacaauaacagacuuccuccuugcaacacacgccaaccccacaaugagcaaccucaaaaacauaggacugccauacuuuggccgcuucauacgcaacacaggcaucaaacucucggaaaacgccaacguaaucuaccaauccccuacgggccuuuucucccggaaaaucaaaauaucggacuucuga

SEQ ID NO: 6421 - RNA, 3993 nt, Artificial Sequence
  Cas9 variant
augaaaaacgacuacacuauaggccucgacauaggaaccaauucggucggcuauucugucguuaccgacgacuacaaaguaaucucuaagaaaaugaacgucuucggaaacacugagaagaaauccaucaagaaaaacuucuggggaguucgacuauuugaaucagggcaaacagcccaagaagcacgcaugaaaagaacaagccgccgucggaucgcacgcagaaagaauaggauaugcuaucuacaagaaaucuuccaaccagaaaugaaccaccuggacaacaacuucuucuaccgccucaacgagucguuccucgucgcggacgacgcgaaguacgacaaacacccuauauucggcacccuagacgaggaaauacacuuccacgaacaguucccaaccaucuaccacuugcgcaaguaccucgccgauggcgacgagaaagccgaccuacgucuaguauaccuagccauagcccacaucauaaaauuccgaggcaacuuccugaucgagggcgagcugaacaccgagaauaacucugucauagaacuaagcaaaguauucguccagcuauacaaccaaacccuauccgaacucgagggcuuccaguucauugacgaaaguauagacuucucagaagucuugacccagcaacucuccaaaagcgaacgcgcagauaacguucuaaaacucuucccagacgagaaagguacaggcaucuucgcccaauucauuaagcucaucgucggcaaucagggcaacuucaaaaaggucuuccagcuugaagaggaccaaaaacuccagcuuagcaccgacgacuacgaggaaaacauugaaaaccuacuagccaucaucggagaugaauacggcgacaucuucgucgccgcacaaaaucuauaccaggcaauacuccuggccggaauacugaccagcacagagaaaacccgcgcuaaacucagugccagcaugauccagcgcuacgaggaacacgccaaggaccuaaaacuacucaaacgcuucgugaaggaacacaucccagauaaauacgccgaaaucuucaaugacgccacaaagaacggguacgcaggauauaucgacgggaagacaaaagaggaggaguucuacaaauaccucaaaaccacccuaguccaaaaaucugguuaccaauacuucaucgagaaaaucgaacaggaaaacuuccuccgcaagcaacguauauacgacaauggcgucaucccccaucaaguacacgcagaggaacuccgagccauacuucguaaacaggagaaauacuacucauuccucaaagagaaccaugagaaaauagaacaaaucuuuaaggugcguauacccuauuacguggggccgcucgccaaacacaacgaacaguccagauucgccuggaacauccgaaaaagcgacgaaccuauccgcccguggaauaugaaugacgucgucgaugaaaacgccucagccguagccuuuauagaacgaaugacaauuaaagacauauaccuaaacgaaaacgugcugccgcgccacucacucaucuacgaaaaauucacggucuucaacgaacuaacgaagguacuauacgcggacgaccgaggcguguuccagcgauucucagccgaggaaaaagaagacaucuucgaaaaacuauucaaauccgaacgcaaagucaccaagaagaaacuagagaacuaccuccgaaucgaacuaucgauaucgagucccucggucaaagggauagaggagcaguucaaugccaacuucggcacauaccuggaucugaagaaauucgacgagcuccaccccuaccuugacgacgagaaauaccaggacacccucgaagaagugauaaagguacucaccgucuuugaggaccgauccaugauccaaaaccagcucgaacaacucccccucaaucugagcaccaaaaccauuaaagcccucagccggaggaaguacaccggauggggccgccuuucagcccgccuaaucgacggcauacacgacaagaacagcggcaaaacaauccuggacuaccucaucgaggacgaaagcgacuccuacaucgucaacagaaauuucaugcaacucauuaaugacgaccaccuuagcuuuaagaagauaauagaagacucccagcccuacaaagagcagcaauccgcggaagaaauagucucagaacucaguggauccccggccaucaagaaaggcauccugcagucccuaaaaaucgucgacgagcucguagccaucaugggguauaaaccaaagaacauagucgucgaaauggcccgggaaaaccaaacaaccggucgaggcaaacaaaacagcaaaccccgccuuaaaggaaucgaaaacggccuaaaagaguucuccgacucaguacucaagggcagcagcaucgacaacaaacaacuucaaaacgaucgacucuaccuuuacuaucuccaaaauggaaaagacauguacaccggccacgaacucgacaucgaccaccucagcaccuacgacauagaccacaucaucccacaauccuuccucaccgacaacucaaucgacaaccgggugcugacaacuucgaaaucuaacagaggaaagucagauaacgucccaucggaggaaguagugcgaaaaauggaucguuucuggcggaaacuccucaacgcuaaacuaaucuccgaaagaaaguacacaaaucucacaaagaaagaacucacggagucggacaaagcggguuuccuaaaacgucaauuaguagagacacgacaaaucaccaaacauguggccaccauacuugacucaaaguucaacgaagacaguaacaaccgugacguacaaaucaucacccucaagagcgcccucguaagugaguuccgcaaaaccuucaaccuguacaagguccgggaaaucaacgaccuacaccacgcccacgacgcguaccucaaugcgguaguagcacuaagccuccuacgcgucuauccgcaacuaaagccagaguucguguacggcgaauacggaaagaacucaauccacgaccaaaacaaagcaaccaucaagaagcaauucuacucaaacaucacccgcuacuuugcgucaaaagauuacauaauuaacgaugacggcgaaauccuauggaacaaacaagaaacaauagcccaaguuaucaagacccuaggcaugcaccaaguuaacguagucaaaaagguagaaauccaaaaagggggauuuagcaaggaauccauccaacccaaaggagaaagccaaaaacugauucgucggaaacaacaauggaacacaaagaaauacgggggauuugacucacccgucguugccuacgccauccuccucagcuucgacaagggcaagagaaaggcgcgcagcuucaaaaucgucggcauaacaauacaggaccgcgagagcuuugaagguaacccgauccuauaccuaagcaagaaagacuaccauaacccgaaaguagaagcaauccuccccaaauacuccuuguucgaauuugaaaacggucgccgcagaaugguugccagcgcaagcgagacacaaaagggaaaccaacuaaucauacccggacaccucauggaacuucuauaccacagcaagaaaaucaucaacgggaaaaacucagacucagucuccuauauacaaaauaauaaggaaaaguuccgugagauauucgaguauaucguggauuucagcaguaaauacaucagcgcagacgcgaaccuaaacaaaaucgagaaaaucuucgaaaacaacuuccacaaagcaagugagcaggaaauagccaaauccuucauaaaucuccucaccuucaccgcgaugggcgcccccgccgacuucgaguucuucggagagaaaaucccacggaaaagguacgugagcaucucggaaauaaucgacgcugucuuuauacaccaauccaucacaggccucuacgaaacgcgcgucagacucaccgaaguauga

SEQ ID NO: 6422 - RNA, 3993 nt, Artificial Sequence
  Cas9 variant
auggaaaaagaguacacgauaggacucgacaucgggacuaacucggucggcugggccguacuaaccgacgacuaucgccucgucgcccguaaaaugucuauacagggcgauagcaaucggaaaaagauaaaaaaaaacuuuuggggggcccgacucuuugaagagggcaaaacagcccaauuccgaaggaucaagcgaacaaaccgccgucggaucgcaagacgacgucagcgaguccuagcccugcaagacauauucgccgaagaaauccacaaaaaagacccuaacuucuucgcucgacucgaagaaggcgaccgaguggaggccgacaaacguuucgcuaaauuucccguguucgccacacucagcgaggaaaaaaacuaccaccgccaguaccccacaaucuaucacuuacgccacgaccuagcgaauucaaaagaacaagccgacauaagacucguauaucucgccauugcacauugccucaaauaucgaggccacuuccucuucgaaggcgaacucgacacggaaaacaccagcgucaccgagaacuaccaacaauuccugcaagcauaccaacaguucuucccagagccaauaggagaccuagaugacgcaguaccaauccucacagaaaggcuauccaaagcgaaacgcguagaaaagguccucgcuuauuacccgucagaaaaaucgaccgggaauuucgcacaguuccuuaaacucauggucggcaaccaggcgaacuucaaaaagacguucgacuuggaggaagaaaugaaacugaauuucaccagagacugcuacgaggaagaccucaacgaacuccucgaaaagacaagcgacgauuaugccgagcuauuucucaaagccaaaggcgucuacgacgcgauccuccucucccagauacugagcaaguccgacgacgaaaccaaagcuaaacuaagugcuaacaugaaacuacguuucgaggagcaccaacgcgaccucaaacaacucaaagaacugguacgcagggaccuaccgaaaaaauacgacgacuucuucaaaaaucgaucgaaaaacggcuaugccggcuacguaaaaggcaaagccacacaggaagacuucuacaaauuccuucgcaccgaacuugcuggccuugaagagucacagagcauaauggagaagaucgaccuggagauauauuugcucaaacaacgcaccuucgccaacggagucauaccccaucagauccaucuagucgaaaugagagaaauaauggaccgccaaaaacgauucuacccauuccucaaaggcgcacaggggaagauagaaaagcuucucacguuccgcaucccuuauuacgugggcccacucgcccaagagggacagucccccuucgccuggauaaaacgaaagucgcccucacaaaucaccccguggaauuucgccgaggucgucgacaaggaaaacucagccaucgaauucauagaacgaaugaccaaccaggauaccuaccugcccaaggaaaaaguacucccuaagcaaagccuaaucuaccagcgcuuuaugaucuucaacgaacucacuaaaguaucguauacagacgagcgcggcaaaucccacuacuuuucaagcgaacagaagagaaagauauuuaacgaacucuucaaacagcacccucgcguaaccgagaaacaacuccgcaaauuccuagagcugaacgaacaaaucgacucuaccgaaaucaagggcauagaaacaagcuucaacgcaucauacuccacauaccaugaccuucucaagcuaucugaucaaauggauacgcuacuagacgaccccgacaugaccacgauguucgaagaaauaaucaaaauccucacaaucuuugaagaccgagaaaugauacgcgaacaacucaagcccuacgaaaccguacuuggccuaccggccauaaaaaagcuugcaaagaagcacuacacaggauggggacgccucagcgaaaagaugauucaagggaugcgcgaaaagcagagcaggaaaacgauccuagacuaccucauugaugacgacgacuuucccuguaaccgcaaccgcaacuucaugcagcugauaaacgacgaccaccucaguuucaaagaaaccaucgccaacgaacucaucauguccgacuccaacguccuacuugaccaagucaaggccauuccaggcucgccagcaguaaaaaaaggcaucuggcaauccaucaagauuguggaagaaaucauagguauaauaggcaaagcaccaaagaacaucgucauagaaauggcccgagagaaccagcgcacgagccggagccgaccacgacuuaaggcccuagaagaggccuuaaaaaauauagauuccccccuucucaaagacuacccgaccgacaaucaggcucuacagaaagaccgacucuaccucuacuaccuacagaacggcaaagacauguacacaggugaaccacucgaaauccaccgucucucggaauacgacaucgaccacaucaucccccgaagcuucaucgucgauaacucacucgacaacaaaguccucguaaguucgaaggucaacaggggaaagcucgacaacgcgcccgacccccucgucgucaaacgaaugcgaucccacugggaaaaacuacaucaagcaaaacucauauccgacaagaagcuggcaaaccucacuaaacagaaccucaccgaggccgacaaagcccgguucauccagcgccaacuugucgaaacucgacaaauuacaaaacacgucgccaaucuucuacaccaacacuucaaccugccugaagaagucucggccaccgaaaagacaucaauaauaacccucaagagcacgcuaaccucccaauuccgacaaauguuugacauuuauaagguacgagaaaucaaccaucaccaccacgcgcacgacgcuuaccucaacggcgucguagcuaugacccuacuaaaaaaguaccccaaacuggcacccgaauuuguauacggaucguauauaaagggggacaucaaccagauaaacaaagccacagccaagaaggaauucuauuccaauaucaugaaauuuuucgaguccgaagagaucaucugcgacgaacaaggcgaagucaucuggaacaaaaagcgcgaccugucgacaauaaaaaagaccaucggcgcacaucagguaaacaucgucaaaaaagucgaaaaacaaaagggaggcuucuacaaagaaaccaucaacuccaaagccaaccccgaaaaacuuaucccaaggaaagcuucccucgacccccuuaaguacggagguuacgggagcccccuugucgcauacacgguaauauuuauauucgagaaaggaaagcagaaaaaagucacaaagggcaucgaagggaucacggucauggaacaacuccguuucgagcaggacccccgcgaguuucuaaagaccaaaggcuacgaaggcgucaaacaauggcucauacucccaaaguacauacucuucgaagcccagggcggauaccgacggaugauagccucccaccaggaaacacaaaaggccaacucgcucaucuuacccgagaaccugguuacccuacucuaccaugccagacacuacgaugagaucaaucauaaagucucauucgacuacguuaacgcgcacaaggaaggauucaacgacauauuugacuucauauccgacuuuggaguccgguacauccuugcgccccaacaccuggaaaaaaucaaggucgcguacgaaaaaaacaaagaggucgaccucaaagaaaugauugacgcgauacugagccucuugaaguucacguuauucggagccuccgucgaguuuaaguucuucgacauaaagauccucaaacgguacaaaucccucacggacaucugggaggccacaauaaucuaccagucaguaaccggccuguacgagcgacgaguagaggugaggaaacuaugggacggcgagcgccuguga

SEQ ID NO: 6423 - RNA, 3996 nt, Artificial Sequence
  Cas9 variant
augaacaagcaaccauacaacaucgggcuugacaucggcaccuccuccguagguugguccgcaaccgaacucgacaaccgcuuacuccacaucaaggggcacaacggaauaggcguacgucuuuucaaagaaggagaaagcgccgcagacaggaggggcuuccggacaacaagacgccgccucgcccgacgaaaauggaggcuuaggcuacucaacgagauauucgcaacagaaauagccaaaguugacccauccuuuuucgcccgccucaaacagucaaaugugucccccaaggaccccaacaagacaauguucgaaaacauccucuucgacgacgagaaccucgacgaccaaaaauuccaucacgacuacaaaaccauauaucaccuuagacaagcaauaauaaaccaccccgagcaaaaauucgacauacggcugaucuaucuagccaugcaccacauuaucaaauaccggggccacuuccuuaaccaagccaacguacaggacuuuaagggcgggaagaucgaccuggaaaaauccuucaaagcucuaaacgacauauuugaaaaccaaggcagggaccugcgccuagucacagacaaagcaaaccaguacgucaaaguacuauccgacaacgccaagacccgauccgaccguaaaaaggagcucucaaagcuccuauauguccccaucgacaaagacaccgacaaaaacuccaaaaaggucaccggggaaauccucaaggccauccuuggcaacaaagcaaaauucgacgugaucuucggaaucgaagucgagaauccgaaagaaugggugcuaaccuuuaacuccgacgacuucgacgacaaaauagaaggccuuagcucacagaugaccgacgaagacucggagauccugcuuauacugaaggaacucuauuuugcacuuaaccucagcgauauccucaacaacucaguaaccgauaagaacgccaagacccuauccgaagcaaugaucaaucgauacgacgaccacaaaaaccagcucgcuaugcuaaagaaggucaucgacucguccgacaaaaagcacgccaaggagcucaaggaggcauacucagccuacaucgauggcgaaaauaacaagaaaaucuccuucgaagacuuaaagaaacgaauccagaaaaaccuagucgauagcgagcucucccagaaaaucaacgaccuccucgaccacgacuacuuccuuccgaagcaacgcucaaaagaaaauggcgccaucccccaccaacuacaacaacaagaacuagaccaaauuauagagagucaaaaacaauacuacccauuccuggccgagcucaacccaaaugaaaaacgcagcaggcaagcaaaauacaaacuagacgagcuaguagccuuucgcguaccauacuacgucggcccaauggucgaaguaaccgacucaaaccaagaaaacaacgguaaguuugcauggaugauucgcaaagaacaaggcgagaucacgcccuggaacuuugacgaaaaagucgaccgaaccgaaacagccaccaaauuuaucacgcgcaugacuaccaccgacacguaccuaauaggggaaccgguccuacccaaaaacucccuccucuaccagaaguucguaguacuaaacgaacucaacaaucuaaaaauuaaccaggagauaauaaccccaggccagaaacaguaccucuacgaacacgucaugaagaaaaauaaacgcguaacccuuaagaaaauagcagacgcacugguaaucaaaggggacuaccccuacgcgcccgaagucaaagggaccaccgaccagaaaaaccugaacaacggacucaccacguacaucgaccucgccaaaauuuucggcaacgaauuagaugauguagacagggaagcugacuucgagaagaucauagaaugguccaccauauucgaagaccaacauauauucgcccuuaaacugcaagagcucaaauggcucaccgaaaaacaaaggaaccaggucguaaaacuaagguaccaggguugggggaaguuauccaaagaacuccucgccggccuggucgacgacaacggacagcgaaucaucgaccuccucuggagcgacaaccaaaacuucaugcaaaucgucaaccaaaagagcuucaaagaguccaucgccgaucacaacggggcgcacuuggaagaaaagaaccucaaagacgucaucaaugaucuauacaccucaccccagaacaagaaagcgauacgccaggugauccucgucguagacgacaucaucaacgcagucggcuacgaaccggccaacauaaugauggaguucgcacgggaggacucgaaugaccaucgccugacuaacucccgcucccgccagcucgagaacgucuacaaagacaucacgaacucaugguucgacaacgacagcgugaaagacgagcuggaagacaaaaucaaaaacaaagacaaauuuaccgaccgccuuuaccuuuacuucacccaaggagggaaagaccucuacacaggggaaccccuaaacauugacgaucucagcuccuacgacauugaccacauccuaccucagucauucauucuugauaacagccucgacaaccgaguguuaacaucccaacgcaacaaccgcguuucuaaagaagaccaacuaccgggggaacucuucggcaccaagaugcacgccuucuggaaacgucuuaaagccgcccaccuaaucucaaacaagaaauacuacaaccuaacccuuacccccaacuccauuuccaaauucaacaaccaaggcagguucaucaaccgacaacucguggagacacggcaaguuauaaaacuggcagcagaaauacuacacaaccgcuacucugaggagaaagguacaaacauagugacuauaaaggcaaaccuaacccaccacaugagagagaaguucaacuuuuacaagaauagaaacgucaacgacuaccaccacgcauuugaugccuaccuuacagcauucgugggcaacuggcuauuacaacaauaccccaaacucaaaccuuacuucgucuacggcgacuucgccaaaaccgaaauaaacaaucuaaaguccuucaauaugcucuacaaguucgaacaagcacaccaacuaaaugaaaaagacggcaaaaucgcgaaggacgcagacgcuuuacuaggcuacaugaagaacgucuaucacuucaaaaagaugcuugucacuaagaaacucgaaacaaaccacggcgcucuuuucaaacaaacccucuaucccuccccagcgcacgacaucaagaaaagacaacuuauuaagcccaaggacaaccggccaacugacauauacggcggcuacacccacgaagaacgcaaauauaugucgcuggugaaagucaucggcaagaaagacaaugaguaccgcauggccaaugucccccugcuaaaaaucaacaaaaacaacgacaucaaagagauacucaaaucccaguucucaaauaagaaguucgaaaucguucugcccaaaguacucaagaaccaacucuuuuccgaaaacggagcccuguucgucauagggucuaaaggcuacaaauacaacgccaaucaacucguguugucagaccucgacaugaaacuccucaacgaccucucuaauaacaaauccaucgacgaaguaacgauaaaccaacuauucaaaaacauaguugacuccaccaacaaguacaugccacuguacgagauaaagaaccucaacgagguggucgagaaguucaacaaccucgaauuuaacgacaaaaagaaaaccaucacggacuuccuacuugcaacccacgccaacccaaccauguccaaccuuaagaacaucgggcuacccucauacuuuggccgcuucaccuccggaaaugcuggcauuaaauuaagcgaaaacgccaacguaaucuaccagagccccaccggcuuguuuucacgcaaagucaagauaagcgacuucuga

SEQ ID NO: 6424 - RNA, 3999 nt, Artificial Sequence
  Cas9 variant
augaaaaaucgcgagaacaucaaauacuauaucggcgucgacaucggcaccaacagcgucgguugggcaguaaucgacgagaacggcaaccuccucaagaagggaaagcaccacuuauggggaagucgacuauucgaucaggcccagaccgcacaaaaccgccguaacuaccguucuucccgccgccgauacaacaaacggcggcaacgcauuggguuacugcgccugauuaugagcgacauggugcucgaggucgaccccucguucuucauaagacucgagaaaaccacauuucuagacaaggaagacaagaaggcaauacucaaagacaacuacaaaaugaacuacaaccuauucugcgaugaggacuacaacgacaaaaaguacuucaaggacuauccaacaauuuaccaccuccguaaaaagcuaugugaaagcgacgagaaagccgacccgcgacuaauauacuuagcccuccaccacauugucaaauaccgugggaacuuccucuacgaaggacaggagcugcaccucgaaccgucaaacaaagaagaagaccuaaaaauacuuuucgacauccugggaaagaauaacgauaccgucuacgacauuagcgaagaacaaauccaauucauacugaaaaccgugguggagaauaucucaaagacugcaaagguggaugaaugcaugagccaacugaaacugaacucggaggacaagaaaauaguaaaagaauuuaugcgaggucuagucggcaacaaauucaacguaucgaaacuguacaugcacgaggacuugcaguucgacgacgaggaccugaaauuacaguucuccgacaaaagcuacgaagagaaaaucaccgaauacgaaaacgugcucgaagagaaaauggaauuuauagaccucaugcagagguucuacuccuggauagaacuguccaagaucgucgggagcgacucacagcacgcgagcaucucaggcgccauggugaacaucuacgaaucccaccgggaagaccuccguacccuaaaggaagugauguugaagaucgggaagaaagaguacgacgagauguucaaacccaccagcaagaacgucguaaauuacuacaauuacgugaauccggucgccuguagcggugacaaaacagacggguucuacaaauacguuaaaaaggcaaucgaaaagagcgacgacucccgaaaggacgaaauacuacagaaaauagccaacgagacauacaugcuaaagcaaacuagcaaaaacaacgcguauauccccuaccaaaugcaaaaagaugaacugaucaaaauucuggaccaucaggaaaaauacuaucccguacucaaagaaaaccgagacaaaauaauuuccauauuagaguuccgcaucccauacuacuacggcccacucgacggcaacaaacaauucggcuggcugaucaagaagaaaggaaaagaaaacgaaagaauacuaccauggaaccaccaagagauugucgacguacaagagaccgccgcccaauucaucaagaaacucacgaacuacugcaccuaucucccgauagaaaaagucaugccacagaaaucccucacgugcaguauguacgaaguucucucagaaguaaacaaaaucaggauagacggaaagcugcugcccaucgacaccaagaaccgacuaauagaggaccuauuuuucaaaagaaagaccguaaaagaaaaagaccucaucaacuggcucaagcaaaaccagcugacgguaggcgagauaaccggguaucagaaagagaaggcuuucucuagcucccuagcgccguggauagacuuuaaagaaauauuugacgaaaucaacgacuccaacuacgaccucaucgaaaagaucauagaggauaugacuauauucaacgagggaucaauacucaaagagagacuuaagaaagccuacaaccuagaccagaacaaagucaagaaaauaaugaaacuaaaauacuccggauggucacgccucucgaaaaagcuaauaaacggaauccgcgcagacaacaaguuuggcuccuccgucuccauccuggacgucaugaaggaaucgcacauggcucuaauggagaucaucaacgaccaagaccucggauucaaacagaucauugaaaaagagaacuucaaaaacgaaaccggaucguuugaguacgaagacaucgagaaccuagccggcucccccgcccuuaagcggggaauauggcagacacugcaagucauagaagagaucaaaaacuacaugggccacgaacccaaaaauauauacauagaguucgcccgagaggaacaagaaaaaguaagaacaaccacacggguaaagaaacucaaauccauauacaacgacaucaaaaaccagcuagacguccacggcaaagaggucuacaguaaccucaacaaacaagaugagaaaucaucaauagagaaacgccucuaucuguauuauacccaacuagguaaaugcauguacucaggcgaaagccuggacauugacaaacuauccaauuacgaaaucgaccacaucuucccucgaacacucacaucagacgacucgcucgacaaccuaguccuggucaaaaagaaagagaaccagcgcaaacuagacgaccucgugcugccacucgaaauacggaacaaaauggaggucuucuggaagaaacuguacgacaacggacucaucacgcaaaccaaauacuaccggcuaaugcgcgacgaguuccgccgcgaccaaaucgacaaauucauaaaccgccagcuaguggagaccagacaaauaaucaaacacgucgcgaacaucaucgagaaucacuacgaagauacaaaagucuucacugugcgagcaaaccuaucgcacgaguuccgagaaaaauacggcaucuacaaaaaccggaauguuaacgacuuccaucacgcccacgaugccuauaucgcaugcauaaucggccgguacauacaaaucagguuccccggccucgaggccaaguacguauaugggcaauacaugcaaaaugugaagaaaacgaaaaauaacauagacaaggaaaaccacggcuucaucaucaauaguaugaaguaugaaugcaucgacgaagacacaggagaggucauauggaaccccgaaagaauacuugacuauaucaaaugcuucaacuacagagacguuuauauuaccaagaaacucgacaccaacaaccgagaacuuuucaacgucaccauccucccaaacgacaaaaacuccgagaaggguaaaacgaaagcaacaauacccgucaacaagcuacgaucuaacguaagaaaguacggcggcuucuccgggcuacaauccgauauuguggccaucgagggcaagaaaggcaagaaaaucgaccgccgucuaaucaaccugcccauacuucuucgcuacgugucgauugaagaccaauguaaauacaucauggagaacaacaaauacuccgacguaaaaauaauuaaaaagauaaagaagaaccaacuaauagaaaucgauggaauaugcuacuaccuaaaaagcgcagacgaacuagacaccgcauaccaguuaauccucaguagagacgacaacgaaaugaucuacaggauugaccgagcgauacagaacaacgacuuuucauacuucgacaacaagaaagagaacauagacgagcuguaccggcugauuugccauaaaaugauagagaacuacccgaaauacaaaaagaaaguauacgaguucauaaaagaaagggaagaggaguuuuucgaacuggacaacucccaaaagugcauagucaucuucgaaaugauacgcguaaugaagcguggcgagcaauacauaaacaucccguucgagccguacaaccuaaagaacgaccguaagggacgacuaaacugccaaaguauccucuuagacaacacauacuucuacgacgucuccauaacaggaauauacucgaagaaguacaaauuauga

SEQ ID NO: 6425 - RNA, 3999 nt, Artificial Sequence
  Cas9 variant
augcagaaaaacuacaccauaggacucgacauagggaccaauucgguggggugggcaguaaugaaagacgacuacacccucaucaggaaaagaaugaagguacucggcaacacggacaucaagaagauaaagaaaaacuuuuggggcguaagacucuuugacgagggcgagaccgcgaaagaaacccgccuaaaacgcggcaccaggagacgauaccagcgccgacgaaaccgacucauauaccuccaagacauauuccagcaacccaugcucgccaucgacgagaacuuuuuccaccgacuggacgacucauuuuucguacccgacgacaaaucguacgacaggcaccccauauucggaucccuagaagaagagguagcguaccacaacacuuacccaaccauauaccaccuacgcaagcaccucgcugacaaccccgaaaaagcugaccuccggcuugucuauaccgcucuggcacacaucguaaaauacagaggccacuuccuaauagaaggcgaacucaacacggagaacacgagcaucucggagacauuugaacaauuccuggacacuuacuccgacauuuucaaagaacaacugguaggcgacauuucaaaaguagaagagauccuguccuccaagcaauccaggucccgcaaacacgaacaaaucauggcacuauucccaaacgaaaacaagcuaggcaacuucggaagauucaugaugcuuaucgugggcaacaccagcaacuucaagcccgucuucgaucuggaugacgaguacaaacuuaagcucagcgacgaaaccuacgaggaagaccuagauacccuacugggaaugaccgaugaugucuuccuagacgucuucauggccgcaaagaacguuuaugacgccguagagaugagcgccaucaucuccaccgacaccggcaacucaaaggccguccucucgaaccagaugauaaacuuuuacgacgaacacaaaguagaccuagcgcagcuuaagcaauucuucaaaacgcaccuacccgacaaguacuaugaaugcuuuucagaccccuccaagaacggauacgccgguuauaucgacggaaaaacaaaccaagaagacuuuuacaaguacauagaaaaagucaugaagaccaucaagagcgauaagaaggauuacuuccuggauaaaaucgaucgcgaagucuuucuccggaagcaacgaaguuucuacaacagcgucauaccccaccaaauccaucugcaagaaaugcaggcaauacucgaccggcaaucccaauacuacccuuuccucgcggaaaaccgagacaaaaucgaaucucuaguaaccuuccgaauaccguacuacguagggccucuaacaguaagcgaccaaagcgaguucgcauggauggaacgucaaagcgacgaaccgauacgucccuggaacuucgaugaaaucgucaacaaagaacggucggccgaaaaguuuaucgaaaggaugaccaacauggacaccuacuuacucgaagaaaaaguccugcccaagcgaagccuccuauaucagacauuugagguguacaacgagcucaccaaaguaagauacacaaacgagcaaggcaaaacggaaaaauuaaaccgccaacaaaaagccgaaauaaucgaaacacuauucaagcaaaagaaucggguacgcgagaaagacaucgccaacuaccuggaacaauacggauacgucgacgguacggacaucaaaggcguagaagacaaauuuaacgcaucacucagcacguacaacgaccuagcaaagaucgacggugcaaaggcuuaccucgaugauccugaguacgcugaugucugggaagauaucaucaaaauccuaaccaucuucgaggacaaagcaaugcgaaagaaacaacuacagacuuacuccgacacccugucaccagagauccucaaaaagcuagaacggaagcacuacacaggcuggggaagauucuccaagaagcucauaaacggucugcgagacgagggcucaaacaaaacgauccucgacuacuuaaaauccgaugaggggucauccggcccaacaaaccggaacuucaugcaacuuauuagggacaacacccucagcuucaagaagaaaaucgaagacgcucagaccaucgaagacaccacccacaucuacgacaccgucgcggagcuaccaggaagcccggccaucaagaaagguauccgccaggcucuuaaaauugucgaagagaucaucgacaucauaggauacgagcccgagaauauagugguggaaauggcuagggaaucccaaacaacgaagaaaggcaaagaccuaucaaaagaacgucucgaaaaacucacggaggccaucaaagaguucgacggcccaagcgacgucaaagugaaagaccugaaaaacgagaaccuaaggaaugaccggcuauaccuauacuaccuacaaaauggaagagacauguacacaaacgagccccuagacauaaauaaccugagcaaauacgacaucgaccacauaauaccacagagcuucaccacagauaacagcauagacaacaaaguccucgucucacgcaccaaaaaccaagguaacaaaagcgacgacguccccagcaucaacauuguccacaaaaugaaaccauucuggagacagcuucacaaagccggcuuaauuagugaccggaaauucaagaaccucacaaaggcggaacacgggggccugaccgaagcagacagggcacacuuccugaacagacaacucguagagacccggcaaaucaccaaacacgucgcgaaccugcucgacagucaauacaacaccgcagaagaacaacgcauaaauauaguccuccuaaaaucauccaugaccagccguuucagaaaagaguucaagcuauacaaaguacgcgaaauaaacgacuaccaucacggccacgacgccuaccugaacgcagucguagcaacaacaauuaugaaagucuacccgaaccuuaaaccccaauucguauacgggcaguacaaaaagacaagcauguucaaggaggaaaaagccaccgcucgaaagcauuuuuacucuaacaucaccaaguucuucaagaaagaaaaagucguaaacgaggaaacaggagaaauccucugggauaccgaaaggcaccucuccaccauuaaacggguacuauccuggaaacagaugaauaucguaaagaaagucgaaaaacaaaaaggccaacucuggaaggaaaccaucuacccgaagggggacucuucgaaacucaucccggucaaagaagggauggacccccaaaaauacgggggacugagccaaguaagcgaagccuucgcggucguuauaacccacgaaaaaggaaagaagaaacaacucaaauccgaccucaucucgaucccaauugucgaucaaaaagccuaugaacagcaucccacagcguaccucgaagaagcaggguacaacaauccaacaguccuccaugagcuguucaaguaccaacuauucgaacucgaggacggcucccgacgaaugauagcauccgcuaaagaguuccaaaaaggcaaccaaaugguccuaccccuggaacuuguggagcuacuauaccaugcgaaccgauacgauaaagugaaauucccggacucaauagaguacguacacgacaaccuagcgaaguucgacgaccugcucgaauacgucauagacuucucaaacaaguacauaaacgccgacaagaacguccaaaagauccaaaagauauacaaagaacacggcacagaagacgucgaguuaacagucgagagcuucgucaaucuaaugacauucacggcgaugggcgcccccgcuaccuucaaauucuacggcgaaagcauaacccgcucgcgauacacgagcauaaccgaauuucgaggauccacacucaucuuccaauccaucacgggccuauacgaaaccagguauaaacuggaagacaacuga

SEQ ID NO: 6426 - RNA, 3999 nt, Artificial Sequence
  Cas9 variant
augaugaaggaauacagcauuggccuugacaucggaucaaguagcguaggguucgucgcgguagacgaucaauaccgggugguacgagccaaaggcaaaaacgugaucggcacgcgacuuuucgacgagggaaaaaccgcagccgaucgccgcggccuucgcaccacacgccgacgccucucacgcaggaaauggcgccuccggcugcuacgaggcaucuuugaaccccacauaaacgaaaucgacgagagcuucuucaugagguuaaaagaaucaaauaucucccccaaagacagcaacaaacacuucccuggagacauacuguucaacgaccgcuccgacagagaguucuaugaaaauuacccaacaauauaccacuugcgucaagcccucaaaaccgaaaagcgccaauucgauauucgcgaaauauaccucgccaugcaccacaucguuaaguaucgaggacacuuccuugaaggagggaccguaacagauuuugaagucggagaacuugacuuggcagguaaauuuagccggcucaacgaacuauucgaauccauaaaccuagaagucccuuucguucucagacuggacaaccucgaagauguuaaggccguccuaaucgacagccaacgcucggcacaggaccggcaacggacccugacaccggacauauauguacccagcacagacaagauaacagagaaaagauucaagggaaucgcgaccgaacuacuaaaagccauuguugggaacaaagccaaauuugacguccucgccggacuggaacuagacaaagaggaagcgaaacucugggcacucaccuucgacuccgagacauuugacgaagacauagaacaacuggagggcgacaugacggaagcaacacaagaucuaaucgaaauucugaaauccuuacgcagccugauaagacuggcggugaacaugccggagggcgugagccuguccgaaaugaugauacaacgauacgaggaccacgccgaccaccucaaacugcuccgcgacaucauccacaacacggacgcagaaaaagccgcaggccuccaagccgcauacgauggauacauagacggaguaaaggggaagaaaacaccuguugaugacuucuacaaagcgauuaagaaaaaccuagacgacuccgaagccgcccaucaaauccuagcgcucauagacaaaaacgaguucaugccaaaacaacggucaaaaucgaacggcuggauuccgcaccaaauccagcaaaaggaacucgaccgcauaaucgaaaaccaaaagcaguacuacccguggcucgcggaugucaacccaaacgaaucgaggcgcaaaguagccccguacaaaaucgacgaacuggucacguucagaguacccuacuacguagggccccuuguaacguccgaggaacagaaaaaguauggaagcaaauucgcguggaugguaagaaaggaagagaaaggcgagaucaccccauggaacuucgaccaaaaagucgaccgcgccgccagcgccacggaguucaucaaccgaaugaccacgauggacaccuaucuucucaacgaagacguccuccccgcccacucacugauauaccagaaauaugaaguauugaacgagcucaauaaagucaagauaaacggcgaugccauaacgccagaacuaaaacagaaaauauaccacgaccucuucgaaaagcaaacgaccgucuccaucaaaaaccuacaaaccuaccucgucucagaguccgaggcaucagaagucccggaaauaaaagggcuugcugacgaaaagaaauuccuaagcggacugaccacauaccacgaccugaugaaaauauucgaccgaaacgucguuaacgaccccgagagagccgaagacuucgagaaaauaauacgguggucgaccguauucgaagacaagcacauuuacagagagaagcucgacucccucagcuggcucacaacagaccaaaaagaccgccuagccguaaaacgcuaccgcggcugggggcgacucagcgaaaaacugcucauagggcuacgcgacgaaggacacagaagcauaauggacuaccuaugggaaaccacgucgaauuucaugcaaauacaagcccagaacgacuucagcgagaaaauagcagcagaaaauaaagaguuccucgacaacacccaaagcgugcagggaauuaucaacgaacuauacacgucaccgcaaaacaaaaaggcgauacggcaaacacugcuagugguggaagacaucaagaaagcauuccacggcgaagcaccaaagaggaucuuugucgaguucgcgcgcgaaaaugagaguacuccacagagaucaauacaacgccaacgacaggucgagaacgcauacgagaaagucacccaaaaccuacugguggacgauaaaauccgcgcggagcucaaggacucgaucaacgaaaaacgcuuauuccacgaccgacuguuccucuacuucaugcagggaggcauagacauguacuccgguaagaaaaucaauauagacaaccucagcgcauacgacauagaccauauacucccccaguccuucaccgucgacaacucccuagacaaccgaguccucacaaaccagaaagacaaccgagagaaaggaaacucgcuacccuccgagcucuaccggggaucaaugaaagaaacuugggaaaugaugcgaaaucaaggccuccuauccaaaggcaaauuccaccggcucaugaugacaccaaacuccaugacagcauacgaccaacaaggguucauuaacaggcagcuaguugagaccaggcaaguaaucaaacucgccgucgaaauacucgcuucagaguucgaccaagcagacgaaaaagucgaaaucgucagcgucaaagcaggccucacacaccaaaugcgccaagacuucucgcuaaucaaaaaucgcgauguaaacgacuaccaccacgcauucgacgcguaccuaacagcguucgucggaaccuaucuauuaaagagguacccaaagcuacgcccauauuucguauacggcgaguucaagaaauucagccaaaaacaagcgaaccucacaaacuucaacuucuugugggcccucaaacacaaggaccaagucgccgucgaagacacaggagagaaaauauggaacaaaccacaagaccucgcguacauaaggcaucucuucgccuucaagaaaauccucaucucccgcgaaguaagcgaacgccacggagccuuguucgaccaaacacuauacaaagcguccgacgacaaagcuaguggacaaggcuccaaaaagcuaauacccgcaaaggacaacagacccacagaacuauacggaggcuacuccggccaaacaagcgccuucauggccauuguaaaagucacaaaagguaagaaaacgaaauaccucguagucgguguaccuacagccgccauaucacaacuacaaggcauggacgucaaaaguagccaauacacggagaaaauauacaacauccuaucuccaaaacugcucagcaagaacgacgacuucgaaguaaucguaccgaagguucgauaccgucaacuaauccuagacaacaaccagcuauucacacuagguucagacaccuacaaauacaacgcccgacaacucguucuaagcaaugaagucuuagcaguaaucaaucgcgacaaguccuucauagacaaaaagcuaagcgaagaagcugaaaaccaggcccucaacgacgccuucgacgaaauaguagucgccauggacaaacacuucgauuuauacgacaaaaacggauucagagaaaagguaaaagccggcaagcagcgcuucgaagaauuacccguuucucuauuuuccgaagacaaagaaaacgaagguauaaccaaaagaaccguccucaaacgcauucuacaaggccuucacgcaaacgcaacaaccagugaccuuaagguccucgacggcaaauucuacaauuga

SEQ ID NO: 6427 - RNA, 4002 nt, Artificial Sequence
  Cas9 variant
augaaaaacuacacuauuggccuggauaucggggucgcaaguguaggcuggguuugcaucgaugagaauuacaagauacuuaacuacaacaauaggcacgccuucggcguccacgaguucgaguccgcagagucagcagccggacggcgucucaagcgcggcaugcgccggcgguacaacagacgaaagaaacgccuccaacuucuacagagccucuucgacuccuacaucacggacucaggguucuucagcaaaaccgacagccaacauuucuggaaaaacaacaaugaguucgagaaucgcucccuaaccgaaguacuguccucccuucgaauaagcucccgcaaauacccuacaauauaccaucuccgcuccgaccugaucgagagcaacaaaaagauggacuuacggcucguauaccucgcccuacacaaccugguaaaauaccggggacacuuccuucaagaggggaacuggagugaagccgccuccgccgagggaauggacgaucagcugcucgagcuagucaccagauacgcagaacuagaaaacuugucgccccucgaccuauccgaaucgcaauggaaagccgccgaaacgcugcuacucaaccgaaaccuaacgaagacagaccaaagcaaagaacugacagcaauguuugggaaagaauacgaaccauuuugcaaacugguugcgggccugggcgucucacuacaccagcuuuuuccauccucagaacaagcccuugcauacaaagaaaccaagaccaaaguacaacucucgaacgaaaacgucgaagaagugauggagcuacuacucgaagaggagagcgccuugcucgaggcagugcagccauucuaccaacaagucguacucuacgaacuacuaaagggcgagacguauguagcuaaagccaaagucucagcauucaaacaguaccaaaaagacauggcgucacuaaagaaccuccuagacaaaacauucggagagaaaguauauagaagcuacuucaucuccgauaagaacagccaacgcgaauaccagaaaagucacaaaguggaaguccuaugcaagcucgaccaauucaacaaagaagccaaguucgccgaaaccuucuacaaagaccucaagaaauugcuggaggauaagucgaagacaagcaucggcaccacagaaaaagacgagaugcugagaaucaucaaagccauagacagcaaccaauuccuccaaaaacaaaaagguauacaaaacgccgcaaucccgcaccaaaacucgcuauaugaggccgagaaaauacuacgcaaccaacaggcucauuaccccuucaucaccaccgaauggaucgaaaaaguaaaacagauccucgccuuccgcaucccguacuacaucggcccucucgucaaagacaccacacaguccccguucucaugggucgaacgcaaaggggacgcgcccaucaccccuuggaacuucgacgaacaaaucgacaaggccgccuccgcagaagcguucauuucaagaaugcgcaaaacuugcaccuaccugaaaggucaggagguauuaccuaaaucaucccugacuuacgaacgcuuugaagugcuaaacgagcuuaaugggauacaacuacgaaccaccggggcagaaucagacuuccgacaccgacucagcuacgaaaugaaaugcuggauaauagacaacgucuucaagcaauacaagacaguaucaacgaagcggcuccugcaagaguuaaagaaaagccccuacgcagacgaacucuacgacgaacacaccggcgagaucaaagagguguuuggcacccaaaaagaaaacgcauucgccacaucccucucaggguacaucagcaugaagucaauacuaggggcagucgucgacgacaauccggccaugaccgaggaacuaaucuacuggaucgcugucuucgaggacagggaaauccuacaccucaagauccaggaaaaguacccuagcaucaccgacguccaacgacaaaaauuagcccuugucaaacucccgggcuggggacgauucucacggcuccucauagacggacucccacucgacgagcaggggcaaucagugcucgaccacauggaacaauacaguuccgucuucauggagguacugaaaaacaagggcuucggccuggaaaagaaaauccagaaaaugaaccagcaucaggucgacggaaccaagaaaauacgauacgaggacauagaagaacuggccggaagccccgcacugaaaagagguauauggcgcagcguaaaaaucgucgaggaacucgucagcauauucggagagccagcaaauauaguacucgaaguugcccgagaggauggagagaagaaacgaacaaaaucccgaaaagaccaaugggaggaacuaacaaaaacgacacucaaaaacgacccagaccucaaaucauucauaggagaaaucaaaagccaaggcgaccagcgcuucaaugaacagcgcuucuggcucuauguuacacaacaaggcaaaugucuauacaccggcaaggcgcucgacauccaaaaccucagcauguacgaaguggaucacauccucccacaaaacuucguaaaagacgacagucucgacaaucucgcccucguaaugcccgaggcgaaccaacgcaagaaucaaguaggccaaaacaaaaugccccucgagaucaucgaagccaaccagcaauacgcgaugcgcacacucugggagaggcuacacgaguuaaagcugauuucgaguggcaagcuagggcgccucaagaaaccguccuucgacgaaguggacaaagacaaauucauagcacggcaacucgucgaaacucgucagauaauaaagcacguaagagaccuccuugacgagagguuuagcaaaucggacauccaccugguaaaagcugggaucgugagcaaauuccgccgcuucagcgaaauaccaaaaauaagagauuauaauaauaaacaccacgcaauggacgcucuguucgccgcagcacucauccaaucaauucuaggaaaauacggcaagaacuuccucgccuucgaccuuuccaagaaagacaggcaaaagcaguggcguagcgugaagggcagcaacaaagaguucuuccuguucaaaaacuucgggaaccuacgccuacagucacccgucacgggugaggaggugagcggcguagaguacaugaagcacgucuacuucgaacugccauggcagacgacaaaaaugacacaaaccggagauggcauguuuuacaaagaaucaauauucuccccaaaaguaaagcaagcaaaguaugucagucccaaaacggagaaauucguacacgacgaagucaaaaaccauuccaucugccuaguagaauuuaccuucaugaagaaggaaaaagaaguccaagagaccaaauucauugaccugaaagugaucgagcaccaucaguuccuaaaggagccagaaagucaacuggccaaguuccuagcagaaaaagaaacaaacaguccaauaauccacgcgcgaauaauacgcacuaucccaaaauaccagaaaaucuggauagaacacuuccccuacuacuucaucucaacaagagaauugcacaacgcacgccaauucgaaauuuccuacgaacucauggaaaagguaaagcaacugucagaacgaaguagcgucgaggagcuuaagaucguauucggccuccucaucgaccaaaugaacgacaacuauccaauuuacaccaagucuucaauccaagaccgaguccagaaauucgucgauacucagcuauacgauuucaaguccuucgagauaggauuugaagaauuaaagaaggcagucgcggcaaacgcccagagaucagacacauucgggucgagaauaagcaagaaaccuaaaccggaagaaguagcaauaggauacgaaagcauaacaggccuaaaguaccgaaaaccacgaaguguaguaggcaccaaacgcuga

SEQ ID NO: 6428 - RNA, 4002 nt, Artificial Sequence
  Cas9 variant
augucacagaacaucgucgauuacugcauaggacucgaccuaggcacgggcucaguuggaugggcggucguagacaugaaccaccgccucaugaaaaggaacggaaaacaccucuggggcucacgacucuuuuccaacgcugagaccgccgccaaccgccgggccuccagauccauucgccgacgguauaacaaacgacgagagagaauccgacuacucagagccauucuccaagauaugguucucgaaaacgauccgaccuucuucauaagacucgaacauacgagcuuccuagaugaagaagacaaggccaacuaccuaggagccgacuacaaagacaacuacaaccuauuuauagacgaggacuucaacgacuacaccuacuaccacaaauaccccacuaucuaucaccugagaaaggcguuaugcgagucuaccgaaaaagccgauccacgucugaucuaccuagcgcuacaccacaucgucaaauaccggggcaacuuccucuacgaaggucaaaaauucaacauggacgcgucgaauaucgaagaucgccuaagcgauguauucacacaauuugcggacuucaacaauauacccuacgaggacgacgaaaagaaaaaccucgagauucucgaaauacucaagaaaccucucucgaagaaggcaaagguagaugaggugauggcccucauugcuccggaaaaagauuuuaaaagcgccuacaaggagcucgucaccgggauagccggcaacaaaaugaacgugaccaaaaugauccuaugcgaacccauaaaacaaggagacuccgagaucaaacucaaauucucugacaguaacuacgacgaccaguuuucugaaguggaaaacgaccuaggcgaguacguugaguucaucgacucgcuccauaacaucuauuccuggguggagcuccagaccauaaugggcgccacgcacacguacaacgccagcauaucagaagcaauggucagucgguacaacaagcaccacgaagaccuacaguugcuuaaaaagugcaucaaggauaaugugcccaaaaaguauuuugacauguuccggaacgacagcgaaaagcugaaaggauacuauaacuacaucaaccacccgagcaaagcccccgucgacgaguucuacaaauacgugaagaaaugcaucgaaaaaguggacacacccgaagcaaaacaaauccuccacgacauagaacucgaaaacuuccuccucaagcaaaacucucgaaccaacggaagcguccccuaccaaaugcaacucgacgagaugaucaaaauaauagacaaccaagccaaguacuacccagugcuaaaggaaaaacgcgaacaacuccuaucgauccuaacauuuaagauacccuacuacuucggcccccuaaacgaaaccagcgaacacgcauggauaaaaagguuagagggcaaggagaaccaacguauccuccccuggaacuaucaagacauaguagacgucgacgcgacggcggagggcuucauaaaacgcaugcggucuuacugcaccuacuucccggaugaggaaguucucccaaagaacucguuaaucguauccaaauacgaggucuacaacgaacuaaacaaaauucgggucgaugacaaacucuuggaagucgacaucaaaaacgacauauacaacgaacucuucaugaauaacaaaacgguaaccgaaaagaaacugaaaaacuggcuagucaacaaccaguguugcaacaaaaacgcggagauaaaaggcuuccaaaaagagaaccaauucagcacuucgcuuaccccguggauagacuucaccaacaucuucggcgagaucaaucaauccaacuucgaucucauagaggacauaaucuacgaccucacaguguucgaggacaagaaaaucaugaaaagacgccucaaaaagaaauacgcacuacccgacgacaaaaucaaacaaauccucaaacugaaauacaaagauuggucgaggcuuucaaagaaacuucucgacggcaucguggcugacaauaaguucgggucgucugucaccguccucgacgucuuagaaaugucacgacucaaccuaauggaaauaaucaacgacagagaccugggauacgcacaaaugauugaggcagcagccucaugcccagaggauggaaaauucaccuacaaagaggugcagcgccuggcgggcucaccagcucugaagcgggggauauggcaaagccuucaaauaguggaagagaucacaaaggugaugaaaugccgccccaaguacaucuacauagaguucgaaagguccgaggaaaccaaagagcgaaccgaauccaaaauaaagaaacucgagaacgucuacaaagaccucgaugaacaaacaaaagucgaguacaaaacaguacuagaagaacuuaaaggauucgacaacacaaagaaaaucuccucggacucccuauuucucuauuucacacaacucggcaaauguauguacagcggcaagaaacucgacaucgacagccuagacaaauaccaaauagaccacauagucccccaaucgcuaguaaaagaugacagcuucgacaaccgcguccuaguaguaccaagcgaaaaucagcgcaaacucgacgaccucguagugcccagcgacauccgggucaaaaugaacucauucuggaagcuccuguucgaccacgagcucauuucacccaagaaauucuacucccucaucaaaaccgaauauacggaacgagaugaggaacgcuucaucaaccgccagcuuguagaaacacgucaaaucaccaaaaacgucacccaaaucauagaggaccacuacaguaccacaaaaguagccgcaauacgagcaaaccuaagccacgaguuccgggugaaaaaccacaucuacaaaaacagagacaucaacgacuaccaucacgcacaugacgcauacauuguagcccuaaucggcggauucaugagagaccgguacccgaacaugcacgauuccaaagcgguguacagcgaauauaugaaaauguuccgcaaaaacaaaaacgacaaaaagcgauggaaggacggauucguaaucaacagcaugaacuaccccuacgaagucgacggcgaacuaauauggaacccggacaucaucaacgaaauacgcaaaugcuucuacuacaaagauugcuacugcaccaccaaacucgaucaaaaguccggacagauguucaaccucacaguccucccgaacgacgcccauucgcccaaagggacgaccgaagcugucauccccguuaacaaaaacagaaaagacguaaacaaauacggcggauucuccggauuacaguacguaaucguagccauagaaggaaagaagaaacgggggaagaaaacaaaacuugucaagaaaauauccggcguaccacuacaccuaaaagccgccucucucgacgagaaaaucaaauauaucgaagaaaaagaaaaccucacagacguuaaaaucaucaaagacaguauaccagucaaccagaugaucgagauggacggcggcgaauaccuacucacaagccccaucgaguucguaaacggccggcagcuaguccucaacgaaaaacaaugcgcucuaaucgccgacaucuacaacgccaucuacaaacaggacugcgauaaucuagacgacguccucaugauucaacucuacauagaacucaucaacaaaaugaaagcgcuauacccagcauaccaauccaucgcggaaaaauucgaguccaugaccgaggacuacguggccgugaguaaggaagaaaaagcggacaucaucaagcaaaugcuuauaaucaugcacaggggcccccggaacgggaagauccaguacgccgacuucaacgugggcgaccgcaucgggcgcaaaaacaaaaugucgcucgaccuggagcgcguaaccuucgucagccaaucgcccaccggcauauacacgaagaaauacaaacucuga

SEQ ID NO: 6429 - RNA, 4002 nt, Artificial Sequence
  Cas9 variant
augggaaaagaguauuaucucggccucgacaucgggacugacagcgucggcugggcagucugcgauacgaacuacaaaauccccaaauucaaaggcaacgccauguggggcauccggcuauucgagaaaucaaacucggcugaagaaaggcgcggcuuccgcagcagcaggcgacgaacgcagcgaaagagggaacgccucaaacuacucgaaaugcuguucgacgaggagauuucaaaaauagacccugccuucuucauaaagcuccgcgagagcaacuuauaucucgaagacaagagcacaaaaauccccuacuguguguuuuccgacgaaaacuacacagacaaagacuuccacagagauuacccuacaaucuaccaucuccgcaaugaacuaauaaagucaaacaagccacacgacguccgucugguguaccuagcgcuacaccacauaaucaaaaaucgaggacauuuccuauuugacuacucauacaaaaacgacaaaagcggcgacuucaugccaaucuacaaugaccucaaaaacuacuuuuacgacaauuacgaaaucgagcuagacugcagugacgucgacgaguucgcaaacacgcuaaaagacaaauccaagggcaaaacaaagaagaacgccgaaaucgcagaacucuucggcgucucgaagaaguacgauaagguccucuacagcgcacucucguugcuuucaggaagcagcgucaaacucuucgacauauucgacgacgaagcauuaaaggauguagagaaaaagagcgucagcuucucaucaggguucgacgacaacgccaacgacuuccaauccuaucucggagaacgcuucgaacucuuagaaaagcuaaaggcgguguaugacugggcggugcucgcagauaucuuggacggcaaagaguacaucagcgaagccaaagucgcaaucuacgagaagcacaaacgagaccugaagacccuaaagaaguacaucaagaucuauaugcccgaaaagaaggcagagauauucaacaucucguccaaggacaacaauuacguagccuacuccaagcacaucaagaccucgaacggcaccggcguacucauaagcacaugcacccaggaggaguucugcgcguaccugaagaaaacccuaggcauuuguaaagaugcuuccuacgaagaaauguuuaaagaaauagagaacuccacguucaugcccaaacaaguaaccaaggacaacggaguggucccgaugcaaguaaacgagaaagaacucgucgccauacuagacaacgccaaagaauaccuacccuuccugcucaacaaggacaaugacggcaagaccguguacgacaagauaaaggcucuuuuugaauaccgaaucccguacuacauagggccccuuaacacccacagcaccaaaucauggcucguacguagcaacgagaaaauuuaccccuggaauauagaagacguaguagacuucgacaagucugccgaaaaguuuauugaaaaccuuaccuccaaaugcacauaccucccccaguacgacguaauaccaaaacacucacuccuuuacaacaaauucugcgugcucaacgaacucaacaacuugaagauagacggcgagaaaaucagcguccaacucaaacaagacauauacaacgaccucuucaagaaauacuauaaaguuaccaacaagaaacucugcgacuaucucaaaucgcgcaacauagcguuugacgaaauuagcggaaucgauaacgauuucaaaaguucccuuaaauccuacaaagaccuaguagcguacaaccuaacagacgagcagaaagaagagauaguaaaagcaaucaccaucuucggcgacgacaagaaacugcucaagaaacgcuugaaaaacgaguucggcggaugccucucggaugaugaaauaaagaaaaucugcaaacugaaauauacugggugguccaagcucucucgugaauuuuuaacggacguuaccgcugucuacaaagaaaccggcgaacucaucaacauaaucugcgcccucugggaaacgaacuacaaccucaccagccuccucuacagugacgaguucugcugcgacgauaaggaaaauaaaacauucaacgacaaaaucaacgaacucaacuccuucggcaacgacaaaacccuaaaucagauaguugaagaacucuacguauccccacucgucaaaagaccaauauaccagucccuacuuaucaccaaagaacuugaaaagauaaugaaauguccacccaagaaaaucuucgucgaaguagcgcggggagccgaagagaagaaacguacagucagccggaggaacaaacuccuugaucucuacaaaagcugcaagaacgacuacccccuccuauucgacgagcuacagaacaauaccacggacgacgagcuaaaaucagacaaacucuaccuguacuucacccaauucggcaaaugcauguauaccggcgaaaacaucgagcuuggcgaccucuucaacaagaacuuguacgacaucgaccacaucuacccccagucgaaaauaaaagaugacucccuagacaaucgaguccucgugaaaaagaccacaaacgcgaaaaaggacaacgaauacccacuaucgucccagauucgggagaaaaugacaccccacuggaaagcacuguuagacaaaggccuaauaaacaaaaagaaauacgaacgccuaguccgaaauuacccccucucagacgaagaacugucacaguucaucucacgacaacuggucgagacacgccaaucgacaaaagccguggcaaacauacucgaacaacucuacccacgacccgacacggagauaguauacgucaaagcagcacuagcaagcgaguuccgccaccaauaugacaugcuaaaaugccgcgaagucaacgaccuacaccacgcaaaagacgccuaccugaauauaguggucggcaacgcauacaacggcaaauucacccacaacaaggccaacuucaucaaaggacuacagaacaacgacaaagccuacacggucaagcuagauuccaugcugaagcacaacauagauggcgcuuggaucgccgacaacaacgagucacucaacauaguaaaauccaccaugaacaagaacaacauccgcuacacucgauacgcuuucgagaaaaagggaggacuauucaaggucaccauccucaagaaaggaaacggccaggcauccaucaagaaaaaugacaaacgcaauagcauagaaaaauacggcggguacaaccaagucucauccacguauuucagcugcgucgaacauggcaaagacaauaauagaaugaucuccauguucagcgucaaccuauaugacaaaaacaaguacgaagaaaaccccauugcauaccucaucgaaaauuacgguuuaaucaacccaaucaucaaagugaaaaagguaaagauccagucgugcauuagcuucgauaacaugcuuugucaccugggcggaaaggacagcggcggcucacagauauccuaccgaccgggaguacagcuagugcucggauacgauaaugaacgauacauccgcaacgugauucgcugcgccgggggcgaccuccaccuacaaacaucuaagaacgaaaaagacauaguaaccgcggaaaagaacaucgaacuauucaaccuucucaucgagaagaugaaaaacaauauuuacggagugcucuacucaaaucugggcgacaagcuauacugcaguaaggaaaaguucgagaaauuggacauaguagaacaaugcaacguaaucaaaaacguacucaccauacucaagaacaacgcgucgaaaggggaccugaaguccaucggcauaaaagcaaacggagccauacggcucaacaacaacauaucagaaaucaagaaggucaaaaguaucaaacuaauaaaucaaucgguuaccggccuauucgagcaagagaucgagcuauuaaaucucuga

SEQ ID NO: 6430 - RNA, 4002 nt, Artificial Sequence
  Cas9 variant
augagucaaaacauaguagacuacugcauugggcuagaccucgggacaggaagcgucggcugggcggugguagacaugaaccaccgucuaaugaagagaaacgggaagcaccuauggggcagucgccucuucuccaaugccgaaacagcagcaacccggcgcuccagcagaagcauucggcggcgguacaacaaaagacgcgaaagaauacgccuccuacgggccauccuacaagauaugguccuagagaaagaccccacguucuucauuagacucgaacauacuagcuuccuagacgaggaagacaaagccaaguaccucgguaccgacuauaaagacaacuacaaccucuucauagacgaggacuucaaugacuacaccuacuaccauaaguacccaaccauauaccaccuucgaaaagcccuuugugagagcacggagaaggccgacccccgccuaauuuacuuggcccuccaccacaucgugaaauaccggggcaacuuccucuacgaaggacaaaaguucaacauggacgcauccaacauagaagacaagcuauccgacguauucacgcaguucgcagacuucaacaacaucccuuaugaagacgacgaaaagaaaaaccucgaaauucucgagauucucaagaaaccccuaucgaagaaagcaaaaguggacgaaguuauggcacuaaucagccccgagaaagaguucaagucugcauacaaggagcuuguaacagggauagcgggaaauaaaaugaacguuacgaaaaugauccucugcgagagcauuaaacaaggggacucagagaucaaacucaaguucagcgacucgaacuacgacgaccaauucagcgaaguagagaacgaccugggcgaauacguggaauuuauagacucccuacacaacauauacagcugggucgaacuccagaccauaaugggagccacacacacagacaacgcgucaaucagcgaggccauggucagccgauacaacaaacaccacgaagaccuacaacuacuaaagaaaugcaucaaggauaacguacccaagaaauacuucgacauguuccgaaacgacagcgaaaaagucaaaggauacuacaauuacaucaaccgacccaacaaagccccaguggacgaguucuacaaauucgucaagaaauguaucgaaaaaguagacacccccgaagcgaagcaaauacuacacgacaucgagcucgagaacuuccuacucaaacaaaacucacgcacaaacggguccguccccuaccagaugcaacucgacgaaaugauuaagauaauagacaaccaggcuaaguauuacccaguccuaaaagaaaagcgggaacagcuacucagcauccucacauucaggauccccuacuacuuuggcccucuaaaugagacaucagagcacgcauggauaaagagacuagaaggcaaggaaaaccagcgcauccucccauggaacuaccaagacaccgucgauguagaugcaacggccgaaggcuucauaaaacgaaugcgaagcuacuguaccuacuuccccgaugaagaaguacuacccaaaaacucacuaaucguaagcaaauacgaggucuacaacgaacuaaacaagaucagaguagacgacaagcuacucgaagucgacguaaagaacgauaucuacaacgaacucuucaugaaaaacaagacggucacagaaaagaaacucaaaaauuggcugguuaacaaucagugcuguaggaaagacgccgaaauaaaaggcuuccaaaaggaaaaccaauucagcaccucgcuaacaccauggaucgacuucaccaacaucuucggcaaaauugaccaauccaauuucgaucucaucgagaaaaucauauacgacuuaacggucuucgaagacaagaaaaucaugaaacgcaggcucaaaaagaaauacgcgcugccagacgacaaaaucaaacaaauccucaagcucaaguacaaggauuggagccgccuuuccaagaaacuccuagacggcaucguggccgacaaccgcuucgguuccuccgucaccguccuggacguccuagaaaugagucgacucaaccuaauggaaauaaucaaugacaaagaacuaggcuaugcgcagaugaucgaagaagccucuucauguccaaaagauggcaaauucacauaugaagaggucgccaaacuagcgggcagccccgcgcugaaacgagggauauggcaaucccuacagauagucgaggagaucacaaaagugaugaaaugccggccgaaauacauauauaucgaguucgaacgcucagaagaagcaaaagaacgcaccgaaucaaaaaucaagaaacucgaaaacguauacaaagaccuagacgagcagacgaagaaagaguacaaauccguucuugaagaacugaaaggcuucgacaacacaaagaaaaucagcagcgacucccuauuucuguacuucacccaguuagggaaauguauguacuccggcaaaaagcucgacauagacucccuggacaaguaccaaauagaucacauugugccccagucacucguaaaagacgacagcuucgacaaccgcguccuuguccuacccuccgaaaaccaacgaaagcucgaugaccucgucguccccuuugacauacgggauaagauguaccgguucuggaagcuccuguucgaucacgaguuaaucuccccgaaaaaguucuacucauugaucaaaaccgaauacacagaaagggacgaggagagauuuauaaaccgccagcugguagaaacgcgccaaauaaccaagaacguaacccagauaauagaagaccacuacucaaccacaaaagucgcggcuauccgagcuaaccucagccacgaguuccgcguuaaaaaccauaucuauaagaaccgcgacaucaacgacuaccaccacgcccacgacgcauacauaguagcgcucaucggaggauucaugcgcgaccgcuacccaaacaugcacgacuccaaagccgucuacucagaauacaugaagauguucagaaagaauaaaaacgaccagaagaaguggaaagacggcuucguaaucaacucgaugaacuacccguaugaaguagacggcaagcucaucuggaaccccgaccuaauuaacgagauaaagaaaugcuucuacuacaaagauugcuacugcaccacaaaacuagaccaaaaaucgggccagauguucaaccuaacaguacuacccaacgacgcacauagcgccaagggaacaacagaagcugucauccccgucaacaagaaccgaaaggacgucaacaaauacggcggauucagcggccuccaguacgucauagccgcuaucgaaggcaccaagaagaaaggaaagaaacuggucaaagugcgaaaacuaucgggaaucccacucuaccuuaaacaagcagauauaaaagagcaaauagaauacguagagaaggaggaaaaacucucggacguaaaaauaaucaaaaauaauaucccacuaaaccagcucaucgaaaucgacggcaggcaauaccuccugacaagcccaacagagugcgucaacgcaaugcagcuaguacugaacgaagaacaaugcaagcucaucgcagacauauacaacgcaaucuacaaacaggacuucgacggucucgacaacaugcuaaugauccagcuuuaccuacaacugauagacaagcuaaaaacacuuuacccgaucuacaugggcauaguagaaaaauucgaaaaacucacggaagacuucgucucaaucucaaaagaggagaaagcuaacguaaucaaacaaaugcugaucaucaugcacaagggaccacaaaauggcaacauaauauacgacgacuucaacguaggaaagagaaucggcagacuuaacgggcgcaccuucuaccucgacaacaucgaguucaucucgcagucgcccacgggcauauacacaaagaaauacaaacucuga

SEQ ID NO: 6431 - RNA, 4002 nt, Artificial Sequence
  Cas9 variant
auguacaccuacuacuucaaagaaucggaaauggucuacgacgucggacucgacauagguacgggguccguggggugggucgcccuugaugaaaacgggaaacuagcccgagcaaaaggcaaaaaucuagugggugugcgauuauucgacacugcucaaaccgccgcugaccgccgaggguuccgcaccacacggaggcgccuaagccgucgaaaguggcggcucaggcuucucgacgaacuauucucggccgagauaaacgaaauagauagcuccuucuuccaacgacugaaauacagcuacguacacccaaaggaugaagaaaacaaagcccacuacuacggcggcuaccuauuccccaccgaagaggaaacgaaaaaguuccaccggagcuacccgacaaucuaucaucugcgacaagaacuaauggcccaaccuaacaaaagauucgacauacgagagauauaccuagcgauccaucaccuuguaaaauaccguggccacuuucucuccagccaggagaaaaucaccauuggaagcacguacaaccccgaggaccucgcuaacgcaaucgaaguauacgcagacgaaaaaggccugagcugggaacugaacaacccagaacaacugaccgagaucauuagcggagaagcaggauacggccuaaacaaaucaaugaaagccgacgaggcacucaaacucuucgaauuugauaauaaucaggacaaagucgccaucaaaacccuacuggccggccugaccggaaaccaaaucgacuucgccaaacuguucggaaaagauaucuccgacaaagacgaagccaaacucuggaaauuaaaacucgacgacgaagcgcuugaagagaaaagccagacgauccuaucacagcugacagacgaagaaaucgaacuauuccacgcggucguccaagccuacgacggcuucguccuaaucggccuccucaacggcgcagacagcgucagcgcggccaugguccaacuauacgaccaacaccgggaagaccgcaagcugcuaaagagccucgcgcaaaaagccggccucaaacacaaacguuucucggaaauauacgaacaacuagcacucgcaacugacgaagccaccaucaaaaacggaauaagcacugcccgcgaacucgucgaagaaagcaaccucagcaaggaaguaaaagaagauacucuacgccgccuugacgagaaugaguuccuucccaagcaacgaaccaaagcaaacucgguaaucccacaccaacugcaucuagccgaacuccagaaaauccuccaaaaccaaggacaauacuacccguuccuccuugacacauucgaaaaggaggacggccaagacaacaagaucgaggaacuccuccgauuccgcaucccauacuacguaggcccacucgugaccaaaaaggacguagagcacgcgggaggcgaugcagacaaccacuggguugaacgcaacgaaggcuucgagaaaucaagaguuacgccauggaacuucgauaaaguguucaaccgcgacaaggccgcuagagacuucauagagagacuaacgggcaacgauaccuaccucauaggagagaaaacgcucccgcagaacagccuccgcuaccaacuguucaccguacuaaacgaacucaacaacguccgcgucaauggcaaaaaguucgacuccaaaaccaaggcggaccucauaaacgaccuauuuaaagcccgcaaaacaguaagccucagcgccuugaaagacuaccuaaaagcgcaaggaaaaggcgacgucacaauaacagggcuagccgacgaauccaaauucaacaguucacuguccuccuacaacgaucuuaagaaaaccuuugacgcagaauaccucgagaaugaagauaaccaagaaacccucgaaaagaucaucgagauccaaaccguauucgaggacuccaaaaucgcgucccgggaacuauccaaacuuccacuagacgacgaccaggucaagaaacucagccagacacacuacaccggcuggggccgacuaagcgaaaaacuccucgacagcaaaauuauagacgaacggggucaaaaagucuccauucuggacaaacucaaaagcaccagccaaaacuucaugagcaucaucaacaacgacaaguauggagugcaagcguggaucacggaacagaacacaggcucgucaaaauuaaccuucgacgaaaaagucaacgagcuaacgacuuccccagcaaacaaaagaggcauaaaacagucauucgccguacugaacgauaucaagaaagcaaugaaagaagaaccccgccgcgucuaccuagaauuugcgcgcgaagaccaaacauccguccgcuccgucccccgauacaaccaacugaaagagaaguaccagagcaaaucccuuuccgaagaagcgaaagugcucaaaaagacacuagacgggaacaagaacaaaaugucggacgaccgcuacuuccuauacuuccaacaacaggggaaagacauguacaccggccgccccaucaacuucgaacggcuaagccaagauuacgacaucgaucacaucaucccgcaagcauucacuaaggacgacagccuagacaaccgcgugcuugucucgagacccgagaacgcccgcaaaagcgacagcuucgcguacacugacgaaguacaaaaacaagauggaucgcucuggacaucauuacucaagagcggguucauaaacaggaagaaauacgaacgacucaccaaagcaggaaaauaccuagacggccaaaagaccgguuucaucgccagacaguuagucgagacgcgccaaauaaucaagaacgucgcuucucucauugagggagaguacgaaaacuccaaagcaguagcaauuagaucggagauuaccgcagacaugaggcuccuggucgggauaaagaaacaucgcgaaaucaacuccuuccaccaugccuucgacgcuuuguugauaaccgcagcggggcaguacaugcaaaaccguuaccccgaucgagacucaacaaacguauacaaugaguucgaccgguacaccaacgacuaccuuaaaaaucuccgacaacuaucgucacgcgacgaagugagaagacugaaaucuuucggguucguaguagguaccaugcgaaaaggcaaugaagauugguccgaagaaaauaccaguuauuugaggaaagugaugauguucaagaacauccuaacgacaaagaaaacagaaaaagaccgcgggccccucaacaaagaaaccaucuucagcccaaagucaggcaagaaacugaucccccucaauucuaaacgcuccgacaccgcacucuacgguggguacagcaaugucuacagcgccuacaugacgcucguacgugccaacgggaaaaaccuccucaucaaaauaccaaucagcaucgccaaccaaaucgaagugggcaaccuaaaaaucaaugacuauauaguaaacaacccggcgaucaagaaauucgagaaaauacucauaagcaaacucccccugggccaacucgucaacgaagaugggaaucucauuuaccuggccucgaacgaauaccggcacaacgccaaacagcuauggcucucuaccacagacgcagacaaaauagcgagcaucagcgaaaacagcucggacgaagaauugcuugaagcguacgauauccucaccagugagaacgucaaaaaucgcuuccccuucuucaagaaggacauagacaaacugucacaagucagagacgaguuccuggacuccgauaagaggauagccguaauucaaacaauccuucgcggccugcaaauagacgccgccuaccaagcccccgucaaaaucaucagcaagaaaguauccgacuggcacaaacuccagcaaagcggugggauaaagcugagcgauaacucagaaaugaucuaucaaagcgcgaccggaaucuucgagacccgagucaagauaucagaccuccuguga

SEQ ID NO: 6432 - RNA, 4005 nt, Artificial Sequence
  Cas9 variant
augaaaaacccauauacaauagggcuagacaucggcacgaacuccgucggcugggcaguccucacaaaccaauacgacuuaguaaaacgcaagaugaaaguagcgggcaacuccgacaaaaagcaaaucaaaaagaacuucuggggcgugcgccucuucgacgacgggcagacggcaguagaccgucguaugaaccgcacugccaggagacgaauagaacgacgccggaaccgcauauccuaccugcaggagauauucgcagucgaaauggcgaacaucgacgccaacuuuuucugucgacuaaacgacagcuucuacguggacagugaaaaacgaaacagccgucauccauucuucgcgaccaucgaagaggaaguagcguaccacaaaaacuaccgcacgaucuaccaccuuagggaagaacucgucaacuccuccgaaaaggcagaccucagacucguuuacuuggcgcuagcacacaucauaaaauaccgagggaacuuuuugaucgagggagcccucgacacgaaaaauacaucuguagauggcgucuaugaacaguucauacagaccuacaaccaaguguucaugagcaauauagaagaagggacacuggccaaaguagaagaaaauaucgaggucgccaacauucuagcaggcaaauucacacgcagagagaaauucgagcgaauacuucagcucuacccgggugaaaaauccacgggcauguucgcucaauucaucuccuuaaucguaggaucaaaagguaacuuccaaaaaguguucgaccucauagaaaagaccgacauagagugcgccaaagacucauacgaagaggaccuugaggcauuacuagcaauaaucggggacgaguacgcggaacuauucguugccgcgaaaaacaccuacaacgcggucguacuaaguaguaucauaacggugaccgccacagaaacaaaugcaaagcuaucagccaguaugaucgaacgcuucgacgcacaugagaaagaccuaggcgagcuuaaagcguucauaaaauugcaucugcccaaacaauaccaggaaaucuucaacaacgccgccaucgacgguuacgccggguacauagacggaaaaacaaagcagguugacuuuuacaaguaccucaagacaauccuagaaaacauagaaggcgccgauuacuuuauagcaaagauagaagaggaaaacuucuugcgaaagcaacggacauucgacaacggggcuaucccccaucaacuccaccuugaggaacuggaagcuauuauacaccagcaggcgaaguacuacccauuccuccgcgaggacuacgaaaagauuaagagccucgucacauuucggauaccauacuucgucgggccccucgccaaaggccaauccgaguucgcuuggcucacuagaaaagcugacggcgaaauucggccguggaacauagaagaaaaggucgauuucggcaaguccgcugucgacuuuaucgagaaaaugacgaauaaggacacuuaccuccccaaagaaaacgugcuucccaaacacucccugugcuaccaaaaauauaugguauauaacgaacucacgaagguacgcuacaucgacgaccaaggcaagaccaacuacuucagcggacaagaaaagcaacagauauucaacgaccucuucaagcagaaacgaaaagucaagaagaaagaccuggaacuauucuuacguaauauaaaccauaucgaaucucccacgaucgagggccuggaagacagcuuuaacgccaguuacgccaccuaccacgaccuacucaaaguaggcaugaaacaggaaauacucgacaacccucuaaacaccgaaaugcuugaggacaucguuaaaauccucacggucuucgaggacaaacccaugauuaaggaacagcuccaacaauuuucagacguccuagacgggggcgugcuuaagaaacuagaaagacgccacuauacuggcuggggacgguugagcgccaaacuacucgucggcauacgggaaaaacaaucgcaccuuaccauucucgacuaccuuaugaacgacgauggccuaaaccguaaccucaugcaacuaaucaacgauuccaaccuauccuucaaauccauaauagaaaaagaacaagucagcacgacggacaaagaccuccaauccaucgucgcggaccuagccggcagcccagccaucaagaaagggauacuacagucccucaaaaucgucgacgagcuaguaaguaucaugggcuacccaccgcaaacuauaguagucgaaauggcucgggaaaaccaaaccaccgguaaaggcaaaaacaacucgaaaccccgauacaaauccuuggaaaaagcuaucaaagaguucggcagcaaaauccuuaaggaacaccccacagacaaccaagaacucaaaaauaaccggcuauaccuuuacuaccuccaaaacggcaaggacauguacacaggacaagaacuggauauccacaaucucuccaacuaugacauagaccacauaguaccccaaucauucauaacggacaacagcauagauaaccucguccuaacauccagcgcgggaaaccgugaaaaagggggcgacguaccuccccuugagaucguacgcaaaagaaaagucuucugggaaaaacuauaccaaggcaaccuaaugagcaaacgcaaauuugacuaccuaacaaaagcagaacgaggcgggcucacggacgccgacaaagcgcgcuucauacaucgccagcucguagaaacgcgacagaucacgaaaaacgucgcaaacauacuccaccaacgauucaacaacgagacugacaaccacgggaacaccauggaacaagucagaaucgucacacugaaguccgcacuugugucccaauuccguaaacaauuccagcucuauaaaguuagggaaguaaacgauuaccaccacgcccacgacgcguaucugaauggaguagucgcaaacacguuacugaaagucuacccgcagcucgaacccgaguucgucuacggcgaauaccaccaauucgacugguucaaggcuaacaaagccaccgccaaaaagcaauuuuauacuaacauaaugcuauucuucggccagaaggaacgcauuaucgaugaaaacggcgaaauacucugggacaaaaaguaccucgaaacaaucaagaaaguccucgauuaucgucaaaugaauaucguaaagaaaacagaaauccaaaaaggcgaguucuccaaagcaaccauuaaacccaagggcaacucaagcaaacucauaccgcgaaaagaaaacugggacccuaugaaauacggcgggcuggacuccccaaacauggcauacgcaguaaucauagaacaugcaaaagggaaaaagaaacuuaucuucgaaaagaaaauaauccgcaucaccauaauggaacgaaaaauguucgaaaaggaugaggaggccuuucucgaggaaaagggcuaucgucacccuaagguccuaacaaaacucccaaaauacacccuguaugaaugugagaaaggacgccgccgaaugcucgccagugccaacgaagcccaaaagggaaaccagcuagugcucuccaaccaccuuguaucacugcuuuaccacgccaaaaacugcgaagccagcgacgggaaaagccuaaaauacauagaagcccaccgagaaacauucucagaacuucucgcccaaguaucagaguucgcaacacgcuacacgcucgcugacgcaaaccugagcaagaucaacaaccuguuugagcaaaacaaagagggcgacauccaagcaauagcgcagagcuucguagaucucauggccuucaacgccaugggcgcccccgccuccuucaaguucuucgaagcuacuaucgaccggaaacgauacacuaaccuaaaagaacuccucucaagcaccauaauauaccaauccaucaccggccuauacgaaucacguaaaaggcucgacgacuga

SEQ ID NO: 6433 - RNA, 4005 nt, Artificial Sequence
  Cas9 variant
augaaaaagccauacaccauuggacucgacauuggcaccaacucggugggcugggcagcccuuacggaccaguacgaccucgucaagcguaaaaugaagguggcuggcaacagcgagaaaaagcaaaucaagaaaaaccucuggggaguccggcucgucgacgaaggcaaaaccgcugcucaccguagaguaaaccgcaccacccgcaggcguaucgaaaggcgcagaaaccgaauaaguuaccuccaagaaauauucacggcagaaauguuugaagucgacgccaacuucuuuuaucgccuagaagauuccuuuuacauagaguccgaaaagcgccaaucgcgccaucccuucuucgcuacgaucgaagaggaagucgcguaccacgaaaacuacaggaccaucuaccacuugcgcgagaagcuagucaacucgucggauaaagccgacuuacgacuggucuaccucgcccucgcacauaucauaaaguaccgaggcaacuucuuaaucgaaggcaagcucgacaccaaaaacacaucgguagacgaaguuuucaaacaauucaucaagacauauaaccaagucuucgccuccgacauagaggagggcagccucacgcgcauugaagaaaacaaugaaguagccaagaucuucuccgaaaaacuaacgaaaagagaaaaacuggacaagaucuuaaaccucuacccaaacgaaaagagcacagaccuauucgcgcaguucaucucacucaucaucggcucaaaaggcaacuucaagaaauucuucaacuugacagagaaaaccgacaucgaaugcgcgaaagacuccuacgaggaagaccuagagguccuacuggccagagucggggacgaguacgccgaaauauucguagcggccaaaaacgccuacaaugcggucguccucucaagcaucauuaccgucagcaacacggaaaccaaggccaagcuauccgccucaaugaucgagcgguuugacaaacacgacaaagaccucaaacgaaugaaggcauucuucaagguccguuugccagaaaacuucaacgagguauucaaugacguagagaaagacggcuacgcuggcuacauagaaggcaaaaccaagcaggaagcguucuacaaauacaugaaaaagaugcucgaacacgucgagggcgcagacuacuucaucaaccaaauagaagaagaaaacuuccuccguaaacagcgcaccuuugauaacggcgccaucccacaccagcuccaccuggaggaacuagaggcaauccuccaccaacaagccaaauacuacccauuccucaaaguagacuacgaaaagauaaaaucccuuguaacguuccgaaucccguacuucgucggaccccuggcuaacgggcaaagcgaguucuccuggcucacgcgaaaagcagacggagaaauaagacccuggaauauagaagaaaagguugacuucggaaagagcgccaucgacuucaucgagaaaaugaccaacaaagauaccuaucucccaaaagagaacguccugcccaaacacaguaugugcuaccaaaaauacaugguauacaacgaacucaccaaaauacgcuauaccgacgaccagggcaaaacacacuacuucucgggacaagagaaacaacaaaucuuuaacgaccucuuuaaacaaaagcggaaagucaaaaagaaagaccuagagcuauuccuauacaacaugaaucacguagagucaccuacggucgagggagucgaggacgccuucaauucuuccuuuaccaccuaccacgaccuccaaaaaguaggcgugccacaggagauccucgacgacccgcucaacacugaaaugcuggaagagauaauaaaaauccuaacggucuucgaagacaaacgcaugauuaaugagagacugcaagaguucagcaacguccuggacgaagcaguucugaaaaagcuggaaaggcgacauuacacgggguggggccgacucagcgccaaacugcugauaggcauccgcgacaaagaaagccaccugacgauccucgacuaccugaugaacgacgacaaacacaaccgcaaccugaugcaacucaucaacgacucgaaccucagcuucaagagcaucaucgaaaaggaacaagucaguacggccgacaaggacauccagagcaucgucgccgaccucgccggaagcccugccauaaagaaaggcauacuccagucccuaaaaauagucgacgaacucgucggcauaauggguuacccaccccaaaccauaguggucgaaauggcccgcgagaaccaaacaacgggaaaagggaaaaacaacaguaagccccgcuucaccagccuugagaaggcgaucaaagagcuaggcucccaaauccuaaaagaacacccaaccgacaaccaaggacucaaaaaugacagacucuaccucuacuaucuacaaaauggcaaggacauguacacgggacaagaacucgacauucacaaccuaagcaacuacgacaucgaccauguaguaccgcagagcuucaucaccgacaacucaaucgacaaccgcguucuagccuccucggcggccaaccgcgagaaaggagacaacguccccucgcucgaggucguacgcaaacgaaaagucuacugggaaaaacuauaccaggccaaacucaugucuaaaaggaaauucgauuacuuaacgaaagcggaaaggggaggguuaacagaagccgauaaagccagauucauacaccgucagcucgucgagacccgccagauaaccaaaaacguagcaaacauacuacaccagcgauucaacugcaaaaaggaugaaagcgggaacgucaucgaacagguccgaauaguaacacucaaagccgcccuaguaucccaauuccgcaagcaauuccaacucuacaaagucagagaaguaaacgacuaccaucacgcccacgacgcauacuuaaacugcgucguagccaacacacugcucaaaguuuacccgcaacucgaaccugaguuugucuacggggacuaccaucaauucgacugguucaaagcaaacaaagccacugccaagaaacaauucuacacgaacaucaugcuauucuucgcaaagaaagaccgcaucauagacgagaacggagagauacucugggacaagaaauaccucgacacaauaaagaaagugcugaacuauagacaaaugaacaucguaaagaaaacagagauacaaaaaggagaguucuccaacgccaccgccaacccaaaaggcaauuccaguaaacugaucccccgcaaagccgacugggaccccaucaaauacggcggcuuugacggcucaaacauggcauacgcgaucguaauugaacacgaaaaacgaaagaagaaaaccgugaucaagaaagaacucauucaaauuaacaucauggaaagaacagcuuuugagaaagaccaaaaagaguuccuggagggcaaaggauaccgaaaccccaaagucaucacaaaaaucccgaaauacacauuguaugaaugcgaaaacggccgacgccgcaugcugggaagcgcaaacgaagcacaaaaaggcaaccagaugguccuccccaaccaccugaugacccuacucuaccacgccaaaaacugcgaagcgucggauggcaaaucacuagcauacaucgaaucacaucgggaaauguuugccgaacuccucgacagcaucucagaguucgccucacgcuauacccuugcagacgcgaaccuggagaaaauuaacacaauauucgagcaaaacaaauccggcgacguuaaaguaauagcacaguccuucguaaaccuguuggaguucaacgcaaugggagcaccagccucguuuaaauauuucgaaacgaauaucgaacgcaaacgauacaacaaucugaaggaauuguuaaacgcgacaaucaucuaccaauccaucacgggccuguacgaagcccgcaagcgcuuagacgauuga

SEQ ID NO: 6434 - RNA, 4005 nt, Artificial Sequence
  Cas9 variant
augaagaauccguacacaauagggcuggacauagggacgaacagcguaggcugggccguauuaaccgaccaauacgaccuagucaagcgcaaaaugaaagucgccgggaacagcgacaagaaacagaucaaaaagaauuucuggggaguacgccuauuugacgacggacaaacagcaguagaccgaagaaugaacagaaccgcccgccgacgaauagagcgccgaagaaaccgaaucuccuaccugcaagaaaucuucgcagucgagauggcuaacauagacgccaauuucuucugcagguuaaacgauagcuucuacgucgacuccgaaaaacgcaacagccggcaccccuuuuucgccacaauagaagaagaagucgcuuaccacaaaaacuaccgcaccaucuaccaccugagagaggagcucgucaacucgagcgaaaaggccgaccuacgccuagucuaccuagcgcuagcucauauaaucaaauacagagggaacuuccucauagagggcgcccuugacaccaaaaacacauccguagacgaggucuacaaacaauucauccaaacauacaaccaaguguucaugaguaacaucgaagaaggagcacucgccaagguugaggaaaacacagaagucgcaagcauacuagcaggcaaauucacccgacgggaaaaauucgagcgaauacuacggcucuacccaggcgaaaaaucgacaggcauguuugcccaguucauaagccucaucguagggaacaaaggcaacuuccaaaaagucuucaaccugguagagaagacggacaucgaaugcgcaaaagacagcuacgaggaagaccuugaagcacuccucgcaaucauuggcgaugaauacgcagagcuauucguggccgccaaaaacaccuacaaugccgucgugcuuucaucaauaaucaccguuacugcuacagaaaccaacgccaaguugagcgcaagcaugauugagcgauuugacgcacacgaaaaagaacucggagaacuaaaagcauucaucaaacuacaccucccaaaacaauaucaggaaauauucaacaacgccgaaauagauggauacgccggcuacaucgacggaaaaacaaagcagguagacuucuacaaauaucucaagaccaccuuagaaaauguagaaggcgcagacuauuucaucacaaaaaucgaagaagaaaacuuccuccguaagcaacggacguucgacaacggagucauaccacaucagcuucaccucgaggagcucgaagcgauacuccaccaacaggcgaaauauuaccccuuccuccgcgaaggcuacgauaaaauaaaaucucuugucacguucagaauccccuacuucgucggcccgcucgcgaacggacaaucggaguucgcauggcugaccagaaaagacgauggugaaauacgacccuggaacaucgaagaaaaagucgacuucggaaaaucagccgucgacuucauagaaaagaugaccaacaaagacaccuaccuaccaaaagagaacguacucccaaaacacucauuguguuaccaaaaguacauggucuacaacgagcugacaaaaauccgcuacaucgacgaccaaggaaagacaaacuacuucagcggacgggaaaagcaacaaaucuucaacgaccucuuuaaacaaaaacgcaaaguaaagaaaaaggaccucgaacuauucuuacguaacauuaaccacaucgaaucccccacgaucgaagggcuagaagacagcuucaacgcaagcuacgccaccuaucacgaccugcuuaaggucggccucaaacaagagauccucgacaacccccuuaacacagaaauacuggaggacauagucaagauauuaacuguauucgaagauaaacgcaugaucaaggaacagcuggagcaauucucagacguguuggacggcgucguacugaagaagcuggaacggcgccauuauacgggauggggaagacugagcgcaaagcuccucgucggcauacgcgacaagcaaucccaucugacgauccucgacuaccugaugaacgacgacggccucaaccgcaaccucaugcaacugaucaaugacucaaaccucuccuucaagucaauaaucgaaaaagagcagguauccaccaccgacaaggaccuccagagcauagucgcugaccuagccggaagcccggcaauaaagaaagggauccuacaaucacuuaagauuguugacgaacuuguaucaaucaugggcuacccgccacaaacaaucgucgucgagauggcucgugaaaaucagacaacaggaaaaggcaaaaacaacuccaaaccaagauacaaaucguuagaaaaggcuauaaaagacuuuggaucacagauccucaaagagcacccgaccgacaaccaggaacucaaaaacaacagacucuaccucuacuaccuccagaacggaaaggauaucuacacaggccaagaacuggacauccacaaccuuucgaacuacgacauagaccacauagugccacaaucauucaucacagacaacagcauagacaaccuagugcuuacgagcucggccggcaaccgcgagaaagggggcgacgucccaccccucgagauagucagaaagcguaaaguguucugggagaagcuguaccaaggcaaccuuaugagcaaacggaaguucgacuaccugaccaaagccgaacgcgggggacuaacugaggcagacaaagcgcgcuucauccacaggcagcuagucgaaacaaggcaaaucacgaaaaacgucgcaaacauacuacaccaaagauucaacaaggagacugacaaccacggcaacaccauggaacaaguucgaaucgucacccuaaaaucagcacuggucagccaguucagaaaacaguuccaauuauauaagguacgcgaagucaaugauuaccaccaugcgcacgacgccuaccucaacggcgucgucgccaacacacuacuaaagguguacccacaacucgagccagaguucgucuauggcgaauaccaccaauuugacugguucaaggccaauaaagccaccgccaaaaagcaauucuacacgaacauaauguuguucuucgcacaaaaggagcgcauaaucgacgagaacggcgagauccuaugggauaagaaguaucuagaaaccauaaagaagguacuagacuaccgccaaaucaacaucguuaaaaagaccgaaauacagaaaggggaauuuucgaaagccaccaucaagccgaaaggaaacucauccaagcucauccccaggaaagagaacugggacccaguaaaguacgguggccucgacuccccaaacauggcauacgcaguaaucaucgagcacgcaaaggggaaaaagaaaauagucaucgaaaagaaauugauccagaucaacaucauggaaagaaaaauguucgaaaaagaugaagaggcguuccuagaggaaaagggauaccaccagccaaagguccuaaccaagcucccgaaauacacccuauacgaaugugagaagggacgacgccgcaugcuaagcucagccaacgaagcccaaaagggcaaccaacucguacuuucgaaccaccucgucagccugcucuaccacgccaaaaacugcgaggcauccgacgggaaauccuuaaaauacaucgaggcacaccgcgaaacguucucagagcuucuagcccagguuuccgaguucgcuaccaaguacacccuagccgacgcuaaccugagcaagauaaacaaccuuuuugaacaaaacaaggagggcgacaucaaggcuaucgcacaauccuucguagaccucauggccuucaacgccaugggcgccccggccucguucaaauucuucgaggcaacaauagaccgcaaacgauacaccaaccuaaaggaacuccuaagcagcaccaucaucuaccaaucuaucacaggccuguacgaaucgcgcaaacgacuggaugacuga

SEQ ID NO: 6435 - RNA, 4005 nt, Artificial Sequence
  Cas9 variant
auggguagaaagccguacauccugagccuagacaucgggaccggcucagucggcuacgcaugcauggacaaaggcuuuaacguccucaaauaccacgacaaggacgcccucgguguauaccucuucgacggcgccuuaaccgcucaagagcgccgacaauuccggacaucccgcaggaggaagaaccgacgaauaaaacgccucggacugcuccaagaacugcucgcaccauuaguccaaaaccccaacuucuaccaauuccagcgccaauuugccuggaaaaacgacaacauggacuucaagaacaaaagccuuuccgaggugcugucauuccucggauacgagucaaagaaauacccaaccauauaccacuugcaagaagcacugcuccucaaggacgagaaauucgacccggagcucaucuacauggcgcuguaccaccuggucaaguaccgcggccauuuccucuucgaucaccugaaaaucgaaaaccuaacaaacaacgacaacaugcacgacuucguugaacucauugagacuuacgaaaaccucaacaacauuaaacuaaaccuagauuacgagaaaaccaaagugaucuacgaaauccucaaggauaacgaaaugaccaaaaaugacagggccaagcgagucaaaaacaugcaaaagaaacucgaacaauucuccauaaugcuccucggccugaaguucaacgaagguaaacucuucaaccacgccgacaacgccgaagaacugaagggagcgaaccaaagccacacauucgcagacaacuacgaagaaaaucucacccccuuccucacuguagaacaaucagaguucaucgaacgugcaaacaaaaucuaccucagccugacauuacaagacauccugaaagggaagaaaaguauggcuauguccaaaguggccgccuacgauaaauuccgaaacgaacugaaacagguaaaggacaucguguacaaagcggacuccacacgcacacaguucaagaaaauuuucguaucaagcaagaaaagccuaaaacaauacgacgcaaccccaaaugaccagacauucagcucccucugucucuucgaucaguaccuaauccgacccaagaaacaauacucacuacucaucaaagagcucaagaaaauaaucccgcaagacagcgaacuauacuucgaagccgaaaacgauacgcugcucaaaguccuaaacacuaccgacaacgcgagcauccccaugcagaucaaccuauacgaagccgaaacuauacugcgcaaccaacagaaauaccaugcagaaaucaccgacgaaaugaucgagaaagugcucagccucauccaauucagaaucccuuacuauguuggcccccuggucaacgaccacacagccagcaaauucggcuggauggagcgcaaaucgaacgaaagcauaaaaccauggaacuuugacgaaguggucgauaggagcaaaagcgcuacucaguucauucgcagaaugaccaacaaaugcucauacuuaaucaacgaagacgugcuccccaaaaacucucuccuauaucaagaaauggagguccucaacgaacucaacgcaacccaaauacgccuacaaaccgaccccaaaaaccgcaaguaccgcaugaugccacagaucaagcucuuugccgucgagcacaucuucaagaaauacaaaaccgucucccacucgaaauuucuggaaauaaugcuuaacucgaaccaccgagaaaacuucaugaaccacggcgagaaacugagcauuuucggcacccaagacgacaagaaauucgccuccaaacuaucgagcuaccaagacaugacaaaaauauucggcgacauagaaggaaaacgagcccaaaucgaggaaauaauacaauggauaacaauuuucgaagacaaaaagauacucguucaaaaacucaaagagugcuauccagagcuuaccucaaaacaaaucaaccagcucaaaaagcuaaacuacagcggcugggggcgccuguccgagaagcuccucacacacgccuaucaaggccacagcauaaucgagcuacuacggcacucugacgaaaauuucauggaaauacuaacuaacgacguauacggauuccagaacuucauaaaggaggagaaccaaguacaaagcaacaaaauucagcaccaagacaucgcaaaccucaccaccucucccgcgcuuaagaaagggaucugguccacaaucaaacuuguacgugagcuaacguccaucuucggagaacccgaaaagauaaucauggaguucgccaccgaagaccaacaaaagggaaaagaacagaaaucccgaaagcaacuaugggacgacaacauaaagaagaacaaauuaaaaagcguagacgaauacaaauacauaauagauguagcuaacaaacuaaacaacgaacaacuccagcaagaaaaacuguggcuuuaccuuagccagaacgguaaauguauguauagcggucagucaauagaucuagacgcucugcuaucgccaaaugccaccaaacacuacgaagucgaccacauauucccgcgcuccuucauaaaggacgacagcaucgacaacaaagugcuugucauaaagaaaaugaaccaaaccaagggugaccagguaccacuacaauucauccaacagcccuacgaacgaauagcauacuggaaaucccuaaacaaggccggccuuaucucugacagcaaacugcacaaacucaugaaaccagaguucaccgcuauggacaaggaaggcuucauccaaagacagcucguugaaacacggcaaaucagcgugcacguacgcgacuuccuuaaggaagaauaccccaacaccaagguuauaccgaugaaggccaaaauggucuccgaauuucggaagaaauucgacauccccaaaauccgccaaaugaacgaugcgcaucacgcuauugacgcauaccugaacggcguaguauaccacggggcccaacucgcauacccaaaugucgaccuguuugacuucaacuucaaaugggaaaaaguccgcgaaaaauggaaagcacucggcgaguucaacacaaaacaaaaaucccgagaacucuucuucuucaagaaacucgagaaaauggaagucucgcagggggaacgccuuaucucgaaaauaaaacucgacaugaaccacuucaagaucaacuacuccaggaagcuagcaaauauaccccaacaauucuacaaccagaccgccgucuccccaaaaaccgccgaauugaaguacgaaagcaacaaaucuaaugagguagucuacaagggacuuacccccuaccagacuuacgucguagccauuaaaucagugaacaaaaagggcaaagagaaaauggaauaccaaaugaucgaccauuaugucuucgacuucuacaaauuccaaaacggcaaugaaaaagaacuagcucucuaccucgcucagcgcgaaaacaaagacgaagugcuagacgcacagaucgucuauagccucaauaagggcgaccuucuauacauaaacaaccacccuugcuauuucguuucacgaaaagaaguaauaaacgcuaaacaauucgaacucacggucgaacaacagcugucccucuacaacgucaugaacaacaaggaaacgaacgucgaaaagcuccucaucgaauacgacuucaucgcagaaaaggugauaaacgaguaucaucacuacuugaacuccaaacugaaggagaaacgaguccgcaccuucuucuccgagagcaaccagacccacgaagacuuuaucaaggcacuagacgaacucuuuaaagucguaacggcaagcgcgacccgguccgacaaaaucggcucccgcaaaaacucgaugacucaccgcgccuuccuggggaaaggaaaagacgugaagauagccuacaccagcaucagcggccucaagacaaccaaaccaaaaucccucuucaaacucgccgaaucccggaacgaacucuga

SEQ ID NO: 6436 - RNA, 4005 nt, Artificial Sequence
  Cas9 variant
augaaaaaucccuacaccaucggccuagacaucggaacgaacuccguagggugggcuguccuaaccgaccaauacgaccucguaaaacggaaaaugaaggucgccggaaacagcgauaagaaacaaaucaagaaaaacuuuuggggaguccgccucuuugacgagggagaaaccgcagcggacagaaggaugaaccgaaccgcccgccgccgaauagaacgccgccguaaucgcaucaguuaccuccaggagauauuugcucuagaaauggcaaacaucgacgcaaacuucuucugccgucuuaacgacagcuucuacguggacagcgagaaacggaacucgcgacaccccuucuucgcaacgauagaggaagaaguggccuaccacaaaaacuaccggaccaucuaccaccuccgagaagaacucgucaacucuagcgagaaagcagaccuacgccucgucuaccuagcccuagcgcacauuauaaaauacaggggaaacuuccugaucgaaggggcgcucgauacuaaaaacaccagcguagacggagucuauaagcaauuuauccaaacauacaaccaaguguucauaagcaacaucgaagaaggcacccuggccaagauggaagaaaacacaaccgucgccgacauccucgcgggcaaauucaccagaaaagagaaacuagaaagaauccuccaacucuaccccggugagaaaaguacagggauguucgcccaauuuaucagccugaucguagguucaaagggaaauuuccaaaaaguauucgaccuaguagagaaaaccgacauugaaugugccaaagacucguacgaagaggaccuggaagccuuacuggcaauaauaggugaugaauacgccgagcuauucguugccgcgaaaaacacguacaacgccgucguccucagcaguauaauaaccgucacggacacggaaacaaacgccaagcugagugccagcaugaucgaacgauucgacgcacacgaaaaagacuuaagagaacugaaagcguuuaucaaacuacaccuccccaaacaauacgaagagaucuucagcaacgucgccauagauggcuacgcgggauacaucgacggaaaaaccaaacaaguagacuucuacaaauaccucaaaacgcuacucgagaacaucgagggggccgacuacuucaucgccaaaauagaagaagaaaacuuccuucgcaagcagcgaacguucgacaauggugccaucccacaccaacuucaccucgaagaacuagaagcgauccuacaccaacaagcaaaauacuacccguucuucaaagaggcuuacgacaaaauaaaaucgcucguaaccuuccguaucccauacuucgugggcccacuggcaaacggacagagcgacuuugccuggcucaccaggaaagccgauggcgaaauacgucccuggaacauagaggaaaaggucgacuucgggaaaucagcagucgacuucauagagaaaaugacaaacaaagauacauaccuaccaaaagaaaacgucuuaccuaaacacagccuauacuaccaaaaauacaugguauacaaugaacuaacaaaaguacgcuauaucgacgaccaagggaagacaaauuacuucucuggacaagaaaaacaacaaauauuuaacgacuacuucaaaaagaaacggaaaguaucaaagaaggaucuagagcaguuccuacggaacaugagccacaucgagucgccgacaaucgagggacucgaagacagcuucaacagcucuuaugcaacauaccacgaccugcucaaggucggaauaaagcaagaaguccuggaaaacccccuaaacaccgagaugcuggaggacaucguaaaaauccucacagucuucgaggacaagcgcaugauaaaggaacaacuacaacaauucucagauguacuugacggugccguccuaaagaaacuagaaaggagacacuacacaggcuggggacgccucucggcaaaacuccuuguagggauccgagacaaacaaucgcaccucaccauccuugacuaccuaaugaacgacgacggguuaaauagaaaccuaaugcaauuaaucaacgacagcaaccugucguucaagagcaucaucgaaaaagagcaaguaagcacgacggacaaagaccuccaauccaucguggccgaccuggccggaagcccggcaaucaagaaagggauccuccaaucacuaaaaauaguagacgagcuuguaagcaucaugggauacccgccccaaacaauagucgucgaaauggcaagagagaaccagaccaccgucaaaggaaagaacaacagccggcccagauacaagucacucgaaaaggccauaaaagaguucggaagccagauccugaaagaacaccccacggacaaccaagaacuacgcaacaacagacucuacuuauauuaccugcaaaacggaaaagacauguacacggggcaagaacuugacauacacaaucucucaaacuacgacaucgaccauauaguaccccagagcuuuauaacugauaacagcauagacaaccuaguccucacaucuagcgcgggcaacagagaaaagggcgacgacguaccaccccuggaaauagugcgaaaacgcaaagucuuuugggaaaaacucuuccagggcaaccuaaugagcaagagaaaguucgacuaccugaccaaggcagaacggggcggccugaccgaggccgacaaggccacauucauccaccggcagcucgucgagacacgucagaucacgaaaaacgucgccaacauucuccaccaaagguuuaacaacgaaaccgacaaucacggaaauaauauggagcagguccgaaucgugaugcugaaaagcgcccuggucucgcaauuucgcaagcaauuccagcucuacaaaguucgggaagucaacgacuaccaccacgcacacgacgcuuaucucaacggagucguagcaaacacccuccugaagguguacccgcaacucgagcccgaguucguguacggagaauaccaccaguucgacugguucaaagcgaacaaggcgaccgcaaagaaacaauucuacaccaacauaaugcuauucuucgcccagaaagagcgaaucaucgacgagaacggagagauacucugggacaagaaauaucuagagacaaucaagaaaguccucgacuaucgucagaugaauauagucaagaaaaccgaaauccaaaaaggcgaguucagcaaagcgaccauaaaaccaaagggaaacuccucuaagcuaaucccuaggaaagaaaacugggaccccaugaaauacggcgggcuggacagcccaaauauggcuuacgcugucauaauagaacaugcuaaaggcaaaaagaaagucguuuucgaaaagaaaaucauaagaaucaccaucauggaacgaaaagcguucgaaaaagacgaaaagagcuuccuugaaaaacaaggauaccggcaaccgaaagugcugaccaagcugcccaaguacacacuguaugaaugcgagaauggacgcagacgcaugcucgccagcgccaacgaggcacagaagggaaaccagcaaguccuuaaggggcaacucauaacgcuacugcaccacgcgaaaaacugcgaagcaagcgacgggaaaucacuagacuacauagaauccaacagggaaauguucggagaacuccuggcacacguauccgaguucgcgaaacgcuacacacuagccgacgcgaaccuguccaaaaucaaucaacucuucgaacagaacaaagacaaugauauuaaagucauagcacagagcuucgucaaccugauggcauuuaacgccaugggugcccccgccagcuucaaauucuucgaagcgacgauagagcggaaaagguacaccaaccuaaaggaacuccuaagcgccacaauuaucuaccaaucaaucacggggcuuuacgaagcgcgaaagagacuagacggcuga

SEQ ID NO: 6437 - RNA, 4005 nt, Artificial Sequence
  Cas9 variant
augaaaaacccguacacaaucggccuugacauaggcaccaacagugucgggugggcgguccuaacuaaccaauacgaccuugucaaacguaagaugaaaguggcaggaaauagugacaaaaagcagaucaaaaagaacuucuggggaguccgacuguucgacgacggacaaacggcagucgaccgccgaaugaaucggacagcccggcgccgcauagaacgccgccggaaccgaauuuccuaucuccaggaaauauucgcagucgaaauggccaacaucgacgcgaacuucuuuugcagacucaacgacagcuucuacguggacucugaaaaacguaacucucgacaccccuuuuucgcgaccaucgaagaagaaguagccuaccaugacaacuaccgcacaauauaccaccuucgcgaggagcucgugaacucaagcgaaaaagccgaccuaaggcucgucuaccuagcacuagcacacauaauuaaauaucgaggcaacuuccucaucgagggcgcgcuggauacgaaaaacacaucggucgacgaaguguacaaacaguucauccaaacauacaaccaaguauucaugucaaacaucgaagaaggagcccuagccaaagucgaagaaaaucuugaggucgcaucaauacucgccgggaaguuuacaaggcgagaaaaauucgagcgaauccugcggcucuaccccggcgagaaaagcacggggauguucgcgcaguucaucucccucaucguuggcaauaaaggaaacuuccaaaagguauucaaccucguagaaaagacagacaucgaaugcgccaaggacaguuacgaagaagaccuggaggcccuccucgcgauuaucggcgacgaguacgcagaacucuucgucgcagccaaaaacacguacaacgcagucguccuaagcuccauaaucacgguaacagcuacggaaacaaacgcgaaacuauccgccagcaugaucgaacgauucgacgcacacgaaaaagaccucggcgaacugaaagccuucaucaaacuccaucugcccaaacaauaccaggaaaucuucaacaacgccgcuaucgacggcuacgccggcuacaucgacggaaaaacgaagcaagucgauuucuacaaauaccuaaaaaccacccucgaaaauguagaaggagccgacuacuuuaucacaaagauagaggaggaaaacuuccugcgcaagcagcgcaccuucgacaauggcguuauuccccaccaacuacaccucgaggaacucgaagccauccuacaccaacaagcaaaguacuaccccuuccucagagaagacuacgagaaaaucaaaucccucguuaccuuccgaaucccauauuucgucggaccccucgccaagggccaauccgaguucgccuggcugacaagaaaagcggacggagaaauacggccguggaacauugaagaaaagguagacuucggcaaaucagccguagacuucauagagaaaaugacaaacaaggacacguaccucccaaaagaaaauguccuccccaagcacucacucugcuaccagaaguacauggucuauaacgaacucacaaagguacgauacaucgacgaccagggcaaaacaaacuacuuuagcggccaagaaaaacagcaaaucuucaaugaccuguucaagcaaaaacgcaagguaaagaagaaagaucuggaacuauuccugcggaacauaaaccacaucgaaagccccacaaucgaaggccuagaggacagcuucaacgccuccuaugccacauaccacgacuuauugaaaguagguaugaaacaagaaagccucgacagcccacugaaugccgaaaugcucgaggacaucgucaaaauacuaacgguauucgaggauaaacggaugaucaaggaacaacuucaacaguucuccgacguacucgacgguguaguucucaagaaacucgaaagacgucacuacacgggguggggcagacuuagcgccaaacuacucgucgggauacgggacaagcaaagucaccuaacaauucucgacuaccuuaugaacgaugacggccuuaaccgaaaccuuaugcaacuuaucaacgacagcaaccucagcuucaaaaguauuaucgaaaaggaacaagugagcacaaccgauaaggaucuccagagcaucgucgcagaccuggccggaagcccagcaaucaagaaaggcauacuacaauccuuaaaaaucgucgacgaacuggucaguaucaugggauaucccccacaaaccauaguggucgaaauggcccgcgaaaaccagacuacaguaaaaggcaaaaacaacagccgaccccgcuacaaaucgcuggaaaaagcgaucaaagaguucggcucucagaucuuaaaagagcacccaaccgacaaccaagagcucaaaaacaaccgucucuaccucuacuacuugcagaacggcaaagacauuuacaccggccaggaacuggacauacacaaccucucuaacuacgacaucgaccacauagucccccagagcuucauaacagacaacaguauagacaaccucguucucacuagcucagcagggaaccgcgagaaaggcggugacgugccuccgcucgaaaucguucgaaagaggaaaguauucugggaaaagcucuaccaaggcaaccugauguccaaacggaaauucgacuaccuaacuaaagccgaacgaggaggucuaacggacgcggacaaagcgcgauucauacaccgucaauuagucgaaacccggcaaaucaccaaaaacgucgccaacaucuuacaccaaagauucaacaacgaaacagacaacuacggcaauacaauggaacaaguacgcauagucacccuaaaauccgcauuagucucgcaauucagaaagcaauuccaauuguacaaggucagagaggugaacgacuaucaccacgcacacgacgccuaucuuaacggaguggucgccaacacgcuacucaaggucuacccccagcucgagccagaguucguauacggcgaauaccaccaauucgacugguucaaggcaaacaaggcaaccgccaaaaagcaguuuuacaccaacauaaugcuuuucuucgcccaaaaggagcguaucauugacgaaaauggugaaauucuaugggauaaaaaguaccuggaaaccaucaaaaagguacuagacuacaggcaaaugaacauagucaaaaagaccgaaauacaaaaaggggaguucagcaaggccaccaucaagcccaaagggaacagcagcaaacugauccccaggaaagaaaacugggauccgaugaaauacggcggcuuggacucaccuaauauggcauacgccguaauaaucgaacacgcaaaaggaaagaagaaaauagucauagaaaagaaacugauccaaaucaacauaauggaacggaaaauguucgagaaagacgaagaagccuucuuagaggaaaaaggguaccgacaccccaaaguccucacaaaacuucccaaauacacccucuacgaaugcgagaaaggacggcgcaggaugcucgcuuccgcuaacgaggcccaaaaagguaaccaacucguccugagcaaccaucucgucagccuccuguaccacgcgaaaaacugugaagcaucugacggaaaaucgcuaaaauacauugaagcccaccgagaagcguucucggaacuccuagcccaggucuccgaguucgccacccgauacacccucgccgacgccaaccuaucgaaaauuaacaaccuauucgaacaaaacaaagaaggcgacauaaaggcaaucgcacaguccuucguagaccuuauggucuucaacgccaugggggcccccgccagcuucaaauucuucgaagccacaaucgaccgaaaaagauacacuaaccucaaggaacugcuaucgagcacgauaauauaccaaagcauaacggggcuguaugaaagcagaaaacgacuagacgauuga

SEQ ID NO: 6438 - RNA, 4005 nt, Artificial Sequence
  Cas9 variant
augaaaaaccccuacaccauagggcucgacauaggaacaaauuccguaggcugggccguacucaccgaccaauacgaccuaguaaaacguaaaaugaaaguugccggcaauucagacaagaaacaaaucaaaaagaacuuuuggggaguacgucuuuuugacgaaggcgaaaccgccgccgaccgccgaaugaacagaaccgcccgccgccgcaucgagcggcgacgcaacagaauaaguuaccuacaagaaaucuucgcccucgaaauggcgaacaucgacgccaacuucuucuguagguuaaacgacagcuucuacgucgauuccgaaaaacguaacucccgccacccauucuucgccacgauagaggaagaagucgccuaccacaaaaauuacagaaccaucuaccaccuccgagaggagcucguaaacuccagcgagaaagcggaccuccgccugguauaucuagcgcucgcacacaucauaaaauaccgaggcaacuuccugaucgagggagcacuugacaccaagaacacaagcguggacgguguuuacaaacaauucauacaaaccuauaaucaaguuuucaucuccaacaucgaagaagguacccuagccaaaauggaagaaaacaccaccguggcaaacauccucgccggcaaauucacuagaaaagaaaaacuugaacgcauacuccaacuguauccaggcgagaaauccaccggaauguucgcgcaguucauaagccucauagucggcuccaaaggcaacuuccaaaaaguuuucgaccucguagagaaaacagacaucgaaugcgcaaaagacagcuaugaagaagaccucgaagcccuccuggccauaauaggcgacgaauacgcagaacuauucguagccgccaagaauaccuacaacgccguaguccuuuccagcauaauaacaguaaccgacacagaaaccaacgcgaaacuuucugcuuccaugauugaacgguucgacgcgcacgagaaagacuuaagcgaacucaaggcauucauuaaacuccaccucccaaagcaauacgaagagaucuucagcaacguugcgaucgacggauacgcaggcuacaucgaugguaagaccaagcaagucgacuucuacaaguaccucaaaacacugcucgagaacaucgaaggcgcagacuacuucaucgccaaaaucgaagaagagaacuuccuacgcaaacaacgcaccuuugacaacggcgcuaucccccaccagcuacaccuggaagaacuagaggcuauccuccaccagcaagcaaaguacuacccauuccuaaaagaagccuacgacaaaauuaaaucacuuguuacauuccgaaucccauacuucgucggcccccucgcaaacggacaauccgacuucgccuggcugacccggaaagccgacggcgaaaucagaccauggaacaucgaggaaaaggucgacuucggcaagagcgccgucgacuuuaucgagaaaaugacaaacaaggauaccuaucugcccaaggaaaacguccugccaaaacacucacuuuacuaccaaaaguauaugguguacaacgaacucaccaaaguacguuacaucgacgaucagggcaagaccaauuauuucuccggccaggagaaacaacaaaucuucaacgacuacuucaaacagaagagaaaagucuccaaaaaggaccucgaacaauuccuacgcaacaugucacauauugaauccccgacgauagaaggacuagaagacagcuucaacucaucauacgccacguaccacgaccuccucaaagucggcauaaaacaggagguccuggagaauccacucaacauggagaugcucgaggacaucgucaaaauccucacaguguuugaggacaagcgaaugaucaaagaacaacuacaacaauucuccggaguccucgauggggcggugcucaagaaauuggaacgccgccacuacacaggcuggggccgccucucggcaaaacuucugguggguauccgggacaaacaaagccaccucacuauacucgauuacuuaaugaaugacgacggcuuaaaccguaaccuaaugcagcuuauaaacgauaguaaccuuagcuucaagucaauuaucgagaaagagcaaguaagcacuaccgacaaagaucuacaauccauagucgcggaccuagccggaucccccgcaaucaagaaagggauacuccaaucccucaaaauuguugacgagcuaguaagcauaauggguuacccgccccaaaccaucgucguagagauggcgcgcgaaaaccaaaccacaguaaaaggcaaaaacaacagccgaccacgguacaaaagccuggaaaaagccauaaaagaguucggcucccaaauacugaaagaacacccgacagacaaucaagaacuccggaacaacaggcucuaucuauauuaccuacaaaacggaaaagacauguauacgggucaagaacuagacauccacaaccucagcaauuacgauaucgaccacaucguaccccaaucauucaucaccgacaacagcaucgacaaccucgugcuaaccagcucugcuggaaaccgagaaaagggugacgacguacccccgcuagaaauaguccggaagcgaaaggucuucugggaaaagcucuuucagggcaaucucaugagcaaaagaaaguucgauuaccucacaaaggccgagagagggggccuaacugaagccgacaaggcgaccuucauacaucgucaacucguagaaacacgccaaaucacuaaaaacgucgcgaacauccuccaccaacguuucaacaacgaaaccgacaaucacggcaauaacauggaacagguacgcaucgucaugcugaaguccgccuuagucucccaauuccgcaaacaauuccaacucuacaaaguacgugaaguuaacgacuaccaccacgcacacgacgccuaccucaacggcgucguugcgaacacccugcucaaaguauauccccaacuggaacccgaguucguauacggagaauaccaccaauucgauugguucaaggccaacaaagccacagcuaaaaagcaguucuacaccaacaucauguuauucuucgcacagaaagaacgaaucaucgacgaaaacggugaaauccucugggacaagaaauaccuagaaacaauaaagaaaguacuggacuacaggcaaaugaacaucgucaagaaaacagagauccaaaaaggcgaguuuuccaaagcaacgauuaaacccaaaggaaacuccaguaaacucaucccuagaaaagaaaacugggacccaaugaaauacggagguuuagacucccccaacauggccuacgccguuaucaucgaacacgcuaaagggaaaaagaaaauagucuucgaaaagaagaucauaagaauuacuauuauggaaagaaaggcguuugaaaaagaugaaaaauccuuucucgagaaacagggcuaccgucagccgaaaguauugacaaaacuaccaaaguacacccuauacgaaugcgagaacggccgcagacgcaugcuagccagcgccaacgaggcacaaaaaggcaaccaacaagugcuaaaaggccaacuuauuacccugcuccaccacgccaaaaacugcgaagccucugacggaaagagcuuagacuacauagagagcaaccgcgagauguuuggcgagcuccuagcacacgucuccgaguucgcgaagagauacacccuugcggacgccaaccucagcaaaauuaaccaacucuucgaacagaacaaagacaacgacauaaaagucauagcccaaucauucgucaaccuaauggccuucaacgcuaugggggcccccgccuccuuuaaauucuucgaggcgacuaucgagcggaaacguuacacaaaccugaaggagcuccucagagcaacaauaaucuaccaaucgaucaccggccucuacgaagccagaaagcgacucgacggcuga

SEQ ID NO: 6439 - RNA, 4005 nt, Artificial Sequence
  Cas9 variant
augaagaacccguauacaaucggccuagacaucggaacaaacucaguaggaugggcgguucuaaccgaccaguaugaucucguaaaaagaaagaugaagguggcaggcaacuccgacaagaaacaaauuaagaaaaacuucuggggcguccgacuauucgacgaaggggaaaccgcagcggauaggagaaugaaccgaacggcaagacgccgcauagagcgccgccggaaccgaauauccuaccuacaagaaauauucgcccuugaaauggcaaacauugacgccaauuucuuuugccgccuaaacgacuccuuuuacguggauucggagaaaaggaacucacgccaccccuucuuugcgaccaucgaagaagagguggccuaccacaaaaacuaccggacaaucuaccacuugcgagaggagcuagucaacuccucagaaaaagcugaccuccgacuggucuaccucgcccucgcacacaucaucaaguaccgcggaaacuuucucaucgaaggagccuuagauaccaaaaacaccucggucgacggcguguacaagcaguucauacaaacauacaaucaaguauucauauccaacaucgaagaaggcacccuagccaagauggaggaaaauacgaccguagccgacauacuagcagggaaauuuacgcggaaagaaaagcuagaacgaauacuccaauuauaccccggcgagaaaaguaccgguauguucgcccaguucaucagccucaucgucggaaguaaaggcaacuuccaaaagguguucgaccuuguagagaaaacagauauagaaugugcaaaggacuccuaugaagaagaccuugaagcccuccuagcaaucaucggagacgaauacgccgagcuauucguggccgccaaaaacaccuacaacgcagucguucuaagcuccaucaucacgguaacggacacggaaaccaacgccaaacuaucggccucgaugauagaacgguuugacgcccaugagaaagaccuauccgagcugaaagcauucaucaagcugcaucuacccaaacaauacgaagagaucuucucaaauguggcgaucgacggauacgcaggauacaucgacggcaagaccaagcaaguagacuucuacaaauaccuuaagacacuacucgagaacauagagggagccgacuacuucaucgccaaaaucgaggaggaaaacuuucuacggaaacaacgcacuuucgauaacggcgccaucccacaucagcugcaccuugaggagcuggaagccauucugcaccaacaggccaaauacuacccauuccucaaagaggccuacgacaaaaucaagucccucguuacauuccgcauacccuacuucguuggcccccuagccaacggccaaagcgacuucgcauggcucacccgcaaagcugacggggaaauccggcccuggaacaucgaagaaaaaguagacuucggcaaaucagcggucgacuucaucgagaaaaugaccaacaaggauacuuaccuccccaaagaaaacguccucccaaaacacucacuauauuaccaaaaauacauggucuauaacgaacucacgaaaguccgauacaucgacgaccaaggcaaaaccaacuacuucagcggccaggaaaagcaacaaauauuuaacgacuacuuuaaacaaaagcgcaagguuucaaagaaagaccuggaacaauuucuacgaaauaugucccacauugaaagccccacaauugaaggccuagaagacuccuucaacucaagcuacgcgaccuaccacgauuuacugaaaguaggcaucaaacaggaggugcucgaaaacccccucaacaccgaaaugcuagaagauaucgugaaaauacuaacagucuuugaagacaagcguaugaucaaggaacaacuacaacaguucucugacguccuggacggcgcaguccucaaaaagcuggaacgacgucacuacaccggcugggggcgccuuuccgcgaaacuccuggucggcauucgugacaaacaaucacaccucaccauacucgacuaccucaugaacgacgacggacucaacaggaaccuuaugcaacuaaucaacgacagcaaccucuccuucaagagcaucauagaaaaagaacaagucagcaccacagacaaagaccuccaaagcaucgucgccgacuuagccggcagcccggccaucaaaaaggggauccugcagucacucaaaauaguugacgagcuagucagcaucaugggcuacccaccccagacaauugucgucgaaauggcucgcgaaaaccaaaccacaguuaaaggcaaaaacaacagccguccgcgcuacaaaagucucgaaaaagccauuaaagaguuugguucccagauacuaaaagaacaccccacagacaaccaagaacuucggaacaaccgacuuuaccuauauuaccuacaaaacgggaaagauauguauacuggacaggaguuagacauccacaaccucuccaauuaugauaucgaccacaucguuccccaauccuucaucacagacaauagcaucgacaaucuaguccugacuagcucagccggcaaccgcgaaaagggugacgacgucccaccucucgaaaucguccgaaagcgaaagguauucugggaaaaacuauuccaagggaaccuaaugaguaagcggaaauucgacuaccugacgaaagccgaacgaggaggccucaccgaagccgacaaagccacguucauacaccgacaacucguggaaacccgacaaauaaccaagaacgucgccaauauacugcaccaacgauucaacaacgaaacggacaaccacggaaacaacauggagcaagugcgcauugucaugcuaaaauccgcccucgucucacaguuccguaaacaauuccagcucuacaaaguccgcgaagucaacgacuaccaucacgcucacgacgcauaccucaacggcguggucgccaacacgcuccucaaaguuuauccccaguuagagccggaguucguguauggugaauaccaccaauucgauugguucaaagccaacaaggcaaccgccaagaaacaauucuauaccaacaucaugcuguucuucgcccaaaaagaaaggaucaucgaugaaaauggggagauccucugggacaagaaauacuuagaaacaauaaagaaagugcucgacuaccgucagaugaacaucgucaaaaagacggaaauccaaaaaggcgaguucagcaaagcuaccauuaaaccgaaaggcaacucuuccaaacugaucccaaggaaagaaaacugggaucccaugaaauacggcggccucgacucaccaaauauggcauacgcaguaauuauagaacaugcaaagggcaagaagaaaguggucuucgagaagaaaauuauccggauaacgauuauggagaggaaagcauucgaaaaagacgaaaaaucuuuccuagagaaacagggcuacaggcaacccaaagugcugaccaaacuccccaaauacacccucuacgagugcgaaaacggcagaagacgcaugcucgccagcgccaacgaagcccaaaaaggaaaccaacagguacucaaaggacaacucauaacacuccuccaccacgcuaaaaacugcgaggcauccgacgggaaaucacucgacuacauagaaagcaaccgugaaauguucggcgaacuauuagcccacguauccgaguucgccaaacgcuacacgcucgcagacgccaaccucucgaaaaucaaccaguuauucgaacaaaauaaagacaacgacaucaagguaaucgcccaaucguucguaaaccugauggcguucaacgccaugggcgcucccgccuccuuuaaauucuucgaagcgaccaucgaaagaaagcgguacacaaaccucaaggaacuccugagcgcuacaaucauauaccaaaguauaaccggacucuacgaagcacgcaaaagacuagacggcuga

SEQ ID NO: 6440 - RNA, 4005 nt, Artificial Sequence
  Cas9 variant
augaaaaacccuuauacuaucggucuggacauaggcaccaacuccgucgguugggccguccucaccaaccaauacgaccucguuaaacggaagaugaaggucgccggcaacuccgauaagaaacaaaucaagaaaaacuucuggggaguccgacucuucgacgacgggcagaccgccgucgaccgccgaaugaaucgaacagccagacgccgaaucgaacgccgacgcaaucgaauuagcuaccuccaggaaauuuucgcaguagagauggccaacauagaugcaaacuucuucugccgccuaaacgauucuuucuacguggacagugaaaaacgcaacucccgccaccccuucuuugcaaccauagaggaggaagucgccuaccacgacaauuaccggaccaucuaccaccucagagaggagcucguaaacagcuccgaaaaagcggaucuccggcuggucuaccuugcgcucgcccacaucauaaaguaccguggcaacuucuuaauagagggagcucuagacaccaagaacaccagcguugacgaagucuacaaacaauuuauacagaccuacaaccaagucuucaugagcaacaucgaagaaggggcccucgcaaaagucgaagaaaaccuagaaguagcguccauccucgccggcaaauucacucgccgcgaaaaauucgaacgaauccuccgucuauaccccggcgagaaaucaaccggaauguucgcgcaauucaucagccucauagucggaaacaaaggcaacuuccaaaaaguguucaaccugguggagaaaaccgauaucgagugugcaaaggauucauacgaggaggaccuggaagcgcuccucgcgaucaucggcgacgaauacgcggagcuauucgucgcugcuaagaacaccuacaacgccguagucuuauccucgaucauaaccguaaccgcgacggaaaccaacgcaaaacucagcgcguccaugauugagcgauucgacgcccacgagaaagaccuaggcgaacugaaggccuucauaaaacuccaccuccccaagcaguaccaagagaucuucaacaacgccgcgaucgacggcuaugccggguacaucgacggcaaaaccaaacaagucgacuucuauaaauaccucaagacgacgcucgaaaacguugaaggcgccgauuacuuuaucacuaagaucgaagaagagaacuuccuacgaaaacaaagaacguucgauaacgggguuaucccgcaccaacugcaccucgaagaacuggaagccauucuccaccaacaagccaaguacuaccccuuccucagagaagacuacgagaaaaucaaaagccuaguuacuuuccgaauccccuacuucgucgggccgcucgccaagggccaaagcgaauuugcauggcucacucgcaaagcagauggcgaaauccggcccuggaacaucgaagaaaaaguagacuucgggaaauccgccgucgacuucaucgaaaagaugaccaacaaagacaccuaucugccuaaagagaacguacuacccaaacauucacucugcuaucaaaaguacaugguauacaacgagcugaccaaggugcgcuauauagacgaccagggcaagacaaacuauuucucgggacaagagaaacagcagauuuucaacgaccuauuuaaacagaaaaggaagguaaagaagaaagaccuagaacuauuucuaaggaacaucaaccacaucgaaaguccgacaauugaaggccuggaggacagcuuuaacgcuuccuacgcuacguaccacgaccuccuaaaggucggaaugaaacaagaaagucucgauuccccacugaaugcagaaauguuagaagacaucgucaagauccugaccguguucgaggacaagcgcaugaucaaggagcaacuccaacaauuuagcgauguccucgacggcgucguacuaaagaaacuagaacguagacacuauaccgguuggggaagacuaucggccaaacuacugguagggauccgggacaagcaaagccaucuaaccauacuagacuaccuaaugaacgaugacggccuuaacagaaaucuuaugcagcuaaucaacgacagcaaccucuccuuuaaaucgauaaucgaaaaggagcagguaagcacaaccgauaaggaucuccagagcaucgucgcagaccuugccggcagccccgcaauuaagaaggggauccuacaaucucuaaaaauaguugacgagcugguaucuaucaugggauaucccccucagaccaucgucguagaaauggcacgugaaaaccaaacaacuguuaagggcaaaaacaacucgcguccacgcuacaagagccucgaaaaggccaucaaggaguucggcucacagaucuugaaagagcacccgaccgauaaccaagaauugaaaaacaaccgacuauaucuguacuaccuacaaaacggaaaggacaucuacacuggacaggaacucgacauccacaaucugagcaacuaugacauagaccacauugugccccagagcuucauaacagacaacucaauagacaaucuaguccuaaccucaagcgccgggaacagggaaaagggcggugaugucccgcccuuggaaaucguccgcaaacguaaagucuucugggaaaaacuguaccaagguaaccugaugucuaagcgcaaguucgacuaccucacuaaagccgaacgcggaggacucaccgacgcugacaaagcccgauucauacaucgccagcuaguagaaaccagacagaucaccaaaaacgucaccaacaucuuacaccaacgauucaacaacgaaaccgacaacuaugguaauaccauggaacagguccgcauaguaacccucaaauccgcacucgucucccaauucagaaagcaauuccaacuguauaaaguccgggaagucaacgacuaccaccaugcccacgaugccuaccucaauggcguagucgcuaacacacuacugaaagucuacccccagcucgagccagaguucgucuacggcgaauaccaccaauucgacugguucaaagcaaauaaggcgaccgcuaaaaagcaauucuacaccaacaucauguuauucuucgcgcaaaaggaacguaucauagaugaaaacggcgaaauacugugggacaagaaguacuuggaaacaaucaagaaagugcucgacuaccgccaaaugaacaucgugaaaaagaccgaaauacaaaaaggcgaguucuccaaagccacgaucaagccgaaggggaacucaagcaaacuuaucccucguaaagaaaacugggauccaaugaaauacggcggucucgacucaccaaauauggcuuaugccgucaucaucgaacacgccaaaggcaaaaagaaaaucguaauagaaaagaaacugauacaaaucaacaucauggaacggaaaauguucgaaaaagacgaagaagcauuccucgaagaaaaaggauaccgccaccccaaaguccuaaccaaacugccuaaauacacccuguacgaaugugaaaaagggcgacgccguaugcuggcaagcgccaacgaggcgcaaaaggggaaccaacuuguacucucgaaccaccucgucucccuccucuaccacgcuaaaaauugcgaggccucagacgggaaaucccugaaauacaucgaggcacaccgagaagcauucucagaacuacuagcccagguaucagaguucgcgacccgcuacacccuggcagacgccaaccuauccaaaauuaacaaucuauucgaacaaaauaaagaaggcgacauaaaagccaucgcccaauccuucgucgaccucaugguauucaaugccaugggagccccagcgucuuucaaguucuucgaagcaaccauagacaggaaaagauacacgaaccucaaagaacuacucaguucgaccauuaucuaccaauccauaaccggacuauacgagucacgaaaacgacuagaugacuga

SEQ ID NO: 6441 - RNA, 4005 nt, Artificial Sequence
  Cas9 variant
augaagaaagaauacaccauaggccuggacauaggaacaaauagcgucgggugggcaguccuuacagaaaacuacgaccuggucaaaaagaaaaugaaagucuacggaaacacagaaacgaaauaccucaagaaaaaucucuggggagugcggcuauucgacgaaggagaaacagccgcagaccgcagauuaaaacguaccacccgacgccgauauucacgccggcgcaacagaauaugucggcuccaagauuuauucaccgaagaaaugaaccaggucgacgccaacuucuuccacagacuacaagaaucguuccuaguuccagacgaaaaagaguucgaacggcacgcaauauucggcaaaauggaagaagaagugucauauuaccgcgaguuccccacaaucuaccaucugcgcaaacaccuagccgacacgucagaacaagccgaucuccgacuugucuaucuagcccuagcccacauagugaaauaccgaggacacuuccuaaucgaaggcgaacucaacaccgaaaacagcuccgucagugaaacauuccgaacguucauacaaguguacaaccaaauauucagagagaacgaaguuccgcucgccguacccgacaauauugaggagcuauucagcgaaaaagucagccgugcaagaaaagucgaagcaauccuauccguuuacucagaagagaaauccacaggcacgcuagcgcaauuccuuaaacucauggucggcaaccaaggacgauucaagaaaaccuucgaccuagaagaagauggcaucauccaaauccccaaagaagaauacgaagaagaacucgagacccuccuagcaaucauaggcgacgaauacgcggagaucuucucagcgacaaaaagcguguacgaugcugucgcgcuaagcggcauccuaucagucaccgacggagauacuaaagccaaacucucggcgucuauggucgaacgguacgaagcccaccaaaaagaccuaguacaauucaaacaguucauaaggaaagaacugccagaaauguacgccccaauauuuagggacaacucaguuucuggguacgccggcuacguggagaacucgaaaguggucacacaagcagaguucuacaaauacauaaagaaagccauagagaaaguaccaggagcagaauacuuccuagagaaaauagaacaggaaacauuccuugacaaacaacguacauuuaacaacggcguaaucccacaccaaauacaucucgaggaacuggaggcgaucauccagaaacaagccaccuacuaccccuuccuagcagacaacaaagaagagaugaaacaguugguaaccuucagaauaccguauuacguaggaccccucgccgacgguaacucaccguucgcuugguuagagcgaaucuccucggagccaauccgacccggaaaccuggcagagguagucgacaucaagaaaagugcgaccaaauucaucgaacgcaugaccaacuucgacaccuaccuaccaaccgaaaaagugcuccccaaacauagcaugaucuacgaaaaauauaugguauacaacgaacuuacgaaagucucuuacgucgacgaaagagguaugaaccaacgguucucaggcgaagagaagaaacaaaucguagaggaacuguucaaacagagccgcaaaguuaccaagaaacuacuagagaaauuccucagcaacgaguucggccuaguagacguggccaucaaaggcaucgaaaccagcuucaaugcaggauacggaaccuaccacgauuuucucaaaaucggaaucacacgagaacaauuagacaaagaggaaaauucagagacacuggaagagaucgucaaaauacucacagucuucgaagaccgcaaaaugauccgcgagcagcugaagaaauacacauaccucuucgaugaggaaguguuaaagaaacuagagcgcaggcacuacacuggauggggacgccuaagcgccaaacuucucauagggauaaaagagaaacgcacccacaaaaccauccucgacuacuugaucgaagacgacggagguaaacaacccauaaaccgaaaccucaugcaauuaaucaacgacagcgaccucuccuucaaauccgagaucgccgaagcccaaucagacaugaacaccgaggaccuacaugaagugguccaaaaccucgccggauccccagcaaucaaaaagggcauacuccagucccuaaagaucguugacgaacuggucgauaucauggguucccuacccaaaaacaucgucguagagauggcccgagaaaaccaaacgacgagccgaggacgcaccaacucaaacccgaggaugaaagcccuggaagaagccaugcggaacuugcgaagcaaccuacuaaaggaauauccaacggacaaccaagcgcuucaaaaugaccggcucuaucuuuauuaccuacaaaacggcaaagacauguacacagggcuggaccugagccuucacaaccucucauccuacgauauagaccacauaguuccacagagcuuuaccacagacaacagccuagacaaccgcguacucgucuccagcaaagaaaaccggggcaagaaagaugacguaccaucaaaggaaguaguccaaaagaauauaacgcugugggaaacgcucaagaauagcaaccuuauaucccagaagaaauacgacaaccuaacgaaggggcuucgcggaggacuaaccgaagacgacagagcacacuucauuaaaagacagcuaguagaaacaagacagauaacaaagcacguagcacgaauccucgaccaacgauucaacucccagaaagacgaagaaggcaaaaccauccgagcaguacggguggugacccuaaagagcucacucaccagccaguuccgaaagcaauucgccauacacaagguacgagagaucaacgacuaccaccacggacacgacgccuaccuaaacggagucgucgccaauagccuacuaaggguauacccgcagcugcaaccagaguucgucuacggcgacuaccccaaauucaacgccuacaaagcgaauaaggcaacugccaagaaacagcuauauacgaacauaaugaaauucuuugcagaagacgccgucaucaucgacgaaaacggagaaauacugugggacaaaaagaauauugcaacagucaagaaagucaugucguacccacaaaugaauaucgucaagaaaccugaaauccaaacggggagcuucagcaaagagacaauaaaaccgaagggcgacagugacaaacucauaagccgaaaaaccaacuggagccccaaauuauacggcggcuucgacuccccacaggucgccuauagcgucauaaucaccuacgagaaagggaaaaagaagguccgagccaaagccaucgucggaaucacaaucauggaacaaagccuauuuaagaaagacccggucagccuacucgaagagaaaggcuacgccaacccagaaguacuaauccaccuaccgaaauauacacucuaugaacuggagaacggacgacgucgccuccucgcguccgccaacgaagcacagaagggcaaucaacugguacuaccugcaucgcucgugacauuacucuaccaugcgaaacaagucgacgaagacucuggcaaauccgaagaguacguaagagaacaccgagcugaguucgcagagauccuaaacuacguccaggccuucuccgaaaccaaaauacucgcaaacaagaaccuacagaccauacucaaacucuacgaggagaacaaggaggccgacauaaaggaaauugcagaguccuucguaaaccuaaugaaauuuucagcauacggagcccccauggacuucaaauucuucggcaagaccauaccacgcucacgauacacuucaguaggggagcuccucucagccacaaucauaaaccaguccaucaccggucuguacgaaaccagacgaaagcucgucgauuga

SEQ ID NO: 6442 - RNA, 4005 nt, Artificial Sequence
  Cas9 variant
augcgcaagcccuacacuauaggccucgauauaggaacgaacagugucggaugggcgguccucacagaccaauacaaccuggucaaaaggaaaaugaaaguugcaggcucagcggaaaagaagcagaucaaaaagaauuucuggggcgugcgacucuucgacgaaggggaaguggccgcaggccgacgaaugaacagaaccacaagaaggcgaauagaacggaggcgaaaccgcaucgccuaccuacaggaaauauucgccgcggaaauggccgagguagacgcaaacuucuuuuaccgacuagaagacuccuucuacaucgaguccgaaaagcgccacucccgacaccccuucuucgcuaccaucgaggaagaaguggccuaccacgaagaauacaagaccauauaccaccuacgugaaaaacucguaaacagcagcgacaaagcagaccucaggcucgucuaccuagcacucgcccacauaaucaaguaucgaggaaauuuccucaucgagggcaugcucgacaccaagaacacgagcguagaugaagucuuuaagcaauucauacaaacguauaaccaaaucuucgcgagcgacauagaggaagggucccuaaccaggcucgaggaaaacaaggagguggccgaaauccucuccgaaaagcuaacccgccgcgaaaaacucgacaaaauacucaaauuauacacaggagagaaaagcacagggauguuugccagauucaucaaccugaucauaggcaguaagggugacuucaagaaagucuucgaucucgacgaaaaagccgagaucgagugcgcgaaagacaccuaugaggaggaccuggaagcccuccucgccaaaauaggcgacgaauacgcagagauauuugucgcagcaaagagcacuuauaacgcugucguccucuccaauaucaucaccgugacagacaccgagacgaaagccaaacucagcgccuccaugaucgaacguuucgacaagcacgcaaaagaccuaaaacggcucaaggccuuuuucaaaaugcaacugccagaaaaauucaaugaggucuuuaacgacauugagaaggacggcuacgcaggcuacaucgacggcaagacaacacaagaaaaauuuuauaaguacaugaagaagaugcuagcuaacauagacggcgcugauuacuucaucgaccagauugaggaggaaaacuucuuaaggaaacaacggaccuucgauaacggcaccauuccacaccaacuacaccuggaggagcuggaagccauccugcaccaacaagcgaaauacuacccguuccuacgcaaagacuacgagaagauuaggucucucguaacguuccgcauaccauacuucauagggccccuugccaacggccagagcgacuucgccuggcugacgcgaaaggcugacggcgagauccgcccguggaacaucgaagaaaaagucgacuucggcaagucagccaucgacuucauagaaaagaugacgaauaaagacacguaccuucccaaggagaauguacuaccaaaacacagccuaugcuaccaaaaauacauggucuauaaugagcugacgaaaauccgcuacaucgacgaccaaggaaagacgcaccacuucaguggccaagaaaagcaacaaauauucaacggacucuucaaacaacagcgcaaagucaaaaagaaagaccucgaacgauuccucuacacaaucaaccacaucgaaucucccacaaucgagggugucgaagacgccuucaacucguccuucgccaccuaccacgaccuacaaaagggugggguaacccaggaaaucuuagacaacccgcuaaacgcggauaugcuugaagaaauaguuaaaauccuaacgguauucgaggacaagcgcaugauaaaggaacaacuccaauccuucagcgacguccucgacggaacgauacuaaagaaacuggaaaggcggcacuacacaggcugggggcguuugucagccaagcuacucacagguaucagagacaaacacucccaccugacuauucucgacuaccuaaugaacgacgauggcuuaaaucgcaaccucaugcaguuaauaaacgacuccaaccuguccuucaagagcaucaucgaaaaagaacaagucucaaccgccgacaagggaauccaaaguaucguggcagaacuggcagggagccccgccaucaaaaagggcauacuacagucccucaaaaucgucgaugaacugguaggcaucaugggguauccgccacaaacgaucguggucgaaauggcgcgcgaaaaccaaacgacugggaaaggcaagaacaacuccaaacccagguucaucucccucgagaaggccauuaaggaguucggcagccaaauucucaaggaacaccccaccgacaaccagugucucaaaaacgacaggcucuaccucuacuaccuacaaaacggaaaggacauguacaccgggaaagaacuagacauacacaaccuaucaaacuacgacauugaucacauaaucccgcagagcuucaucacggacaacagcaucgacaaucggguccuagugaguuccaccgcgaacagggaaaagggcgacaacgugccacuccucgaagucguccgaaaacgaaaggccuucugggagaaacuauaccaagcaaaauuaaugucaaagcguaaauucgacuaccuuaccaaagcagagcgcggcggacugaccgaagccgacaaagcgaacuucauccaacgccaacuggucgaaacacgacaaaucaccaaaaacguagcaaauauacuuuaucaacgcuucaacugcaaacaggacgagaacggcaaugaaguagaacaaguucggaucgucacguuaaagagcacccuagugucgcaauuccgaaagcaguuccaacuauacaaaguccgagaagucaaugacuaccaccacgcacacgacgccuaccucaacggcguaguggcgaacacucuccucaagguguacccacagcuggaacccgaguucgucuacggcgacuaccaccaauucgacugguucaaggcgaauaaagcuaccgcaaagaaacaguucuacacgaauaucaugagauucuucgccaaagaaaaccaaaucauagacaaaaauggcgaaauacucugggacaacagauaucuagacacgauaaagaaaguacucaguuaccgccaaaugaacauagugaaaaagacggaaauacaaaaaggagaguucagcaacgccaccguaaacccuaaaggaaacucgucaaagcuaauaagccggaaggcggacuggaacccaaucaaauacggcggguucgacggcagcaacauggccuacucgaucgugauagaauacgaaaagcgcaaaaagaaaacggugauaaagaaagaacucauccagaucaacaucauggaacgagucgcauuugaaaaggaccaaaaggcguuucucgaagaaaaggguuacuacucgcccaaaguacugacaaaaaucccgaaguacacccuauacgaaugcgagaacgggcgacgacgcaugcucggaucggccaacgaagcccaaaaaggaaaccagauggugcuaccaaaucaccuuaugacccuucuguaccacgccaaaaacugcgaagccaacgacggggaguccuuagcauacaucgagaugcaccgggaaauguucgcagagcuccucgccuacaucagcgaguucgcaaagagauauacccuggcuaacgaccgguuggagaaaaucaacauguucuucgaacaaaacaagaaaggcgauaucaaaguuaucgccaagagcuucgauaaauuaaaggucuucaacgccuucggcgccccucgcgauuucgaguucuuugaaacgacaaucaaacggaagcgauacuauaauauaaaggaacuccucaaugccacaaucaucuaucagucgaucaccggccucuacgaagccagaaaaagacucgaagauuga

SEQ ID NO: 6443 - RNA, 4008 nt, Artificial Sequence
  Cas9 variant
augaaaaacuacaccaucggccucgauauaggcaccaauagcguggggugggcugucauaaaagacgaccugacccucguccgcaaaaagaucaaaauuagcggaaacacggauaagaaagaaguaaagaaaaaccuauggggcucguuccuguucgagcaaggugacacagcgcaggacaccagggugaaacgaaucgcccgacgccgauacgaacggcgacgcuuccguauucgagaacuacagaaaauauucgacaaauccaugggagaggucgacucaaacuucuuccaccgccucgacgaauccuuccucgucgaagaagacaaagaauauaguaaauaccccaucuucagcaacgagaaagaagauaaaaacuacuacgacaaauaccccacaaucuaccaucugagaaaagaccuagccgacagcaaccaaaaagccgaccugcgccuaauauaccuagcccucgcccacaugaucaaguaucggggccacuuccucaucgaaggcgaccuaaaaauggacggaaucagcaucagugagagcuuccaagaguucaucgacagcuacaacgaaguaugcgcacuugaagaugaaaaccuagaaaucauauacaaugacgaacugcuaacccagaucgaaaacaucuucaaacaggacaucucacgguccaagaaacuagaccaagccaucgcccucuuccaagggguaaaacgucagucgcucuuuggaauauuccugacucucauagucgggaacaaagcaaacuuccagaaaaucuucaaucuagaagacgauauuaaacuagaccucaaagaagaagacuacgacgagaaccuagaagaacuccugaguaacauagacgaaggguaucgagauguauuccugcaagcaaagaacgucuacaacgcaaucgaacucagcaagauccuaaagaccgacggaaaagaaacgaaggcgccccuaucagcccagaugguugaacucuacaaucaacaccgcgaagaccucaaaaaguacaaagacuacaucaaggccuacuugccggaaaaauacggagagaccuucaaggacgccaccaaaaacggcuacgcgggcuauaucgacggaaaaacaagucaagaagacuucuacaaauuuguaaaagcccaacucaaaggagaagagaacggagaauacuuccuugaggccaucgagaaugaaaacuuccugagaaaacaacggagcuucuacaacggagucauccccuaccaaauccaccuacaagaacucacggcuguccuagaucaacaagaaaagcacuacuccuuccucaaggaaaaccgagauaagaucaucagccugcuaacguuucgcauaccguacuaugucgggccacuagcaaagggggagucacgcuucgcauggcucgaacgauccaacagugaagagaaaaucaaacccuggaacuucgacaagauagucgacauugacaagagcgccgaacucuucauagaaaaccuaaccucaagggacaccuacuuaccagacgaacccguccuccccaaaaggucucucauauaucaaaaauucacaauauucaacgaacucacgaaaaucagcuacauagaugagcgcgggauacuccaaaacuucuccucccgagagaagaucgcgaucuucaacgaccucuucaaaaacaaaagcaaggucaccaaaaaucaacuugugaaauacaucgaaaacaaagagcaaaucaucgcaccggagauuaaggggaucgaggauagcuucaacagcaauuacaguacauacaucgacuuaagcaaaauccccgacaugaagaaacuacuagagaaagacgaggacgagauacucgaagaaauaauaaaaauccucaccaucuucgaagaccgaaagaugaggaaacgacaacucaugaaguucaaggauaaacuaucagaaaaagccaucaaccagcugagcaagaaacacuacaccggcuggggacagcuauccgagaaacucaucaacggcauucgcgacgagcagucaaacaaaacgauacucgacuaccuuauugaggacaacgguugcccgaagaacaugaaccgcaacuucaugcagcucauaaaugacgacacccucuccuucaaggagaaaauccgcaaggcgcaagacaucaaccagguaaacgacauaaaagagaucguuaaagaccuacccggcuccccggccaucaagaaagggauauaccagagcauccgcauugucgacgagaucauccggaaaaugaaagaccgaccgaaaaacaucgugaucgaaauggcccgugaaaaucaaacaacucaagaaggcaaaaacaaguccaaagcccggcuaaagaaaauccaggagggccuagagaaccuugacagcguccauguagaaaagcaagcucuggacgaggaaaugcuuaaaucaccaaaauacuaccuuuacugccuacaaaacggcaaggacauauauacgggaaaggaccucgauauugggcaacuccagacauacgacauagaccauaucauaccaaggagcuucaucaccgacaacucguucgacaaccuaguccucacaagcuccaccgucaaccgcggcaaacucgacaacgucccaagucccgacauaguccgccaacagaagggauucuggaagcagcuccuccgcgccggucuaaugucccagagaaaauucaauaaccuuaccaaaggcaagcugaccgaccgagaccgacaacaauucauaaaccgccaacugguagaaacacggcagaucaccaagcacguagccaaucuucugucccaccaccuaaaugagaaaaaggaaguaggcgagaucaauaucguacuacucaaaagcgcacuaaccucccaguucagaaagaaauucgauuucuacaaagugcgagaagucaacgauuaccaucacgcgcacgacgccuaccuuaacgggguaaucgcccuaaaacuacucgaacuauaccccuacauggcaaaggaccuaauuuacggaaaauacagcuaccaccgcaaaauugaaggcgacaaggccacacaagccaaguacaagaugucaaacaucaucgaacguuucucgcaagaccuacuggccaacccagacggcgaaaucgccugggagaaggacaaggaccuuaacacaauccggaaaguacucuccucgaagcaaaucaauaucauaaagaaagcggaagagggaaaaggucgccucuucaaagaaacaauaaauucgcggccauccaagaagacggaaaaacgcaucccaaucaagaacaaccucgauccgaacauauacgggggcuacaucgaagagaaaauggccuacuacauugccaucaauuaccuagaaaaugguaaaacaaagaaagccauagucgggauauccauaaaagauaagaaagacuucgaaggccagaccaccgaauaccucggcaaaaucggauucaauaaagcaagcaucaucaacucguucaaaaacuacacucuauucgaacuagaaaacggcagccggcgaaugauagucggggccuccaaagaaaacgacagcaaaggggagcuccagaaaggcaaccagauguaccucccacaaaacuuacuugaauuuguauaccaucuaaagcacuacaacgaagacgaaacaucccacaaauucaucgucgagcacaaagccuacuucgacgaacuccucaacuacauuguggaguucgcaaauaaauaccucgaacuugagaacucgaucgagaagaucaaggaccucuaccacgggaaaggcccagacgucgaagaaaaggagcuagucgagagcuucauuaaccuacuagccauuacuaaaugcggaccagccgccgacauaacuuuccuuggagaaaagaucucaaggaaaagauaccgguccaccaacugccucuggggaucagaagugauauuccaaucacccacagggcucuacgaaacucgacuacgccuagaauga

SEQ ID NO: 6444 - RNA, 4011 nt, Artificial Sequence
  Cas9 variant
auggacgacaauuaccaacucaugcacgccaaaggcaaauacggguacggcacaagaaucuacagcgaaggacagacagccgcagaccgccggggcuuccgaacgacccggcgccgccugaaccgaagaaaauggcgccuccgucuucuccaggacuuuuucgaaccauauauccucccccaggaugaagccuucuucauacgccagaagcaguccaaccucguuccccaagacacgaagaaacaguacccggaaagcguccuuuucgacgacacaucagacaaggacuucuacacggaauaccccacaaucuaccaccucaggcaggcccucaugacggaaaacaggcaguucgacauucgcgaggucuaccucgcgauccaucacaucgucaaguaccgcggccauuuucuaaacaacgcgcccgugaaaaccuucaaaagcggcaaccuugaccuggcuaucaaauucaacgaguugaacgaagaauuuaaguccguuuaccccgaccucgaacuacaauucaaccuagaccaaaucgacgaaaucaaaaagauccugcuagacuccacaaaaucacgauucgacaggcagggcgaagcagugaagcucaucuacacuguaucagagguaaaaaccaucgaaaaacuacagaauaaaaucgucaagcaauuccucagcggaauacugggacugaauacacgauucgacguccucaccaauacggagucggacgacuccauguggaaauucucacucgacagugagucaagugacgacgcccucgaugagauaauagcccaacuagaugaccccgcgauacacgucguagaacuggugaaugagauccacuccaguauaacccucgcaggcauaguacccgaaggacagggccucagcgagucgauggucgagaaauaugaagcccacaaagcccaucugcaacuccuaaaagcaguagaaaagcuggucgacaaaaaggccgccgacaaacuagaaguugccuaugaccaguauaucaacggcaaagacagcaagcaauucaucaaagaggacuucuauaaggccguucagagcgagaucaaaggagucgccggugacgagguagccgaaauaaaccagcucaucgaacuggaccaguucaugccuaagcaacgcacgaaagagaacggugccaucccccaccagcuccaccagcacgaauuggacgucaucaucgagaaccaaagcaaauauuacgauuggcuaggagagaaagucggcaacgaauacaagcuagacaaacuggucagcuuccgaguucccuacuacguggggccacucgucgacaccgccucaaaagagaagaaagacgaaacacgauucgccuggaugguacggaaaaacccagagucgaccgaagccauuacaccguggaacuuugaagacaucgucgacaaaaacgccucugcggaaaacuucauaaagcgaaugacaaccaaggacaaauaccucuugaacgaagacguucugcccaagugcagucuacucacccaggacuucgaaguguacaaugaacuuaacaauauacgcgucaacggggagaaauucacagccgagcagaagcaauugauccacgacgagcuguucaccaaacaugccagcguauccauaaaacaacuaaaagacuucuuagucucagaauuaauguacguccgugacaaccucaaaguggaaggucuagcagacgaaaagaaacuuaugagcucauuaucuacacaauucgacuaccagaaaauaauccccgaccaaaucaaugacguaaaauaccgcgaagacaucgaacaaaucauagaaugguccacaauauucgaggacgcugcaauauucaagaccaaacuaaaagaaaucgacuggcucaccgacgaacaacgaaauaagcucgcgaacaaacgguacagaggcuggggaucccucagcaaacggcuuuuagccugccuaguagacgaaaacggccaacgcauaauagacauacuacgggacucgagcgacaacuucaugaugaucguaaacagaccggaguucaagcaagccauauuugacgagaacgccaaucucaccgagaccaauagcaaaaaggacauguucgaaaugaucgacaauuucuacaccucaccacaaaacaagaaagcaauccgucaaguacuccucgucgugcaagacauacaaaaugcgaugggagggguggcgccacaaaagaucuucaucgaguucgcccgcgaagacgaaguaaacggccgacgcaccaacagccgauauucgcaaauucgagaaauguacagcaaagucaccgacgacguuauaaacaagaccguccgcggggagcucgaagcuaacaaaggcagucucaacaaagagaaacuauucuuguacuuccuacagggcgggauagaccuguauucggggaagaccaucaacaucgacaacauauccucguacgacguugaccacguccucccgcagagcuucauuaaggaugacucaaucaacaacaaaguccuagucaacgcaaaaggcaaccgcgugaaaaacgacaacguacccauggaacucuucggugccaaaauguaccccacauggaagagaaugguugacacuggcauuauguccaaagccaaauucaagaaccucacccucaacccggacaacguagacaaguucaaagcagaaggauucauaaaccgucagcuagucgagacccggcaaaucaucaaacuuguagcucaaauacuaaacgacaaacuaggcgacgacacgaaaauaguaucagugaaagcaaaccuaacccacgacaugcgagucuucuucgacuucccgaaaaaccguaacgucaacaacuaccaccacgccuuugaugcauacuuauccgcuuucguuggcaccuaccucuacaaaagguaccccaaguuacagccuuauuucguauauggagaguucaagaaaauggauaaguuaaagaacaugaccagcuucgacuuucuacgcgaccugaaacacacggacaaaguugucgacaaagacacgggcgaaaucaucgccgauaagcucgcgguaauaacaaacaugaacaaaaucuacgacuucaagaaaguccuagucacccaugaaguacacgaaaacucaggcgcuauguaugaccagacccucuacccggcaaaacuagacaaaucacucggacgcaaaggagccaaacaacuaauccccaaaaaggacgacaugcccacagcccucuacggcggauacaccggcucaaaagacgccuucaugagcaucguacgccucaaaaagaaagacgaagucuacuacaaagucauugggaucccugugcgcaucgccgacuccguacagcacggcaaagaggucgacgucgaagcacucacccaauucauagaaacaaaguucaccaaagaaaaccucaauaaaaagaccggggagauaacacgcaaaguagaaugguucgaauuggugcuccccaaagugcuauucggacaggccguauucgacggcggucaacccuucaugcucggcuccuccacuuacccucacaaccuacgcgagcucgugcucacaaaagacagcgucaagaagaucgcaggcaaagagucgaacaaaagcuaucucgacgcauacgacgaaaucauggaggccaugaacaaauacuucccucuauacgauacgaacaaguuccgcgaaaaagucaucgaaggccgauccaaauucauagaucucccagacaaagacgaguacgagaacaauaagcuaguccaggugggaaagucaaccauaauagaccgaauguucaucggccugcacgcaaacgcggcacgaacagaccucaagaacaucgggaucaccaccccauucggauucaugcagcaggcuuccggaaucaaguuaaccaaggacaccgucgugcuguuucaaaguaguaccggccucuucgagcgaaaggucgcccugaaggaccucuga

SEQ ID NO: 6445 - RNA, 4011 nt, Artificial Sequence
  Cas9 variant
augaccaaagacuacaccauaggacuagauauagggaccaauagcgucgguugggcaguacugaccgacgacuaccaacugaugaaacgaaagauguccgugcacgguaacaccgagaaaaagaaaaucaaaaagaacuucuggggcgcacgacuauucgacgaaggccaaacggccgaguuccggcguacaaagcgcaccaaccgcaggcgccucgcucgccgcaaauaccgacuaucaaagcugcaggaccucuucgcagaagaacuaugcaaacaagacgacugcuucuuuguccgccuugaagaguccuuccuaguucccgaggaaaaacaauacaagccagccuccaucuucccgacgcuggaagaagaaaaagaauacuaccaaaaauaucccacuauauaucaccuccgccaaaaacuugucgacuccacagaaaaggaagaccuccgacucguuuaccuggcgcuagcccaccuccucaaguaccgaggccacuuccuuuuugaagguuaccuugacacggaaaacacaagcaucgaagaauccuuccgcguauuucuagaacaguacggaaaacagucggaccaaccgcugauugugcaccaaccgguacucaccauccuuacagacaaacuauccaagacuaagaaagucgaagagauccucaaauacuacccgaccgagaaaauaaacagcuucuuugcacaaugccuaaaacucauagugggcaaccaggcaaacuuuaaacggaucuuugaccuagaggccgaggugaaacuacaauucagcaaagaaacguacgaggaggaccuggaaucauuauuagagaaaaucggagacgaauaccucgauaucuuucuacaggccaaaaagguucacgaugcuauccuacuaagcgagaucauauccucuaccguaaagcacacccaggccaaacuaaguaguggcaugguagaacgcuacgaaaggcauaaagcagaccuggccaaauucaagcaauucguuaaggaaaaugucccccaaaaagcaaccguauucuucaaagacaccaccaaaaacggcuacgcgggauauaucaaagguaagacgacccaagaggaguucuacaaguucgucaagaaagaacugucaggugugguggggagcgagcccuuccuugagaagauagaccaagaaaccuuccuacucaagcaacgcaccuacacuaacggcgucaucccacaccaaguucaccucauagaauugaaggcgauuaucgaccaacaaaaacaacacuacccguuccuagaagaagccggaccuaagauaauagcccucuucaaauuucgcauccccuacuacguuggcccacucgcgaaggagcaggaagcauccagcuucgcauggauagagcgaaaaaccgcugaaaagauccaccccuggaacuucucggaggucgucgacauagaaaaauccgccaugcguuucauacagcgcaugacgaaacaagauacauaccuaccgaccgaaaaagugcuacccaagaacucccugcucuaccaaaaauacaugauauucaacgaacucacaaagguauccuacaaagacgaacggggcguuaaacaauacuucaguggagacgaaaaacagcaaaucuuuaaacaacuauuccagaaggaacgcggaaaaauaaccgugaagaaacuccaaaacuuccuauauacucacuaccacauagaaaaugcacacauauucggaaucgaaaaagcauucaacgccagcuacucaacauaccacgacuucaugaaacucgccaaaaccaaccaaaaguccaugcaagaauggcucgaacagcccgaaauggagcccauauucgaggacauuguaaaaauccucaccauauucgaggaccgccaaaugaucaagcaccagcuauccaaauaccaagaagucuucggagaaaaacuccuaaaagaguucgccagaaaacacuacacagggugggggcgauucagcgcaaaacucauccacggcauucgcgacagaaagaccaauaaaaccauccucgacuaccugauaaacgacgacgacgucccggcuaaccgcaaucggaaccucaugcagcugauaaacgacgaacauuugagcuuuaaagaggaaaucgcaaaagcaaccgucuucuccaaacauaaaagccuggucgacguaauacaagaccugcccgggucaccagccaucaagaaaggcaucuggcaaucccuaaagauagucgaggaacuaaucgcuaucauaggauacaagcccaaaaauaucgucauugagauggcccgcgaaaaccagaaaacucaucgaaccaagccccgucuaaaggcgcucgaaaacggucucaagcaaauuggcuccacccuccugaaggaacaaccgaccgacaacaaagcucuccaaaaagagcgccucuaccucuacuaccugcaaaacggccgagacaucuacacuggcgagccacucgacauugagaaccuacaccaauacgaaguggaucacaucaucccucgcuccuuuaucgucgacaacagcauagacaacaagguccugguugcauccaaacagaaccagaagaaacgcgacgacguaccaaacaaacaaaucguaaacgaacaacgcauauucuggaaucaacuaaaagaagccaaacucauaagccccaagaaauacgcauaccuaacuaaaaucgaacucacgccggaagacaaagcccgguucauacaacgacaacucguugaaacccgccagaucaccaaacacguugccaacauccuacaccagagcuuccaucaagaagaagaaggcaccgacugcgacggaguccaaaucaucacacucaaggccacacugaccucccaauuccgccaaacauucggacucuacaagguacgcgaaaucaacccccaccaccacgcucacgacgcuuaccugaauggcuucaucgccaacguacuacuaaaacgcuacccaaagcucgcaccagaguucguauacggcaaguacguaaaauauucccuugcgcgcgaaaacaaagcaaccgcgaaaaaggaauuuuacucaaacauacuuaaauuccucgaauccgacgaacccuucugcgacgaaaacggugagaucuacugggagaaguccuaccaccucccacggaucaaaaaggugcuaagcagccaccaaguaaacguugugaaaaagguggagcagcagaaaggagguuucuacaaagaaacgguaaacaguaaagaaaaaccugacaaacucauugagagaaagaacaacugggauguaacgaaguacgguggcuucggaucccccgugaucgcauaugcaaucgcuuucguauacgccaagggcaaaacucagaaaaagacacgggcaaucgaagggaucacgaucauggagcaagccgcguucgaaaaggaccccaccacauuucugaaagacaagggauucccccaagucaccgaguucaucaaacuacccaaguacacccucuucgaguucgacaacggccgaagacgauuccucgccucccacaaagaaagccaaaagggcaacccguucauccucagugaccaacucgucacgcuccucuaccaugcccagcacuacgacaaaaucaccuaccaagagagcuucgacuaugucaacacccaccucuccgauuucucggcaauacucacagaagugcucgcauucgccgaaaaguauacacuagcagacaagaacauagaacgaauccaagaacuauacgaagaaaacaaauacggcgaaaucagcaugauagcccagagcuuccuccaacuccuacaguucaaugcaauaggcgcuccggcagacuucaaauucuucggcgucaccauaccgcgcaaacgguacacgucacuaacggaaaucugggacgcaacaauaaucuaccaaucaguaacgggccucuacgagacccgaauccgcaugggggacuuaugggccggggagcaauga

SEQ ID NO: 6446 - RNA, 4011 nt, Artificial Sequence
  Cas9 variant
augaccaaggacuacacaaucggccuagacaucggcaccaacagcguaggcugggccguccuaaccgacgacuaccagcuuaugaaaagaaaaaugaguguacacggcaacaccgaaaagaaaaagauaaagaaaaacuucuggggagcccggcuguucgacgaaggccagacugccgaguuccgucgaaccaaaagaacaaacagacggcgccuugcccgucgaaaguaccggcuuuccaagcuccaggaccuuuucgccgaggaacucugcaaacaagacgacugcuuuuucgucagacucgaagaaucauuccucgucccagaggaaaagcaauacaagccugcguccaucuuuccaacgcuagaggaagaaaaagaauacuaccaaaaauacccaacaaucuaccacuuacgucagaaacuuguggacucaaccgagaaagaagaccuccgacucgucuaccuggcccucgcccaccuccugaaauacagaggacauuuccuuuucgagggcgacuuagacaccgaaaacacaucaaucgaagaauccuuccgugucuuuuuggaacaauacucaaaacaaagcgaccaaccgcuaauaguccaucaaccuguacuuaccauccuuaccgauaagcucagcaagaccaagaaagucgaagagauacuaaaguacuaccccacggagaagaucaacuccuucuucgcgcaaugccucaagcuaaucguaggaaaccaagcaaacuucaaacgcauauuugaccucgaagcagaagucaaacugcaauucuccaaagaaaccuacgaagaagaccuggaaucacuacucgagaaaaucggcgacgaauaccucgacauauuccuucaagccaaaaagguacacgacgcuauacugcucagcgaaauaauauccagcacagugaaacacacaaaggcaaaacucucguccggcauggucgaacgcuacgagcgacacaaagcugaccuagccaaauuuaagcaauucgucaaggaaaacgucccccagaaggcuacagucuucuucaaagacaccaccaagaauggauaugcaggauacaucaaaggaaaaacaacucaagaagaguucuacaaguucguuaagaaagagcuauccggcguagucggcagcgaacccuuccucgagaaaaucgaccaagaaacauuccuccucaaacagaggaccuacaccaauggaguaauuccccaccagguucaccugaucgaacucaaagccauaaucgaccaacaaaaacaacacuacccauuccucgaagaagcugguccaaaaauaauagcccucuucaaauuucgcauccccuacuacgucgggccucuggcgaaagaacaagaggccuccucguucgccuggauagaacggaaaacagccgaaaagaucaacccauggaacuucuccgaaguagucgacauagagaaaagcgcuaugcguuuuauccaacgaaugacaaaacaagauacguaucuaccuaccgaaaaaguccuccccaaaaacucacuccucuaccaaaaauauaugaucuucaacgaacuaaccaaaguauccuacaaagacgagcgaggcguaaaacaguauuuuuccggagacgagaaacaacaaaucuucaaacaacuguuccaaaaagaacgcggaaagauaaccguaaagaaacuccaaaacuucuuauacacacacuaccacaucgagaacgcacagauauucggcaucgaaaaagcauuuaaugcguccuacucaacauaccacgacuucaugaaacuggccaaaaccaaccagaaagcaaugcaagaauggcuggaacagcccgaaauggaaccuaucuucgaagacauagucaaaauacucacuaucuuugaagaccggcaaaugauaaaacaccaacuaagcaaauaccaggagguuuucggagaaaaacuucucaaagaauuugcacgcaaacacuacaccggauggggccgcuucucggccaaacucauccacggcauacgggaccgcaaaacuaacaaaaccauacuggacuaucucaucaacgacgacgaugucccugcaaacaggaaccgaaaccuaaugcaguuaauaaaugaugaacaccucagcuucaaagaggaaauagcaaaggccacagucuucagcaaacauaaaucacucguggauguaauccaagaccuccccggcucccccgcuauuaagaaaggaauauggcaaucccugaagauaguggaagaauugauugccaucauaggguacaaacccaaaaacaucgucauagaaauggcccgggaaaaccaaaagacacaccgcacaagccccaggcuaaaggcccuagaaaauggacuuaaacaaauuggcagcacgcugcucaaagaacaaccuaccgauaacaaggcccuccaaaaagaaagacuguaccuauauuaccuacaaaacggacgggacauguacacaggggaaccgcuggagauagaaaacuuacaccaauacgaaguagaccacaucaucccucggucuuucaucgucgauaacucaauugacaauaagguccucgucgccucaaaacaaaaucaaaagaaacgagacgauguaccaaagaaacaaaucgugaacgagcaacggauauucuggaaccaauugaaagaagcaaaacugaucucccccaaaaaguaugccuaucugacaaaaaucgagcucacaccagaggacaaggcccgcuucauccaacgacagcuagucgaaacgcgacaaauuacgaagcacguggccaacaucuuacaccaaucguucaaccaagaagaagaagggacugacugcgacgggguccaaaucaucacccugaaagccacgcugacaagccaauuccgccagacguucggacucuacaaagugcgagaaaucaacccccaccaccacgcccaugacgccuaucuaaacggcuucaucgcuaacgugcugcuuaagcgauaccccaaacuagcuccggaguucgucuacgguaaguacguaaaguacucccucgcacgcgaaaacaaggccacugcaaagaaagaguucuauucaaauauacucaaauuccucgaaucggacgaaccuuucugcgacgaaaacggcgaaaucuacugggaaaaaucucaucaccucccccgcauaaagaaaguacucucaucccaccaaguaaacguagucaaaaagguagaacagcaaaagggcggauucuacaaggagacugucaacuccaaggaaaaacccgacaagcucauagaacguaagaacaacugggacgugacaaaauacggcggcuucgguucccccguaaucgccuacgccaucgccuucguauacgccaaagggaaaacccaaaagaaaacccgcgcgauagaaggcauaaccauaauggaacaagccgcguucgaaaaagaucccacgaccuucuugaaagagaaaggguuuccacaggucaccgaguucauaaaauugcccaaauacaccuuauucgaauuugauaacggccgacgcagguuccuggcaagccacaaggaaucccagaaaggcaacccauucauccucuccgaccaacuuguuacccuucuuuaccacgcccaacacuacgacaaaaucaccuaccaagaaucguucgacuauguuaacacgcaccucucggacuuuucagcgauccuaacggaaguacucgcguuugcagaaaaauacacccuggccgacaagaacauugaacggauccaggaacuuuacgaggagaacaaauacggagagacguccaugaucgcccagagcuuccuccaacuccuccaauucaaugcgaucggagcccccgcugauuucaaauucuucggagucaccauaccacgaaagcgcuacaccucccucaccgaaauuugggacgccaccaucauuuaucagagcgucacuggucuauacgaaacccgcauccggaugggcgaccucugggccggggaacaauga

SEQ ID NO: 6447 - RNA, 4014 nt, Artificial Sequence
  Cas9 variant
augaagaacaugaagaaacccuacaccauaggacucgacaucggcacgaacucagugggcugggccguucucaccgaccaguacgacuugguaaagcggaagaugaaaaucgccggcgacucggagaagaaacagaucaaaaagaauuucuggggaguccgacucuucgacgagggccaaaccgcagccgaucgccgcauggcucgaaccgcgagacgccggaucgaacgucgaaggaauaggaucaguuaccuccaaggcauauucgccgaagaaauguccaaaacugacgcaaacuucuucugcaggcugagugacaguuucuacgucgacaacgagaagcgaaacagucgacacccauucuucgcaacgaucgaagaggaagucgaauaccacaaaaacuaucccacaauauaucaucuacgagaggagcuagucaacagcagcgaaaaagccgaccuccggcucguauaccuggcgcucgcacacauaaucaaauaccgcggcaacuuucuaaucgaaggggcacuugauacccaaaauacgagcgucgacggcaucuacaagcaauucauacaaacuuacaaccaaguuuuugccagcgggauagaagacggaagccugaaaaagcuggaggauaacaaagacgucgcuaagauacugguggaaaaaguaacaagaaaagaaaagcucgaacgaauacuaaaacucuaccccggagaaaagagcgccgguauguucgcccaauucauaagccugauaguaggcaguaagggcaacuuccagaaacccuucgauuuaaucgagaaaagcgacaucgaaugcgcgaaagacuccuacgaagaagaccuggaaucgcugcuggcacuaaucggggacgaauacgcggaacuuuucguggcagcgaagaaugccuauagcgccgucgugcucucaaguaucauaaccgucgcagaaaccgaaaccaacgcgaaacucagcgcuagcaugauagagcgcuucgacacacacgaagaagaccucggagaacugaaggcauucauaaagcuccacuuaccaaagcacuacgaagaaauauuuucaaauacagaaaaacacggcuacgcuggguacaucgacgggaagaccaaacaagccgauuucuacaaauacaugaagaugacuuuagagaacaucgagggcgccgacuacuucaucgccaaaaucgaaaaggagaauuuccugcgaaaacagcgaacauucgacaacggcgccauaccccaccaacuacaccuagaggaacucgaagcaauucugcaccagcaggcgaaguacuacccguuccuaaaagaaaacuaugacaagauaaaaucccuagucacuuuccgaauaccauauuucguggggccucuggccaacggacagagcgaguucgccugguugacccgcaaagcagacggggaaauccgccccuggaacaucgaagaaaaaguugacuucgggaaauccgccguagacuucaucgaaaagaugacgaauaaggacacguaucucccaaaagaaaacgugcuccccaaacauucccuaugcuaccaaaaauaccuaguauauaaugaacugacaaaaguccgcuacaucaacgaccagggcaagacgucauacuuuuccggccaagagaaagaacagauauucaacgaucuguucaaacaaaagcgcaaggucaaaaagaaagaccuagaacuauuccuaagaaacaugagccacgucgagagccccacgaucgaaggccucgaagacagcuuuaacagcuccuacagcacauaccacgaccuccucaaagucgggauuaaacaagagauauuagacaacccagucaacacagagaugcuagaaaacauagucaaaauccuaaccguauucgaagauaaaagaaugauaaaagaacaacuucaacaauucucugacguauuagauggggugguacugaagaaacuagaacgcaggcacuacacgggguggggcaggcugucagccaaacuccuaauggggaucagagacaaacaaucacacuuaacuauccuggacuaccuaaugaaugacgacggauuaaaccgcaaccucaugcaauuaaucaacgacucaaaccuauccuucaaaagcauuaucgagaaggaacaagucacaaccgccgacaaagauauacaaagcauaguagcugacuuagcagggucaccagcaaucaagaaagggauacuacagagccugaaaauugucgacgagcugguguccgucaugggcuaucccccucaaacgauagucguagagauggcccgcgaaaaccaaaccacaggaaaagguaagaacaacagccgaccccgcuacaaaucccucgaaaaagcgaucaaagaguucggaucacaaauacuaaaggagcaccccaccgacaaccaggaguuacgcaacaaucgacucuaccuauauuaccuacaaaauggcaaagacauguacaccggccaggaccuagacauccacaaccucucuaacuacgacaucgaccacauagucccccaaaguuucaucaccgacaauagcaucgacaaccuuguccugaccuccucagcagguaacagagagaagggagacgacguuccaccccucgagaucguacggaagcgcaaaguauucugggagaagcucuaucagggaaaccucaugucgaaaaggaaauucgauuaucuaacgaaagcagaaagaggagggcucaccgaagcagacaaagcgcgcuucauccaccgccagcucgucgagacgcgccagaucacuaaaaacgucgccaacauacuccaccagcgcuuuaacuacgaaaaagacgaccacgggaacaccaugaaacaagucagaauaguaacccugaaauccgcccuagucucccaauuccgcaagcaauuccaacuguacaagguccgcgacguaaaugacuaccaccacgcacacgacgcauaucuaaacggaguaguggcuaacacgcugcuaaagguauacccacagcuggaaccagaguucgucuacggcgacuaccaccaguucgacugguucaaagcaaauaaggcaaccgcgaaaaagcaauucuauaccaacauaauguuguucuucgcacagaaggacagaauaaucgaugaaaacggugaaauacucugggacaaaaaguaccucgacacgguuaagaaagugaugucguaccgccaaaugaacauagucaagaaaaccgagauccaaaaaggagaguucagcaaagccaccaucaagcccaaaggcaauucaagcaagcuaaucagccgaaaaaccaauugggacccaaugaaguacgggggucuggacucacccaauauggcuuacgccgugguaaucgaauacgcaaagggaaagaacaagcuaguguucgaaaagaaaaucauaagagucaccaucauggagcgaaaagccuuugagaaagacgaaaaagccuuucuagaagaacagggcuaccgacaaccaaaaguccuggcaaaacugccgaaguacacucuauacgaaugugaggagggucgcaggcgaaugcucgcaagcgcaaacgaggcccagaaagggaaccaacaagugcucccgaaccaucucguaacccuccuacaccacguggccaacugcgagguauccgauggaaagagucucgacuacauagaaagcaaccgagagauguucgcggaacugcucgcacacguauccgaguucgccaaaagauacacccucgcagaagcgaaucucaacaagauuaaccaacuguucgaacaaaacaaagaaggcgacaucaaagcaaucgcgcaguccuucgucgaccuuauggcauucaacgcaaugggggccccggcgucguucaaauucuucgaaaccacgaucgaaaggaaacgguacaacaaccuaaaagagcuuuugaacagcacaauaaucuaucaauccauaacagggcuauacgaaagccggaagcgacucgacgacuga

SEQ ID NO: 6448 - RNA, 4014 nt, Artificial Sequence
  Cas9 variant
augaagaaauucgagaacuacuacuugggccucgacauaggcaccagcucgauaggaugggcugucacaaacagccaauacgacauccucaaauucaacggaaaguacauguggggaacacgccucuuccccgaggcaaacaccgcacaagagcgccgcauucaccgcucgagccggcgacgacuaaagcgccgcaaggaacgaauccaaauccugcaaaugcuauucgacaaagaaaucgcaaaaauagacagcggcuucuuccaacgccucaaagacagcaaauauuacaaggaagacaaaaccgaaaaacaaaccaacucuaucuuccaugacaaagacuacucagacaaagaguaucaccaagacuucccaaccaucuaccaccucagaaaguuccuccucgagggaaacaagccaaaggacauacgcuuugucuaccuagcgcugcaucacauccucacccaccgagggcacuuccuauucccagacauggaagucucaaacgucacagaauuuucgaacaucuucagcgagcucaaacaauaccucuacgaugaaauggauuuagacuuugaguggaagaacggaaagcuaaaugaaguugaaaacauacuuaaggaccggaaccucgcaaaauccgaaaaggagaaaaagcucugcggaauaauugaacucgaagggaagaucgacaaccagcgcaaagcaaugaucgggaugauguguggcugcaagaagaaauucucagaccuauuccaaaaugaaaacuaccgcgaacuagagaucagcucguucuccuucgccgauagcagcuacgaggagaaacgcgacgaacuagaagggauccucgccgagaacauacucugccuggacuaccuaaagacgauauacgacuggggcaagcugagcgacauacuacaaggagaggaaucuaucagcgucgcgaaaguaaaauccuacgaagaacaccagcucgaucucaaauaccuuaagaauauccugaagcucuacagccauaaggaaaaagaaaacguguuccgcaagaaagaaggcaaauacccaaaauacauauccggaaaacugucccaagaagaguucaacaaaagcauuaagaaaauccuugaggaaauaaaauccgugaaacaggaagaccgaaaagucuucgacaccuuacuuaaacgagccagcaacaaccuccuaugccccaagcagguuaucaaagaaaacggagucauaccuuaccagauacauaaauucgagcuagagaaaauucuaagaaacauggcagacuucuucccgaugcuuaaagagaagaaagacggcaaaacccucuccgagaaaauaaucagcguguucaccuuccggauuccguacuacguuggaccccucaaccaaaauagcgaccgcgccuggcucgugaaaaacaaagaugaaaagauauacccguggaacuucgaagaaauaguuaaccuugaagaaagcgccgagaaauucauucagaaccucacuaacaagugcacguaccuagugcucgaagauguccuaccgaaaagcucaauccucuauucuaaauucaugguacucaacgagcuuaacaaccucaaaaucgauggggaggcaaucucaguagaccucaagcagaaaauauaccucaaccucuuccaaaaauacaagaaagucacucugaagaaacucaaaggguaccuaaaaagugaaaacauucuaaucgacaccuccacccaaaucacaggcaucgacggugacuucaaaagcucccucggcucauacuuagauuucuacaacauucucggugacaaggugaaaacagacuucggaaagaaacuaauagaaaauuguauccuguggauaacccucuacacaggcgaaaagaaacuuuuaaagaauaaaaucaucgcgaacuacaaaggugaacuaagcgaagaggagaucaagaaaauugucaaccucaaauacaaagacuggggccgccugagcuacgccuuccuagaagagauccagagcgcgucccucgagaccggagaacuccgcaacauaauccagaugaugugggagacaaacaacaaucucauggagcuccuuuccuccaacuaucaauuccuauccgaaauagaaaaacgaaacuccgucgucgccauaggaaaggaguucaacuacgaaaccaucuuaggcgacuccuacgccucucccagcguaaagcgaaugauauggcaaucucucagcgucguggacgaaaucaaaaagaucaugaagaaagccccaaagaaaaucuucaucgaaauggcccgccaagaggacaugaagaaagaaagaaaagaaucccguaaaaguacauucuugacgcucuauaaaucaaucaaagaagaaggccgcgacuggaucaaggaaaucgagaacuggagcgacucagaguuccgauccaagaaacucuaccuguauuacacccaaaugggcaaaugcauguacacaggagaaaagaucucccuugaccagcuauucaacaaaaacaucuacgacaucgaccauauauacccccgcucaaagaccaaggacgacucaaucgaaaacauuguccucgugaaacggaacauuaaugcuaaaaagaccgacgaguacccccuggaacgcaacauccagcaaaagcagcacgauuucuggaagaugcuccacaguaagaaacuaauaggagacaagaaauaugagagacucacucgaaccacagaguucaccgacgaggaacucuccgacuuuaucgcacggcaauuaguagaaaccagacagucgacuaaaaucgucgcggacauacuuaaaaaccuauucccagaaacgaaaaucgucuacgucaaggccaaccucacaucagacuucaggaagaacuuuaagauacucaaaucgcgcgacauuaacgacuaccaccacgcccacgacgccuaccuaaauaucguaaccggcaacgucuacaacauaaaauucacggacaaccccagaaacuucauaaaggacaagaaacuggaaggcaagaaauacaacuuaaaaguagagaaaaucuucgaauaccggaaggaaaacgagagcuucuggaaccccaaaaccauggucacuaagaucgaaaacuacaucuuuaaaaagcgcccccaguucacccgcuacucguuugagcagcauggcggauucuuugaccaaaacauagucgacaaagagagcugcaaaaagggcaccggauacauccccauaaaaagcuccaacgccauacuuuacaacaccagcaaguauggaggauacggaucuguuacagguaccuacuucuuccuuguagagcacaccaugaaaggcaagcguauccgcacgaucgagaugaugccccucuaccugagcaaaaagauucacuccaaagaggagcuagaaaaauacugcaaagaaaaacucgagcuacaaaagcccuccguacggcucgcacgcaucaaguacaacagccuacucaagauaaacggauucccauaccacaucacgggaaaaaccaacgacucguacuggaucaugucggcgauacagcuccuccuaagcaagaacuauuacgaguaccucagaaaacuauauaucuucugcaaagaagaacgccuggaagaagagauagucggcgaaaagaacaucaagcucuauaccugcauacuagaaaaacuggaaaaaucaaucuacucccacaaacuccuuaacaucaauuacaacgguaaaucuaaaaaucuuaaggacauacuggaauccgagaaggaaaauuuccugcuacuaagcgagaaaaagcaggcgcagauacucauagaaaucuucacgcuacucgaaagcaacaacuucggcgcgaaccucgaguccuucggcuguggcaagaaaugcggcaucacgaaaaucaacaaaaauauagacaaacuagaagaggugcuacucauaaaccaaagccccaccggccuuuucgaaaacucgauagaccucaagaaaguauga

SEQ ID NO: 6449 - RNA, 4014 nt, Artificial Sequence
  Cas9 variant
augaagaaagacuauguaauuggacuagacaucggaaccaacaguguaggaugggcaguaaugaccgaagacuaccaacuggucaaaaagaaaaugcccaucuacggcaauacggagaagaagaaaauuaagaaaaacuucuggggcgucagacuguuugaggaaggacacacagccgaagaucgccgccugaaacgcaccgcgcgacgcagaaucucacgacgccgaaaccgccucagguaccugcaggccuucuucgaagaagcaaugaccgacuuagacgaaaacuucuucgcaagacuccaggagagcuuccuaguccccgaagacaagaaauggcaucgacaccccaucuucgcaaaacuagaagacgaagucgcauaccacgaaaccuaccccacaauuuaccaccuaagaaagaaacucgcggacuccucagaacaagcagaucuccgccuaaucuacuuagcgcucgcccacauugucaaauacaggggacauuuccuuauagagggcaaacucucgacggagaauaucuccgugaaagaacaauuccaacaguucaugaucauauacaaccagacuuucgucaacggcgaaucacgacucgucagcgcuccacuuccagaaagcguccucauugaggaagaauugaccgaaaaagcaucaaggacaaagaaauccgagaaaguacuccagcaauuuccccaggaaaaagcgaauggacuguucggacaauuccucaaacugauggucggaaauaaagccgacuucaagaaagucuucggacucgaagaagaagcaaaaauaaccuaugccuccgaaucauacgaagaagaccuggagggcauccucgccaaagucggcgacgaguauagcgacgucuuucuagccgccaaaaacgucuaugacgccgucgagcugaguaccauccuugccgacuccgacaagaaaucacacgcaaaacucagcucaucuaugauaguccgcuucacggaacaucaagaagaccucaagaaauucaaacgguucaucagggagaacugccccgacgaauaugacaaccuauucaaaaacgaacagaaagacggcuacgcaggguacaucgcucaugccggcaaaguaucccagcuaaaauucuaucaauauguaaagaaaaucauacaagacaucgcaggcgcagaguacuuccuagagaaaaucgcucaagaaaacuuccuccgcaaacaacgaaccuucgacaacggcgucauaccccaccagauccaucucgcggagcuccaagccaucauacaccgacaagcagccuacuacccauuccucaaagagaaccaagagaaaauugagcaacucgucaccuucaggaucccauacuacguaggcccacucucaaagggcgacgccagcaccuucgccuggcugaagcgccaaagcgaagaaccaaucaggcccuggaaccuacaagagacaguugacuuagaucagucggccacagcauucaucgaacgaaugacgaacuucgacacguaccucccuucugagaaaguacuccccaagcacagcuuauuguacgaaaaguucauggucuucaacgaacugaccaaaauauccuacaccgacgaccgaggcauaaaagcaaacuucucuggcaaagagaaagagaaaauauucgacuaccuguucaagacaagaagaaaggugaagaaaaaggacaucauucaauucuaccgcaacgaauacaacacagaaauagucacgcugucgggccucgaagaagaucaauucaaugccuccuucuccaccuaccaagaccuccucaagugcggccuaacccgagccgaacucgaucacccggacaaugcggaaaaacucgaggacauaaucaagauacuaaccaucuucgaagaccgacaacgcaucagaacgcaacucucgacguucaaaggccaauucagcgccgaaguacucaagaaacucgaacgcaaacacuacaccggcuggggcagacuaucgaagaaacugaucaacggaauauacgacaaagaauccggaaaaaccauacuaggcuaucugaucaaagacgacggcguaucaaaacacuacaacagaaacuucaugcagcucauaaacgacagucaacucucuuucaagaacgccauucagaaggcccaauccucugaacacgaagagacacucuccgaaacagucaacgaacucgcaggcucacccgcuaucaaaaagggcaucuaucagucccucaaaaucgucgacgaacuugucgcaaucaugggguaugcccccaaacgcauaguaguagaaauggcuagagaaaaccagaccacaucuaccggcaaacggcguucuauacaaagacucaaaauaguagagaaagcgauggccgaaauuggguccaacuugcuaaaggaacaaccuaccaccaacgagcaacuacgggauacaagacuguuccuauacuacaugcaaaauggaaaagacauguauaccggcgacgaacuaagccuacacagacuuucgcacuacgacaucgaccacaucauaccccaauccuucaugaaagacgacucacucgauaaccucguccucguaggcuccaccgaaaaccguggaaaauccgacgacguccccucaaaagaggucguaaaagacaugaaggccuacugggagaagcuguaugcggcaggcuuaaucagucagcgcaaguuccagagacucacuaaaggcgaacaagggggccuaacccuagaagacaaagcccacuucauccaacgucaacugguagaaacacgccaaauaacgaaaaacguagccggcauacuagaccagagguacaacgcuaacucgaaggaaaagaagguccagaucaucacgcucaaagccucacucaccucacaauuccgaucgauauucggacuauauaaaguccgcgaagucaacgacuaccaccacgggcaggacgcguaccuaaacugcgucguggcaacaacgcuccucaaagucuacccaaaccuggcaccagaguucguauacggagaauaccccaaauuccaaacauucaaagaaaacaaggccacagccaaagcgauaaucuauacgaaccuucugagguuuuucacugaagacgaaccccgcuucacgaaggacggggaaauccuauggagcaacuccuaccugaaaaccaucaaaaaggaacuaaacuaccaccaaaugaacaucgucaagaaagucgagguccaaaaaggcggauucagcaaagaauccaucaagccgaaagguccaagcaacaagcucauucccgucaagaacggacuagacccgcaaaaguacgggggauuugacuccccgauugucgcuuacacaguacucuuuacacacgaaaaaggcaagaaaccgcuuaucaaacaagaaauccuaggcaucaccaucauggagaaaacacgguucgaacagaacccgauacuguuccuagaagaaaaaggauuccucaggccucgugugcuaaugaaacugcccaaauacacacuguacgaauuuccagaagggcgacgccgccuacuggcuuccgcuaaagaagcccagaaaggcaaccaaauggugcuuccugaacaccuccucacccuccuauaccaugccaaacagugccuccuaccaaaccaauccgaaucccucacuuacguagaacaacaccaacccgaguuccaagaaauacuagaacgagucguagacuucgccgagguccauaccuuagcaaaaucaaaaguacaacaaaucguaaaacuauucgaggccaaccaaacugccgacgugaaagagaucgcugcaaguuucauccagcucaugcaauuuaacgccaugggagcgcccagcaccuucaaauucuuucaaaaagacauagaacgcgcacgcuauaccuccaucaaagaaaucuuugacgccacaaucauauaucagagcacgacaggccuguacgaaacccgcagaaaaguaguggacuga

SEQ ID NO: 6450 - RNA, 4014 nt, Artificial Sequence
  Cas9 variant
augaagaaggacuacgucaucggucuagacaucggaaccaacucggugggaugggcagucaugacagaggacuaccagcuagucaaaaagaaaaugcccauauacgggaacacggaaaagaagaaaauaaagaaaaacuuuuggggcguacgccuuuucgaggagggacacaccgccgaggaccgccgccucaaacgcacagcccgcagacgcaucucacgaagaaggaaucgccuacgcuaccuccaagccuucuucgaagaagccaugaccgaccuagacgagaauuucuucgcucgccuacaagagucauuccucgucccagaagacaaaaaguggcaccgccaccccauauucgcaaaacucgaggacgaaguagcguaccacgaaaccuauccaacaaucuaccaccuccgaaagaagcucgcagacuccagcgagcaagcagaccuucgauuaauauaccuggcacuggcacacaucgucaaguacaggggccacuuucuaauagagggaaagcucucaacagaaaacacaagcgucaaagaccaauuccaacaauucauggucauauacaaccaaacauucgugaacggagaaagcagacucguuucagcaccccucccugaaucgguccuaauagaagaagaacucacagaaaaagcgucccgcaccaaaaagucagaaaaaguacuccaacaauucccacaggaaaaggcuaacggccuauucggccaauuccucaaacucauggucggcaacaaagccgacuucaagaaagucuucggucuagaagaggaggccaaaauaaccuacgccucagaauccuaugaggaggaccucgaggguauccuggccaaggucggagacgaguacagcgacgucuuccuagccgccaaaaauguguaugacgcgguagaacuaucgaccauacucgccgacucggacaagaaaucacaugcaaaacucucgucguccaugaucguccguuucacagaacaccaagaagaccuaaagaaauuuaaacgcuucauacgagaaaacugcccagacgaguacgauaaucuauucaaaaacgaacagaaagacggauacgccggguacaucgcacacgcaggcaaagucagucaacucaaauucuaccaguacgugaagaaaauaauacaggacauagcuggcgccgaguauuuccucgagaaaauagcgcaagaaaauuuccucaggaagcaacguacguucgacaaugguguaauaccccaccaaauccaucucgcggaacuacaggcuauuauucacaggcaagcagccuacuacccauuccuaaaggagaaccaggagaaaaucgagcaacugguaacauuccgcaucccauacuacguaggccccuuguccaaaggcgacgccucaacauucgcauggcuuaagcgacaauccgaggagccgauccggcccuggaaccuucaagaaacugucgaucucgaccagucagcgacggcauucauagaacgcaugacgaauuuugacacauaccucccaagcgagaaaguccuaccaaaacauucacuucucuacgagaaauuuaugguauucaacgaacuaaccaaaauauccuacacagacgaccgcgguauaaaagccaacuucucaggcaaagaaaaggagaagauauucgacuaccuauucaagacuagacgaaaggucaaaaagaaagacaucauacaauucuaccguaacgaauacaacacagaaaucguuacccuuuccggccuagaagaggaccaguucaacgccuccuucucaaccuaccaagauuuacucaaaugcggauuaacacgagcagaacucgaccaccccgacaaugccgaaaaauuagaggacaucauaaaaauccuuaccaucuucgaagacagacagcgcaucagaacacaacuauccaccuucaaaggccaauucuccgcggaaguucuaaagaaacuagaacgcaaacacuauacugguuggggccgccuaucgaagaaacuaaucaacggcauuuacgacaaagaaucagguaaaacaauccucgacuacuuaaucaaagacgacggggucagcaaacacuacaaccgaaacuucaugcaauugauuaacgacucacagcucagcuucaaaaacgccauacaaaaggcucaaucgugcgaacacgaagaaacccugucugaaacagucaacgaacucgcggguaguccggccaucaaaaagggcaucuaccagagccuuaagaucguagacgaacugguagccaucaugggcuacgcaccaaaaagaaucgucgucgagauggcccgugaaaaccaaaccaccagcacaggcaaacgcagauccauccaacggcuaaagaucgucgaaaaggcgauggcggaaauaggcucaaaccuccucaaagagcaacccacaaccaacgaacaacuacgcgacacccgacuuuuccucuauuauaugcaaaacggaaaagacauguacaccggcgacgaacucucguuacaccgauuaagccacuacgacaucgaccacauuaucccucagagcuucaugaaggacgacucgcuagacaaccucguccuaguaggaucaaccgaaaaccgcgguaaaucugacgauguacccagcaagaaggucguaaaagacaugaaagcauacugggaaaaacuauacgccgcagggcuaauaucccaacgcaaauuucagcggcugaccaagggcgaacaggguggccucacccuugaggacaaagcccacuucauucaacgacagcucguugaaaccagacaaauaacaaagaacgucgcaggcauuuuagaccaacgguacaacgcaaaguccaaagaaaagaaagugcagaucauuacgcuuaaagccagccucacaucgcaauuccgauccauauucggccucuacaaaguacgagaaguuaacgacuaccaccacggucaagacgccuaccucaacugcgucgucgccaccacacugcuuaaaguguacccgaaccuagcccccgaguucgucuacggcgaauaccccaaguuucaagccuucaaagaaaauaaagccacggcaaagaccaucaucuacaccaaccucaugcgcuucuucacggaggaugaaccccgcuucaccaaagacuccgagauacuauggagcaacagcuaucucaaaaccaucaagaaagaacuaaacuaccaccaaaugaacaucgucaagaaaguugaaguccaaaaaggaggcuucuccaaagaaucaaucaaacccaaggggcccucaaacaaacuaauucccgucaaaaacggacuugauccccaaaaguacgguggauuugacagcccgguaguagccuacacaguacuguucacucacgaaaaggggaagaagccccucauuaaacaggaaauacuagggauaaccauaauggagaaaacucgguucgaacaaaacccaaucuuguuccucgaggaaaagggauuccuaagaccgcgcguacucaugaaacuucccaaguacacacucuacgaguuccccgaaggucguaggcgccuccuagcaagcgccaaagaagcccagaagggcaaccagaugguccucccagaacaucugcuaacacuacucuaccacgccaagcaaugucuccuccccaaccaaucagagucgcuagcauacguggaacagcaccaacccgaguuccaagaaauccuggaacgggucgucgauuucgccgaggugcacacacuagcaaaauccaaaguacaacaaauuguaaaacuuuucgaggccaaccagaccgcugacgucaaagagaucgccgccucauucauccaacucaugcaauucaacgccaugggcgcgccaagcaccuucaaauucuuccagaaggacauagaacgagcccguuacaccucgaucaaggaaaucuucgacgcuacgauaaucuaccaaagcaccaccggcuuguacgaaacaagacgcaaagucgucgacuga

SEQ ID NO: 6451 - RNA, 4014 nt, Artificial Sequence
  Cas9 variant
augaagaaagauuaugucaucggccucgacauaggaaccaacuccguugguugggccgugaugaccgaggacuaccaacucgucaaaaagaaaaugccaauauauggcaacacugagaagaagaaaaucaaaaagaacuucuggggcguccgccucuucgaagaaggccacaccgccgaggaccgacgacuaaagcggaccgcccgccgccgcaucucacgcagacggaaccgccugcgauaccuacaagccuucuucgaggaagcgaugaccgcccuagacgaaaacuucuuugcgcgacuccaagaauccuuucuggucccagaagacaagaaguggcaccgucaccccaucuucgcuaaacuagaagacgaggucgcguaccaugaaacguauccaacaauauaccaccuacgcaagaagcucgccgacucaucagagcaggcagaccugcgccucaucuacuuagcccuggcccacauagucaaauacagaggacacuuccucaucgaaggaaagcuguccacagagaauauaagcgucaaggaacaauuccagcaauuuaugauuaucuacaaccaaacauucgugaacggagaaagccgccucgugagcgcgccacuccccgaauccguccuaauagaagaggaacuaaccgagaaggccagccgaacaaagaaaagugaaaaaguucuccaacaauucccccaagagaaagcaaauggccucuucggccaauucuuaaagcugauggucggaaacaaagcagacuuuaagaaaguguucggacuagaagaagaagcaaagaucacguacgcuucagaaagcuacgaggaagaccuagaggggauacucgccaaagucggagacgaauacucggacgucuuucuagccgcaaagaacguauacgacgcagucgaacucuccacaauccucgcagauucggacaagaaaagccacgccaaacucucaucaucaaugaucgugcgcuucaccgaacaccaagaagaccugaaaaacuucaaaagauucauccgcgaaaauugccccgaugaguacgacaaccuauucaagaacgaacagaaagauggguaugcgggcuacaucacccacgccggcaaaguuucgcagcucaaguucuaccaguacgucaaaaagauaauccaagacauagcaggcgcagaguacuuccuagagaaaauagcccaggaaaacuuccuccgcaaacaacgaacauuugauaacggaguaaucccacaccaaauccaccucgccgagcuucaggcaauuauacaccggcaagccgccuauuacccguuucugaaagagaaucaagagaaaauagaacagcuagucacguuccgcauaccauacuaugugggaccccuuagcaaaggagacgcgaacacuuuugccuggcucaaacggcaaucugaagaaccaauacgccccuggaaccuccaagaaaccgucgaccucgaccaauccgccaccgccuucaucgagaggaugacaaacuucgacaccuaccugccgucagaaaaaguacucccgaaacacucacuacucuacgaaaaauucauggucuuuaacgaacuaacaaaaaucucauacaccgaugaccgaggaaucaaagcaaacuucucaggcaaagaaaaagagaagaucuucgacuaccucuucaaaacacggaggaaagucaagaagaaagacaucauccaauucuaccgcaacgaauacaacacagaaaucgucacccucuccggacucgaagaggaucaauucaaugccucguucuccaccuaccaagaccucuugaaaugugggcugacccgagcagaacucgaccaccccgauaaugcggagaaacuagaagacaucauaaagauccuuaccaucuucgaagaucggcaacgcaucaggacccagcucucaaccuucaaaggacaauucagcgcagaaguccuaaagaaauuagagcgcaaacauuacaccgguuggggucgccuaagcaagaaacuaauuaacgguaucuacgacaaagaaagcgggaaaacaauacucgacuaucuaaucaaagacgauggcgucagcaaacacuacaaccggaacuucaugcagcucauuaacgacucacagcuuucauucaaaaacgccauccagaaagcccaaucaagcgagcaugaggagacccugagcgagaccgugaaugagcucgcaggaucuccagcgauaaagaaaggcauauaccaaucacugaaaauagucgacgagcucgucgcgaucaugggguacgcgcccaaacggauagucgucgaaauggcgcgggaaaaccaaacgacguccacuggaaaaagaagaucaauccaacgccucaaaaucgucgaaaaggccauggccgaaaucgguagcaaccuacugaaagaacagccaacaacaaacgaacaacugcgugacacacgccuguuccuauacuacaugcaaaacgggaaggacauguacacaggcgacgaacucagccuacaccgacucagccacuacgacauagaccacauaauuccucagagcuuuaugaaagacgacucguuagacaaccucguacucgucggaagcacugaaaaucgcgggaaaucagacgauguuccaucuaaagaaguugucaaagacaugaaagcauacugggaaaaacuguacgcggcgggccucaucucucaacguaaguuccagcggcuuaccaaaggggaacagggcggccucacccucgaagacaaagcccauuucauccaacggcagcuaguggaaacgcgccaaaucaccaaaaacguagccggcauccuugaccagcgauacaacgcgaaaucuaaagaaaagaaaguacagaucaucacccuaaaagcgucccucacaucacaguuucgauccauuuucggacucuacaaaguacgagaagugaacgacuaccaccauggccaagacgccuaccucaacugcguggucgccaccacucuccuaaaagucuaccccaaccucgcccccgaguuuguauacggugaauaccccaaauuccagacauucaaagaaaacaaagccaccgccaaagccauaaucuacaccaaccuauuacgauucuucacggaagaugagccacgguucaccaaggacggcgagaucuuauggagcaacucguauuuaaagaccaucaagaaagagcucaacuaccaccagaugaacaucgugaagaaagucgaaguccaaaaaggcggcuucagcaaagaaucaaucaaacccaaagggcccuccaacaaacucauccccguaaagaacggccuagauccacagaaauacggagguuucgauagccccaucgucgccuacacaguccuauuuacacacgaaaagggaaagaagccgcuaaucaagcaggaaauccucggcaucaccaucauggagaagacccgguucgagcagaacccuauccucuuucuugaagaaaagggcuuccuccgcccgcgcgugcucaugaagcucccaaaauacacccuguaccaauuccccgagggccggcgacgccucuuggccuccgccaaagaggcccaaaaaggcaaccaaaugguccuaccagaacauuugcuaacccuacucuaccaugccaaacagugccuccucccuaaccagucagaaucgcuggcguacguagaacaacaccaaccggaauuucaagaaauuuuagaacgggucgucgacuucgcagaaguccacacccucgccaaaagcaaaguccagcaaaucguuaaacuguucgaagccaaccagaccgcagacgucaaagaaaucgcagccucguuuauccaacuaaugcaguucaaugcgaugggcgcgcccucaacauucaaguucuuccaaaaagacaucgagcgugcccgguacacuagcaucaaggaaauauucgaugcuacgaucaucuaccagucaaccaccggccuguaugaaacccgcagaaaaguagucgacuga

SEQ ID NO: 6452 - RNA, 4014 nt, Artificial Sequence
  Cas9 variant
augaaaaaggacuacgugaucggacuggacaucggcaccaacagcguaggaugggcagucaugaccgaagacuaccagcucgucaaaaaaaaaaugcccaucuacggaaauacggaaaaaaaaaaaaucaaaaagaacuucugggggguccgacuguucgaggagggacacacagccgaagauaggaggcucaaacgaaccgcacggcgccgcaucagcagacgccggaaccgccuaagauaccugcaggccuucuuugaggaggcuaugaccgaccuggacgaaaacuucuucgcgcgucuccaggaaagcuuccuagucccugaggacaaaaaguggcaccgccaccccaucuucgcaaaacuagaagacgaagucgcguaccacgaaacauacccaacuaucuaucaccuacgcaaaaagcuggcggacuccagcgagcaagccgaccuccggcucauauaccucgcacucgcccacaucgucaaguaccgcggccacuuccugauagaaggaaaacuauccacagagaacauaagcguaaaagagcaguuccaacaauuuaugaucauauacaaccagacauuugucaacggggagucgaggcuagucagcgccccucuccccgaaagcguccuuaucgaagaggaacucaccgaaaaagcaucacggacaaaaaaaucugaaaaagugcuacaacaauucccccaagaaaaggcuaacggccuguucggccaguuccucaaacucauggucggaaacaaagcagauuucaaaaaaguauucggauuagaggaggaagcaaaaaucaccuacgcauccgagucuuacgaagaagaccuagaaggcaucuuagccaaagucggagacgaguacucagacgucuuucuggcagccaaaaacguauacgacgcaguagagcucucaacgauccucgcugacagcgacaaaaagucacacgccaagcucaguagcuccaugaucguccgcuuuacagaacaucaagaagaccucaaaaaauucaagagguucaucagagaaaacugccccgacgaguacgacaaucuauucaagaaugaacaaaaggauggauacgcgggcuacaucgcccacgccggcaaagucucccagcucaaauucuaccaauacgugaaaaaaaucauacaagacaucgcaggggccgaauacuuccucgaaaagauagcccaagagaacuuccuccgcaaacaacguacguucgacaacggagucaucccacaccaaauacaccucgcugaacuccaagcgauaauccaucgccaggccgccuacuaccccuuccuaaaagagaaccaggagaaaaucgagcagcuuguuaccuuucgcauccccuacuacgugggcccacuauccaagggcgacgcaagcacauuugccuggcuaaaaagacaguccgaagaacccaucagaccauggaaucuccaggagacaguagaccucgaucaaucugcaacugccuucaucgagcgcaugacaaacuucgacacauaccugcccuccgaaaaagugcucccgaaacacucccuccuuuacgagaaauucauggucuucaaugagcuaaccaaaauuaguuacacagacgacaggggaaucaaagcuaacuucagcggaaaagaaaaagaaaaaaucuucgacuacuuauucaagacccgccgcaaaguuaaaaagaaggacauuauccaauucuaccgcaacgaguauaacacagaaaucguaacacuuagcggucucgaagaagaccaauucaacgcgagcuucagcacauaccaagaccuccucaaaugcggccugacccgcgcagaacucgaccaucccgacaacgccgagaaacuagaagacauuaucaagauccuaacaaucuucgaggacagacagcguauacgcacccaacucucaacauucaagggucaauucucggccgaaguacuaaaaaaacucgagcgcaagcacuauacaggcugggggcgccuaucgaagaaacucauaaacggaauauacgacaaagaaucaggcaaaaccauacucggcuaccucaucaaggacgacggugucucuaaacacuacaaccgcaacuucaugcaacuaaucaacgauucccagcugagcuucaaaaacgccauccagaaggcccaauccucggagcacgaagaaacguuaucagaaaccguaaacgaacuugccggauccccugccaucaagaaagggaucuaccaaucacugaaaaucgucgacgagcucgucgcaauaaugggcuacgcgcccaagcgaauagucgucgaaauggcgagagaaaaucaaacaacuucuaccggcaaaagacggagcauacaaagacugaagaucguagaaaaagcgauggccgaaaucggcucuaaucuccugaaagaacagcccaccacaaacgaacagcuccgcgauaccagacuauuccuauacuacaugcaaaacggcaaagacauguacacgggggaugaacucucacuccaccgacuaagccauuacgacaucgaccauaucauaccccaaucauuuaugaaagacgacagucucgauaaccucguccugguagguuccacagaaaaccgcggaaagucugacgacgugccuagcaaagaggucguaaaggacaugaaagcguacugggaaaaacuauacgcagccggccuuaucucgcaacgcaaauuccaacgacucaccaaaggagaacaaggcggcuuaacucuggaagacaaagcccauuucauccaacggcaacuagucgaaacccgucagaucaccaagaacguggcaggaauacuugaccaacgcuacaacgcgaacucuaaagaaaaaaagguccaaaucaucacccucaaagccagccuaaccucccaauucagauccauauucggucucuacaaagugcgagaagugaacgauuaccaucauggucaggacgcuuaccugaacugcguggucgccaccacacuccuaaaaguuuacccaaaccucgcacccgaauucgucuacggggaauacccaaaauuccaaacauucaaagaaaacaaggcaaccgcaaaggcaauaauauacacgaaucuacuuagauucuucacagaagacgaaccacgcuucaccaaagacggcgagauacuuuggucaaacuccuaccucaagacaaucaagaaggaacuuaauuaccaccagaugaacauaguuaagaaagucgaaguacagaaaggcggcuucuccaaagaaagcauaaagccaaagggacccuccaacaaacugauacccgucaagaacggcuuagacccccaaaaauacggaggauucgacucaccuaucguugcguacaccguauuauucacucacgagaagggaaaaaaaccccucaucaaacaagagauccucggcaucacaaucauggagaaaacaagauuugaacaaaaccccauccuguuccuagaagaaaaagguuuccuccgcccacgaguccucaugaagcugccaaaguacacacucuacgaguucccugagggccgaagaagacuacuggcauccgccaaagaagcgcaaaaagguaaccaaaugguccuccccgagcaccuccuaacccuccuauaccacgccaagcaaugccuccuacccaaccaaucagaaucgcuugcauacgucgagcagcaccaaccugaguuucaagagauccucgaacgcgucgucgacuucgccgagguacacacgcucgcaaaauccaaaguacaacagaucguaaaacucuucgaggcgaaccagaccgcagacguaaaagaaaucgccgccagcuuuauacaacuuaugcaguuuaacgccaugggcgcacccuccaccuucaaauucuuccaaaaagacauugagcgcgcgcgguacaccucgaucaaagaaauauucgacgcuaccaucauauaccaauccacaacgggccuuuacgaaaccagaagaaaggucguugacuga

SEQ ID NO: 6453 - RNA, 4017 nt, Artificial Sequence
  Cas9 variant
augcaggacuacuaccuaggacuggacauaggaacgaauagcgugggaugggcgguaaccgacgagaacuacaacuuacuacgcaagaaaggcaaagaccuauggggcguccggcuauucaaagaagcgcaaccagcgacggaaagaagagggcauagaagcagccgcagacgaacaauacguaaaagccuacggaaacaacugcuccgggaacuauuugaagaagaaauuaacgcaaucgacaaagacuucuuccuccgacucgacgaguccaaauacuggcucgaggacaaaaagauagagggaaaauacucacucuucaacgacgaaaacuucacagacaaggacuauuacgaaaaguucccaacgauauuccaccuucgaaaggcgcuaauagagucagacgacaaagaagauauaagacuguacuuucucgcaauaaaccagaugaugaagagaaggggacacuuucucaucgacgggaaacuaagcaacguggaggacaucacaccauucaaagagugcauucaaaaccuaauaaacgaggaacuagacacagagauagaaaccgaauuuuaugauaaagccaucaaaauagucagcgacuacucccugaagaaaacggaaaagaaaaaccuaaucaaggacuuggucaaagagacagauucuauagaagacuccaagaaaauuaucaauauauucaaccuuuuaauauccggcaaaucgaaaguaaacgggauauucgacgacgaggaaauccuugagaaaaucaaggaagacaacaaggaagacuucuaucucacaucugagaaguacgaagagaaccuagaauauuuuucgcagcugcucgacuaccgauucgaacuaaucucgagucugaaaagcaucuacgacuacaucauccugcaagagguccuaaaaggcaagaaauaucucagcuacgcgcagguagaacgcuacaagaaccacaaagaggaccucagaaaacuaaagcagcucaucaagaaauacgacaaaaacgggaaaauauacuaccagauauuccgagacgaaaacuuuaaaaagggguacgucgcuuaccucgguuacuacaagaagaacaagaagaacgucccugugaaaaagugcgacuacgacaccuucucgaagaacauaaagagcacccucgacaaaaucugcgauaaagaagacccacuguacaucgaacucaucgacaagaucgaaaagggaggcuuccuacugaaacaaaucgucagcacaaacucggugaucccgcaccaaguccacgaacuagaacucgacaaaauacuagaaaaccuagaaaagaacuaccccucguuuaaggaaaucucggacggcgucuccaaaauagacaaaaucaaaaugaucuucaacuuccgcauccccuacuauguaggcccccucaacgacuaucacaaagacaaaguaaacagcaacaccuggaucgugaaaaacgaaggauuugaaaacgaaaacauccggccauggaauuucucuaaaaucgucgacgagcacgcaugcgaagaagaguuuauaaagcgcaugaucaacgaguguaguuacauuccaggcgagaagguccucccaaagucauccuugcuauauuccgaauacaugguccugaacgaacucaauaaccuacgcguaaacggggacaagcucaacccaaagaucaaaaaggagauagucgaaaacaucuacaagaaagagagaaaaguaacgcucaagaaaauacggaacuuucuaaucaucaacaacuacguggacagcaaagucgaguucagcggccuguccgauggcauaaaagccaacaugagcucguacaucgacuucgcggaaauccuagacgacaacuucgacaacaacaugguggaagaccucauugaacagauaacgauacacgucggaaacgucaaacuccucacagaaaagauaucaaacaaguaucccaaccuagagaagaaacaaaucaacaaaauuguuaaccuuaaauucaaagacugggcccgcuucucccgcaaacugcucguaggaaucgaaggcacagagaaggagacgggcgaaauaaacacaauaauaggguuccucagagaaacgaacgagaacuucauggagcucaugucgaaccgguacacuuucuccgaggagaucagugaaaucaaaaagaaguacauaccaaacaaacuuucgaaacaaauaguugacgaccuguacguaagcccggccgucaagaaaaugaucuggcaaguccugaacaucaacgacgaacugaucaaaguacuuggcaaacaaccgaaaaagaucuucaucgaaauggccaggggaaaagaggaaaaacccgaagucaaggacucgcgcaaaaacaagcugauagaacuauacaaaaaccuuggcaaggaaggcaaagagugguuaaaccgaauagaagacaagacagaagccgacuuucgcaaccgcgcucucuacuuauauuacacccaaauggggcgcugcauguauacgggcgaaauaaucgacauagagcgccucuacgacaaagaacucuacgaccuggaccacaucauaccgagaaaaaugaagaaggacgacagcauccacaaaaaccugguccuaguaacgcgcaacucaaaucaauacgaaaagaaagacaacuaccccguccccgaggucauaaaaagucgcgaaaaugucaggcaucuaugguacgcacucaagaagaaggggcuaauaacagaggaaaaguacaaccgacuaaccaggauaaacccgcugagcgacaaggaacucagcgaauuuauagaaaggcaacugguagagacacgccaaaccacgaagguaguuaaggaccucuucgaaaauuacuacacagacucuaaaaucgucacagucaaagcgggacuugucagcgaacuccggcgugacuucgaaguacucaaaugccgcgaaaucaacgaccuaaaucacgcccacgacgcauuccuaaacaucaucgugggagacguguggucgaaaaaguucacaucaaauccauacaacuucguaaagaaaaaccgggagaaguacacacugaacaacauauuuacgaagaaccagaaggaucuccgggggaacgaaauauggaacugugcagaaggcaaaaagcguaucauuaaaaccuugaacaaaccauccguccuauucagcguggagaauuucgaacagaccggccaacuuuucgaccagaacauaauaggcaaacaagacuauaaggagaagacaucauacgucccaauaaaaggagacgaacggcuacaggacauaucgaaguauggaggcuaccgaggcauaagcggggcauacuucuucaucguggagcacaccgaaaagaacaaacgagucaaaacaaucgagucacugcccaucuauaugaaaucguaugucgaagaaaacgggcuccuugacuucugcacuaacgagaugaagcucgucgauccaaaaaucaucguaaagaagcuaaauuacaaaucagagaucauagucgacggauucaaauaccuaaucucagggaaaaccgaaaaccgccucagccuggagaccaacgaauaccucuauuggaaccacacacaaaccaccgacauaaagaaaauccucaacauaaaugagaaaauagagcuggaaaaauacaacggcgacaucgaaagcgagagggaaaacaucauaaaauacauccagaucauacucgaaaaauucaagcucaaaccauucaucaaacgacggaaccuccccaauauagaaauaaacuucgcugacuacgagacagagaaacuccuacagcucuuaguaaaccugaucccgcuaaccaccaaguacgucucgccugucgaccuaaccgucauaucaggaagcaaguacgcaggaaaagugcugaucccaaagaaaaucagcaaccugaacgaagucauauucauuagcaaaucaauuaccgggaucuacgaaucgcgacgucgcauuauauga

SEQ ID NO: 6454 - RNA, 4017 nt, Artificial Sequence
  Cas9 variant
augaaacaggaauauuuccugggccuggacaugggaacaggaucgcuugguugggcgguaaccgacuccaccuaccaggucaugcgcaaacacgggaaagcacuauggggaacccggcuguucgaguccgccagcacggcagaggagcgacgcauguuccggacagcccgcagacggcucgacagacggaacuggcgcauacaagucuuacaagaaaucuucuccgaagaaauaagcaagguagauccaggauucuuccuccgcaugaaggaauccaaauacuaccccgaagacaagcgagacgcagaaggcaacugcccggaacuaccauacgcccucuucguggacgacaacuacaccgacaaaaacuaccacaaagauuauccgaccaucuaccaccuacgaaaaaugcuaauggaaaccaccgaaauccccgacaucaggcuagucuaucuaguacuccaccacaugaugaaacauagaggccauuuccugcucucgggcgacauaucccaaauaaaagaguucaaaucaaccuuugaacaacuaauccagaacauccaagacgaagaacuggaauggcauauaucccuggacgacgccgcaauacaguucguagagcacguccucaaagacagaaaccucacgcgcaguaccaagaaaagccggcucauuaaacaacucaacgccaaauccgcaugcgaaaaagcgauccucaaccuccucagcgggggcacagugaaacugagcgacaucuucaacaacaaggaacucgacgagucggagcgaccaaaggugucguucgccgauagcggcuacgacgacuacaucgggauagucgaggccgagcucgccgaacaauacuacauaauagcaucagcgaaagcgguauacgacuggucugucuuaguggaaauccuaggaaacuccgugucuaucagcgaggccaaaaucaagguauaucaaaagcaccaagcggaccucaagacccuaaagaaaaucgugcggcaguauaugacgaaagaggacuacaaacgcguguucgucgacacggaagagaaacuaaacaacuacagcgccuacauaggcaugacaaagaaaaacggcaagaaaguugaucuaaaaaguaaacaaugcacccaagccgacuucuacgacuuccuaaagaaaaacgucauaaaaguuauugaccacaaagagauuacccaagagauagaaucagagaucgaaaaagagaacuuccuaccaaaacaggucacaaaagacaacggcgucaucccauaucaaguccacgacuacgagcucaagaaaauccucgacaaccugggaacucggaugcccuucauuaaagaaaacgccgagaaaauacagcagcuuuuugaauuucggauccccuacuacguggggccccuaaaccgcguggacgacggaaaagacggcaaguuuacauggaguguccgcaaaucagacgcacgaaucuaccccuggaauuucacggaagugaucgacguggaagccuccgcagaaaaguucauacgcagaaugacaaauaaaugcacauaccuaguaggcgaggacguucucccaaaagacagcuuggucuacaguaaguucauggugcucaacgaacucaacaaccugcgccuaaacggagaaaagauauccguugaacuaaagcagaggaucuacgaggagcuuuucugcaaguaucgaaaagucacgcgcaagaaacucgagcgauaccuuguaauagagggcauagcgaagaaaggagucgaaauaaccggaaucgacggagacuucaaagcaagccugacggcauaccacgacuuuaaagagagacuaaccgacguacagcuaucgcaacgcgcaaaagaagcaaucgucuuaaacgucguacucuucggagacgacaagaaacuccucaaacagcgccuuagcaaaauguaccccaaccuaacaaccggccaauuaaaaggaaucuguucucucagcuaccaaggguggggaagacucaguaaaaccuuccuggaagaaaucaccguaccagcccccggaaccggcgaggucuggaacaucaugaccgcacucuggcaaacaaacgacaaccucaugcagcuccucucacgcaacuacggguucacaaacgaagucgaggaguucaacacacugaagaaagaaacagaccucagcuacaaaacaguugacgaacuauacgucuccccagcagucaaacggcagauuuggcaaacgcuaaaagucgucaaagaaauacaaaaagugaugggcaacgccccaaaacgaguauucguggagauggcgcgcgaaaaacaagagggcaaacgaucggacagccggaagaaacagcuggucgagcuauaccgcgccugcaaaaacgaagaacgcgacuggauaacagagcucaacgcccaaagcgaccagcaacuccggucagacaaauuauucuuauacuacauucaaaaaggacguugcauguacuccggcgagaccauccaacuggacgagcucugggacaacacaaaauaugacaucgaccauauauacccacaaucaaaaacuauggacgacagccugaacaaccgcguacucguaaagaaaaacuacaacgcgaucaaaucggacaccuacccacuaucgcuagacauccaaaagaaaaugaugucauuuuggaaaaugcuccaacagcaaggauucaucaccaaagaaaaauacguacggcucguccgaagugacgaacugucagcugacgaacuagcuggcuucauagaacgccaaaucguagagacgaggcaguccacaaaagccguggcaacaauacucaaagaagcgcuaccagauaccgaaauaguauacgucaaagcggggaacguaucaaauuuccggcagacauaugaacuccucaaaguacgagaaaugaacgaccuccaccaugcaaaggaugccuaucucaacaucgucgucggcaacgccuacuucgugaaguuuaccaaaaacgccgcaugguucauccgcaacaaccccggccgguccuacaaccucaagcgcauguucgaguucgacaucgaaaggagcggcgaaaucgcauggaaggcgggaaacaaaggaagcaucguaacgguuaaaaagguaaugcaaaagaacaacauccuaguaacucgaaaagccuacgaagucaagggaggccucuucgaccaacaaauaaugaagaaaggcaaaggacaaguacccaucaaaggcaacgacgaaaggcucgcugacauagagaaauacggaggcuacaacaaagccgcuggcacauacuucaugcuagucaaaucccuagacaagaaagggaaagagauacgcacaauagaguucgucccccuguaucucaaaaaucaaaucgaaauaaaccacgaaagugcaauccaguaccucgcccaggaacgaggacugaacagcccagaaauacuccuaucgaaaaucaaaaucgauacccuauucaaaguggacggauuuaaaauguggcucucaggccgcacaggcaaccaacuaaucuucaaaggagcaaaucaacucauacugucacaccaggaagcagcuauucuaaagggcguggucaaguaugucaaccgcaagaaugaaaacaaagacgcgaagcuaucagaacgggacggaaugacugaagaaaaacuccuacaacucuacgacaccuuccuagauaagcucucaaacaccguuuacucgauccggcucagugcacagaucaagacccucaccgaaaaacgagcuaaauucaucggacucuccaacgaagaccaaugcauagucuuaaacgaaauacuucacauguuccaaugccaaagcggcucggcaaaccugaaacuaaucggaggacccggaucggccggcauuuuggucaugaacaacaacaucaccgcaugcaaacaaaucagugucauuaaccaaaguccuacgggcaucuacgaaaaggaaauagaucucauaaaacucuga

SEQ ID NO: 6455 - RNA, 4017 nt, Artificial Sequence
  Cas9 variant
augacgaaaccauacucaaucgggcucgauauaggcaccaauuccgucggcugggcggucgucacagacggauacaaagucccggcaaagaaaaugaaaguguuaggaaauaccgacaaaagccacaucaagaaaaaccuccuaggcgcacuccuauucgauuccggcaacaccgccaaagaccgccgacuuaagcgcacagcccgucgccgcuauacgcgacgaagaaacagaauccuauaccuccaagaaaucuucgcugaagagauggcaaaggccgacgagaguuucuuccagaggcugaacgaaucauuccucacaaacgacgacaaagaguucgacucccacccaaucuucggcaacaaagcagaagaagaggcccaccaccacaaauuccccacuaucuuccaucuacgaaaacaccucgcagacuccacagagaaaagcgaucuucgccucauuuaucuagcacucgcacacaugaucaaauuccguggccacuuccugauagagggccaacuaaaagccgaaaacacaaacgugcagacccuauucgacgacuucguggaaguuuacgacaagaccgucgaagaaucacaucuuagcgaaauuagcguuucgucuauauugacggagaaaaucagcaaaagucgacgccuagagaaccuuaucaaauacuaccccaccgaaaagaaaaacacucuauucggcaaccugauagcgcucucgcucggacugcagccaaacuucaaaacgaauuucaaacugagcgaggaugcgaagcuacaauucagcaaagacacuuaugaagaagaccucggcgaacuacuuggcaaaaucggcgacaacuacgcagaccuguucaucucagcaaagaaccucuacgacgcuauccuacucagcggcauacugaccauagacgacaacaccacuaaagcgccacucuccgcaagcaugauaaaacgcuacgaagaacaccaggaagaccuugcacagcucaaaaaguucauccggcagaaccucccagaccaauauucagaaguguucagugacaaaacgaaagacggguacgcaggcuacaucgacggaaaaaccaaucaggaggcauuuuacaaauacaucaaaaauaugcuaaguaagaccgagggcgccgacuacuuccuagacaagaucgaccgcgaagauuuccuaaggaagcagcguaccuucgacaacggaagcguaccgcaccaaauccaccuccaagaaaugcaugccauccuucgccggcaaggcgaauacuacccauuccucaaagagaaccaagauaaaaucgagaaaauccucaccuuuaggaucccuuauuacguggggccccucgcacgcaaaggaucccgauuugcaugggcagaauacaaggcugacaagaaggucacgcccuggaacuucgacgacauccucgauaaggaaaagagcgccgaagaguucauuacgagaaugacacuuaacgaccucuaccuaccggaagaaaagguacuccccaagcacagccuaguguacgaaacauucaacguauacaacgagcuaacaaaagucaaauacgugaaugaacagggcaaagcaauauucuucgacgcuaauaugaaacaagaaauauucgaucauguguucaaggagaaccgaaaagucacaaaagacaagcuacuaaacuaccucaacaaagaauuugaagaguuccgcauagucaaccucacagggcucgacaaagaaaacaaggcuuuuaauuccucacucggaacauaccacgaccuccgcaaaauacucgacaagagcuuccuggacgacaaagucaaugagaaaauaaucgaagacauaauacaaacucuaacccucuucgaagaucgcgaaaugauccggcaacgccuacaaaaauacagcgacauauucacaacucaacaauuaaagaaacuagaacgacgacacuauacgggcuggggacgacucagcgccaaacucaucaacggcauacgagauaaacaauccaauaaaaccauccuuggguaccuaaucgacgacggauacucgaaucgcaacuucaugcaacuaauaaacgacgacucgcuaccguucaaagaagaaaucgccagagcucaagugaucggcgaaacagacgaccucaaccagcucgucagcgacauagccggcucccccgcaaucaagaaaggcauacugcagagccuaaaaauaguagaugagcuagucaaagucaugggccacaaccccgcaaacaucgucauagaaauggcccgagaaaaccaaaccacagcuaaaggucguagaagcagccaacagcgcuacaaacgacuagaagaagccaucaaaaaccuggaccacgaccuuaaccacaaaauacugaaagagcacccaacagacaaccaagcccuucagaacgaccgacucuuucuuuacuaccugcagaaugggcgugacauguauaccgaggacccccuugacauaaaucgccuauccgacuacgacaucgaucacaucauaccacagagcuuuaucaaggacgacuccauagacaacaagguacuggucuccagcgccaaaaaccgcggcaagagcgauaacgugcccucugaagacguggucaaccgaaugcggccauucuggaacaaacuccuauccugcggccucaucucucaacgcaaauacucaaaccuuaccaagaaagagcucaaaccagacgacaaagcaggauuuauaaaacgacaacucguggaaacgcgacaaauaaccaagcacgucgcccaaauccucgacgcccgcuucaacacaaaacgcgacgaaaacaagaaagucaucagggacgucaaaauaaucacccuaaaaagcaaccuaguaagccaauuccgaaaagacuucaaauucuacaaaguacgagaaaucaacgacuaccaccacgcucaugacgcuuaccuaaacgcggugaucggcaaagcacucuuggacgucuacccacaacucgagccagaguucgucuacggagaguacccacacuuccacggguauaaggaaaacaaagccacagccaagaaauucuucuacucaaacaucaugaauuucuucaagaaagacgacauccgcacggacgagaacggcgagauugucuggaaaaaggacgaacacaucucgaacauaaaaaggguccugucuuauccccaggucaacaucgucaaaaagguggagauccaaaccgucggacaaaacggcggccuguucgacgacaacccuaaaagcccacuggaagugacccccucgaaacucguaccccuaaagaaagaacucaacccgaaaaaguauggcgguuaucagaagccaacaaccgcuuaccccguccuguuaauuaccgacaccaagcaauuaaucccgauauccguaaugaacaagaaacaauucgaacaaaacccagugaaauuccuaagggaccgcggauaccagcaaguaggcaagaacgacuucauaaagcugccaaaauacacccucguugacaucggggacggaauaaaaaggcugugggcauccuccaaagaaauccacaaaggcaaccaacucguggugaguaagaaaucacaaauccuacuguaccacgcacaccaccuagacagcgaccuaagcaaugacuaccugcaaaaucacaaccagcaauucgacguucuauucaacgaaauaaucagcuucucgaaaaagugcaaacucggcaaggaacauauacagaaaaucgaaaauguguacucaaacaagaaaaacuccgccagcauagaagaacucgccgaaaguuuuauaaaacuccuagguuucacccaacucggggcgacgagccccuuuaacuuccuaggcgucaagcucaaccaaaaacaguacaaaggcaaaaaggacuacauacuacccugcacggagggaacguugauccgucaaagcaucacaggucuauacgagacccgaguagaccuaagcaaaaucggggaggacuga

SEQ ID NO: 6456 - RNA, 4017 nt, Artificial Sequence
  Cas9 variant
augcgagacuacuacauaggccuagacuugggaacagggagucugggaugggcggugaccgacagggaauaugagauuaugcgugcccaugggaaagcacuguggggaguccgccucuucgacagugcaaacacagccgaggaaaggagaggauuccgcaccgccagacgacgacucgaucggagaaacuggagaaucgaacuacugcaggaacuguucggggaagauauaggaaaaguggacagcggcuucuuccuccgaaugaaagaguccaaguacaugccggaagacaaaagagacgucaacggcaauugccccaaacuaccguacgcccuuuucgucgaggacggcuacaccgauaaggacuaccaucgccaauucccgacaaucuaccaccuccgcaaauggcucauggaaaccgaggagacgcccgacauccgacugguauaccuagcacuccaucacaugaugaagcaccgcggacacuuucuauucagcgggaacauagagaaaauaaaagaguuccaagaaacauucagacaauacaucggaaaaauuagggaagaggaacuggacuuccaccucugcaucgaaggcgaggaacuacgggaaacagaaaacauacugaaggacaaaaaccuaacaagaagcgccaagaaaaccaggcucaucaaacugcugggggcgcacaccgcgugcgaaaaggcagcccugaaccuaguagcgggagggacgguaaagcuaagcgacaucuucggaaacagcgaauuagacgcaugcgagaaaccgaagcucagcuucgcagacgccggcuacgacgacuacgcaggcaugaucgaagacgaacugggagagcaacacguaaucauagaaacggccaaagccguuuaugacuggagcguccuggccgacaucuuaggagacuaccgaugcaucagcgaagccaaagcagccgucuacgagaaacaccaaaaggaccuuagacaucugaaagagcuaguaaaagaaaaccucggccgagacguguacaaagaaguauucguaaagaccaacgagaaacucccaaacuacucagccuacaucggcaugaccaagaaaaacggaguaaaaagugaaauggagggaaagcggugcgaucggaaagcguuuuacgacuauuuaaagaaaaccgucguaaacgcgaucccggacgagucgaaaacugaauaccuacgcaaagaaauggaaaccgagacauuccuacccagacaggugaccaaggacaacggcgugaucccgcaccagguacaccuccaagaguuagacgcaauccuagagaacuuaagcgguaggaucccagcacuaaaggaaaacggaagcaaaauacgagacauauucacauuccgcaucccauacuacguuggcccacugaacggcauaguaaaaggcggcgaacguaccaacugggucaggcgcaaaaaggcuggcaggaucuguccauggaacuucgacgagaugguggacacaggcgcaagcgcagaagaguucauccgccgcaugacgaguaaaugcacauaccuuauccacgaagauguacucccaaagaacagcaugcuauacuccaaguucaugguacucaacgaacugaacaacgucagacuaaacggagagccgauaagcguggaacuaaaacagaaaacguacgaagaccucuuucagcgccaccgcaaagucacucgaagacgacucacagacuacauacgccgagaaggaauagccggacgagacgcggauauaacagggaucgacggagauuuuaaaggaucacuaacggcauaccacgacuucaaagaaaaguugaccggcugcgaacugagccaagcagacaaagagaacaucauccuaaacauaacccucuucggagaagacaaagcguuacucaaaaagagacuaggggcacuuuaccccgccuuaacagagccacaaaagaaggcaauaugcgcguuaagcuacaaagggugggggcgauugagccaacgccuacuagagggaaucaccgcaccagcccccgaaaccggggaaaucuggacagucaucagggcaaugugggaaacgaacgacaacuuaaugcagguccucagcgagaaguacugcuuugccgcagcaauagacgaagaaaacgcgggggaagaauuaaaagagaucacauacaaaacgguugaacaaaugaacguaagcccggcggugcggcgacaaauauggcagagccuccaagugauaaaagagaucugcaaagucaugggcgggccgccgaagagagucuucgucgaaauggcccgggagaaaauggaauccaaaaggaccgaaagccgcaagaaacggcuuauagaccucuauaagaaaugcagagaagaagaacgugacuggauagaagaguugggcaacaccgaggaaacgcgccuacgguccgacaaguuguaccucuacuacacacaaaaaggacggugcauguauagcggcgaaguaaucgagcuagaggaacuaugggauaaucgcaaguacgacaucgaccacaucuacccgcaaucgaaagucauggaugacagccucgacaacaggguccuggucaagaaagaauacaacgccgacaaaacggacgaauaccccauaagagccgauauccgcggaaaaaugcgggcguucuggagaaucuugagagaggaaggguuuauaucaaaagaaaaauacaaccgacucacgagggguacuggcuucgagccaucagagcucgcgggauucauagcacgucaacuggucgaaacgcggcaaggaacuaaggcuguagccagcguccuaaagcaaguguucccagaaaccgacaucguauacgcaaaagcgcgaguggcaagccaauuccggcaagaguucgaucugaucaaaguccgagaaaugaacgacuuacaccacgccaaagacgcauacguaaauauaguggugggcaacgucuacuacacgaaauucaccuccaaugcggcgugguaugucaaggagcacccggggagaaguuacaaccuaaagaaaauguucaccagcgaaagagaugucgcacgcaacggagaaaccgccuggagagcagggaacuccggcacaauagcaacagucaaacgcgugauggggaaaaacaacauacuggugacacgcagauccuacgaggucaaagggggcuuguucgaccaacaacucaugaaaaagggcaaaggacaagugccuaucaaaggacgcgaugaacgacucgcggacaucgacaaguacggaggcuauaacaaagcagcagggaccuacuuuaugcucgcagaaucagaagacaagaaaggagccaaaauacgcuccguagaauacgucccacucuaccucugcaacugcauagaaaaagacgaagaggccgccaagaaauacuuacaaaaagaaaggggacugaaaaauccccgcguccuaaucgcgaaaauaaaaauagacacccuauucaaaguggacggcuucuacauguggcucaguggacgaaccggaaaccaacucauauucaagggggcgaaucagcugauacugagcgaaccagauaugcggauacucaagaaaguccucaaauauguaaauagaaagaaagagaacaaaaacgccguacucggcgaacaugaccaacuaccugagacagaccugauccgucuuuaugauguuuuccuagacaaaaucgaaaacacagucuaucacgugaggcugucagcgcaacaagggacacucaccaaaaacaaagacacguuuugcgaguuauccaacgaggacaaauguauaguccugucagaaauacugcacauguuccaaugccaauccggcagcgcgaaucuaaaacuaauuaagggucccggcagcgccggaauauugguauuaaacaacauaaucagcaaaugcaaccaggucaguauaauccaccaaagcccgacgggaaucuacgagcaagagauagaccucaaaaagaucuga

SEQ ID NO: 6457 - RNA, 4020 nt, Artificial Sequence
  Cas9 variant
augaacaaagccuauacccuaggacuggacaucggcaccaacucggucgggugggcagucgugacggacgacuacagacuaauggccaaaaaaaugcccguacacuccaagauggagaaaaaaaagaucaagaaaaacuucuggggggcucgccuguuugaugaaggacagacagccgaagaacgacgcaacaagcgcgccaccaggcgacgccuucggagacgcaaguaccgaauacuugagcuccaaaagaucuucuccgaagaaauauuaaaaaaagacagccacuucuucgcccgccucgaugaaucauuccuaaucccagaagacaaacaguacgcacgauucccaauuuuuccuacacuguuagaagaaaaagccuacuaccaaaacuacccaaccaucuaccacuuacgccaaaaacuggcagauaguaccgaaaaagcugauauacgccuggucuaucuggcccucgcccacaugauaaaauaccgcggacacuuccuuuucgaaggagaacucgacacagaaaacacauccguagaagagacauucaaagaauucauagacauauacaacgagcaauucgaggagggaauaaucuucuacaaggauaucccacuaauccuuaccgacaaacucucaaaaucaaaaaaaguagaaaaaauacuacaauacuacccuaaagaaaagacaacaggaugccuugcacaauuccucaagcuaauugucgggaaccaaggcaauuucaaacaagccuuccacuuagacgaagaggucaaaauccaaauuucuaaagaaacauacgaggaagaccucgaaaagcuacuacgcaaaagcaaugaggagaugaucgacguauuccugcaaguaaagaaggucuacgacgcgauccuacucagcgauaucuuaagcaccaagaugaaggacacgaaagcaaaacucuccgccggcaugaucgaacgcuaucaaaaccacaaaaaagaccuggaagaacucaaacaguuuguccgagcacaccuccacgaaaaagucacagucuuuuuuaaagacagcucuaaagacggauacgccggauacauugacggcaaaacaacccaagccgacuucuacaaauuccucaaaaaggagcuuaccggcguacccgguucggaaccgaugcuagcaaaaaucgaccaggagaacuuucuacucaaacagcgcacgccgacgaacggagucaucccacaccagguccaccucacggaguucaaggcaauaaucgaccaacaaaagcaauacuacccauuccuagagaaaucaaaggaaaaaaugauacaacuccucacauuccguauacccuacuacgucgguccacuugcccaagacaaagaaaccuccuccuuugcgugguuggaacgaaaaaccaccgaaaagauuaagccguggaaugcuaaggacgucaucgacuacggggcaucggccaccaaauuuauacaacggaugauuaauuacgacacguaccucccaaccgaaaaggugcuacccaaguacuccaugcuauaucaaaaauacaccauauucaacgaacucacaaaagucgccuacaaggacgaccgcggaaucaagcaccaauucagcagugaggagaaauuacgcaucuuccaagaacuuuucaagaaacaacgccgagucaccaaaaaaaagcuacaacacuuccuaagugcgaacuacaacaucgaagacgccgagauccuaggcguugacaaggucuuuaacucaagcuacgccacauaccacgacuuucuggaacucgcgaaaccuuacaccgaaaaaaucaucgagcuccuggaacagcccgagauggaagaaauguucgaagacaucgugaaaaucauaacaaucuucgaagacagggaaaugguacggacacaacugaagaaauaccagcggauucucggagaggagaucuucaaaaaacucguaaaaaaaaaguacaccggcuggggccgacugaguaaacggcugaucaacgggaucagagaccaaaagaccaacaagaccauacucgacuaccuaauaaacgacgacgauuuccccuauaaucgcaaucgcaauuucaugcaacucauaaacgacgaccaccuaagcuucaaagaagaaauagccaaggagcuaacucuuagcgacaaacaaucgcuacuagaaguaguagaggccauacccggcucaccggcaauaaagaaaggcaucuggcaaacccuaaaaaucguggaagagcugaucgcaauaaucggcuauaaaccuaagaacaucguaauagaaauggcacgagaaaaccaaaccaccaccggaggcaaaaaucgcucaaaaccccgacuaaaaucccucgaagaagcccuaaagaacuucgauucgcagcuacuuaaagaacgccccguugacaaccagucccuccaaaaagaccgccucuaccucuacuaccuccaaaacggcaaagacauguacacaggggaaucccucgauaucgaucgucuaucggaauacgacaucgaucacauaaucccaaggagcuucaucguggaccacagccuggacaacaagguccuagucucguccaaggaaaaucgacugaagaaagacgacguuccagauaguaaagucgugaagcgcaugaaagccuacugggaaaaacuccuccgcgcaaaccuaaucucggaacgaaaauucuccuacuugacaaaacuugaacucacggacgacgacaaggcccgcuucauacagagacagcuagucgaaacccgccaaauuaccaagcauguagcagccauccuacaccaauauuuuaaccaaacacaggaacuagagaaagagaaagacaucagaauaauaacacuaaaaucgucgcuaguaucccaauuccggcaagucuucggcauacacaaaguccgagagaucaaccaccaccaccacgcacacgacgcauaucugaaugcaguaguggcucucgcucuucugaaaaaauacccccgccucgcccccgaguucguguacggcagcuuugcgaaauuccaucuagucaaagaaaacaaagcgacagcaaaaaaagaauuuuacuccaacauacucaaguucuucgagaaagaagaacaguucugcgacgagaacggcgaaaucuucugggacaaacgcaaacacauccaacaaauaaaaaaaguaaucuccagccaccaggugaacaucgucaaaaagguggaagugcagaccggcagcuucuacaaggaaaccgucaauaccaaagagaaacccgacaaacucaucaaaaggaaaaacaacugggacgucaccaaauacggaggauucggaagcccagucguagccuacgcggucguauucaccuacgaaaaagggaagaaucacaaaaaagcaaaagccaucgaggggauuaccaucauggaacaggcgcucuucgagaaggacccaaucucauuccugauagaaaaaggguacagcaaugucaaccaguuuauaaagcucccaaaauacacacucuucgaacuagcuaacggccaacggaggaugcucgccucccaccaagaauuacaaaaagccaacucguuuauucuccccgaaaaacucguaacacuccuauaccacgccaaccacuacgacgagauagcguacaaagacuccuacgacuacgugaacgaacacuucuccaacuuucaggacauccucgacaaggucauuauauucgcagaaaaauacacaagcgccccgcagaaacucaaccagauaauugccaccuacgagaagaaccaagaagccgaccgcaaaauaauggcccacagcuuuguaaaccucaugcaauucaacgcgcucggagcccccgccgacuucaaauucuucgauaccacuauaacccgcaaacgcuacacaucgcuaaccgaaauauggcagucgacaaucaucuaccaaagcguaaccggacucuacgaaacucgccgcagaauggccgaccugugggaugggguacaauga

SEQ ID NO: 6458 - RNA, 4020 nt, Artificial Sequence
  Cas9 variant
auggagagauaccauauagggcuagacauaggcacaagcucaaucggcugggccguuaucggagacgacuucaaaauuaagaaaaagaaagggaaaaaccuaaucgguacaagacucuucaacgaaggggcaacagcugccgagagacgcggcuuccgaacccaacgacgcaggcuaaaccgccgcaaauggcgccucaaacuccucgaagaaaucuucgaccccuacauggccgaggucgacgaguauuucuucgcccgacucaaguccuccaaccucagcccaaaagacagcaacaagaaauaccugggcucacuacucuuccccgacaaauccgacagcaacuucuacgacaaauaucccacaaucuaccaucuccgacgagaccuaauggaaaaagacgaaaaauucgaccuucgagaaauauaccuggccauacaccacaucgugaaauauagagguaacuuccuggagaaggucccugccaagaacuacaaaaacucgggcgcuuccauaggcuuccuccucgaagaagugaacucacucuauaaggacauaaucggugacgagucaaucgccauccucaacagcgagaaguucgaagacguagagaaaauaauacuagacgaagaaaccagaaaccuggacaaacagaaaucagucgggaagcuccucgucgaagacaaaaagaagaaaaacaucgucaccgccuucuccaaagcaaucuucggcuacaaauuuaacaucgaagaccuacugcucaucgaaaacgacgagaaaaacaaacucaccuucaacgacgaaaacaucgaugacauauucaacgagcucucccacagucuggacgacaaacaaauggaccugcucacuaagacacgcgaaaucuacuucaaauucaaacucaacaugauaguccccacaggauacacgcucucggagagcaugaucgaaaaguacgagaugcacaaggcucaccuaaaaauguacaaagaguucauuaacacccucaacacuaaagaccgcaaaauucugaaaaacgcguacuccgacuacauaaacaccgaaaaagcgaaagcagccaacgcgcaagagaacuucuacaagacugucaagaaaauaauaaaagacaacaacuccgauacagcaaagaaaauuaucguccuaaucgaugaaggaaacuucaugccgaaacagagaacuggugaaaauggagucauaccacaucaacuacaucaaauagagcucgaucgaaucaucgaaaaccaggccaaguacuacccauggcuagcggaggcaaaccccgucgaaaagaacagaaaguuugcuaaguacaaacuugacgaacugguaacauuccgcgugccauacuacgugggcccucugaucgacaagaccgaaagcaauaaaaacgaaaaggaaaccaaguucgcguggaugguccgcaaagccaagggcacgaucacaccauggaacuucgaaaaccucgucgaccgaacagaaucagcaaacagguucauaaaacguaugaccagcaaggacacauacaucaucggcgaagauguuuuacccgccuccucccuucuauacgagaaguuuaagguccucaacgaacugaacaacaucaaaguaaacgaaaagaaauuggacaucgaacaaaaacaagauauauaccucaaucuguucaccaccgccaaaaacgucacgaaaaagucucucgcgaccuaccuaaacugcucggccgacuccauaucuggacucagcgacggagagaaauucaauagcucccuaagcuccuacauagaccuaaaagcaauccuagggaacauaguagacgacugcaacaaaaacgaagaccucgagaaaauaaucgaguacagcacuguuuuugaggauggcaacauuuacaaagagaaacuuucugagaucagcuggcucaccgacgaacagaucgaaaagcucagcaacauccacuucaaaggcuggggccgguuaagcaagaaacuacugacgcaaaucacuaacgagaacggcgagcgcauaaucgacgcccuauggaacacgucgaauaacuuuaugcaaauaaucaacgacgaguccauacaagcgaaacuggccgaaaucaacggcaaauacgcgggcaaauccgaccuggaagacauucuaucggaagccuacacgagcccccagaacaagaaagccauccgccagguuaugaagguggucgaagacaucgaaaaagccaugcagugcgaaccaacauccaucuccaucgaguucaccagaaagaaacaaaaaucucgacuaaccaacaccagauauaagaaaaucagcgaugucuacgagaaaaucgcggaugaaguaaucuccgaauacgaacuacgcaagcuacagagcgaacucgacucgaacgcgaacaacaugcgcgacagauacuaccuauacuucaugcaacucggccgagacauguauaccggagaaaagaucaauauagacgaacuucaccaacgguaugacauugaccauauccuaccccaaucauucauaaaggacgacuccaucaacaaccgcguccugacaagaaaagacguaaacaacaaggagaagucugacaaaaccgccgccgaccucuacgccgucgagaugucagauuucuggcgaaagcuccgcaagcaagggcucauaaccgaacaaaaauacaaaaaccugcuaacuaaaagcgacuccauagacaaguacgcaaagaaaggcuucaucaagcgacaacucguagaaaccucacaagugguaaagcuaguugccaacauccuccaggacaaauauucagauacgaaaaucauagaagugagagccaaacuuaauuccaaccuacgggaggaauacaaacuaaucaaaaaccgagcugugaacgacuaccaccacgccauugacggcuaccucacaaccuucaucggccaauaucuguacaaaacguacccaaaacuacgcagcuacuuugucuacaacgacuuuaaaaagcuagacucaaacuaucucaaacacaugaagaaguucaauuuccuguggcagcuccaggacgacaaaacgaucgauauauaugacaacgucaacaauaaguuuguguuaaacgucccugaaaugaaaaaguacauucagaagaucuauaacuacaaauacaugcuggucucgaaagaagugacuacaaagaacggcgcauuuuacgaccaaacgaaauauaacgccaaaaccgucaaccucaucccgaucaagaaaaacaagccgacgaacauauacggcggcuacaaagguaaagucuccagcuacaugaugcuagucaaaauuaggaagaagaaagaaguaaucuacaaauucgucgggguaccacggcucuggacugacgaauuagaccgucucaaagacaccacagaacgcaagauccugcuaaacgaaauagccaagaacucccugucgaagacggaacaggacuucgagguaauccucgacaaaguuuacuacggccaacuaaucauagacggaaaccagaaguacacucucggaagcucagaguacaaauacaacgccaugcaauuacaccuguccaaacacgcccucgagguccucgccaaagaaaaugucaaagacgccgagaucaccgacaaagaccucguauccgucuacgaagaaauccuaucgguugucaacaaauacuucgaacucuaugacauaaauaaauuccggcaaaaacucaacgaggggcuagagauauuccgaaaauuaccaguuuacaacgucuaugaguccaacaagauaaaacaagucggaaaauuugagguccucaaccgcaucuugauggggcuccacgccaacgccaugaucacagaccucaaagugcuaggcauuaaaaccaaacuaggacaaaugcaagugaacggcgggauaaagcuguccccggacgccaaacuaaucuaccagagccccaccggcaucuucagccgcgcagucaggguaaaagaccuaggcuga

SEQ ID NO: 6459 - RNA, 4020 nt, Artificial Sequence
  Cas9 variant
augagccugaauaccaacaagaaauacaacaucgggcucgacauaggcacaacaucgguaggaugggcugucaccgacgccgacggacaaaaacugcucaaagcgaaaaauaaaaaccuauggggcgugucacucuucgaagccggaaaaaccgcugccgaaaggagaggcuaccgcuccacacgcaggcgccucaaccacaggaaauuccgacuacgccuacucgaagacauguucgaaaaagagauacucuccaaagaccccagcuucuucauccgacuaaaagaagcauuccugucccccaaggaugaacagaaacaauucaaaggcaauauccuguucaacgacaaagacuacacggacgcagacuacuacgaacaguacaaaacuauauaccaccuacgcuacgaccuaauuucacaacacagacaauucgauauccgugaggucuaccuggcgauccaucaccucaucaaauaccgcggccacuuuauauacgaggaccagaccuucaccaccgacggcaaccaacuccaacaccacaucaaagcgaucaucaccaugaucaacuccauacuuaaucgaauaauuauuccugagaccaucgauauuaacguguucgagaaaacccuacuagaccgaaccaugaaucgauccagcaaaguaaaguuccuaauagaacuaacuggugaggacaaacaggacaaaccccuacuaaaagagcuauucaaccuaaucguuggccuaaaagccaaacccgcauccaucuuugagcaagaaaaccucgcaaccaucgucgagacaaugaacaugucuacagaacaaguucaacuagaccugcugacccucgcagacguacuggcggacgaggaauacgauuuacuacucacugcacaaaagaucuacucggccauaauauuggacgaaucgauggacggauacgaauacuuugccgaggccaaaaaggagaguuaccgcaagcaccaagaagaacucguccucgucaagaaaaugcucaaaucaaacgcgauaacgaacgacgaacgcgccaaauucgaauacuucuacaccgacuacaucggcgcaaaauccuccaauuacgaagagucuaaaaucauaaagaaaggccucagcgccgccuacggaaaauauucaaaagaagaaagacucuucaaacauaucgagcuccuccuggccaaggaaaacgugcuaaccacgguagaacacgaccuacuagagaagaacauaacguucgccucgcuacucccacuccagagaucgucccguaaugccgucauccccuaccaaguacacgagaaagagcucguugcgauucuggagaaccaagccacauacuaccccuuucuccucgaacaaaaagacaacauccacaagcuacuaaccuucagaauccccuauuacguugguccccuagccgaccaaaaagacucagaguucgccuggaugguccggaaacaggccgguaagaucacccccuuuaacuuugaagagauggucgacaucgacgcaucaucggaagccuucaucaagagaaugaccaacaaauguaccuaccuaauccacgaagacgucaucccaaagcacagcuuuucuuaugcaaaguucgaagugcuaaacgaacugaauaagauacgccuggacggcaagccaauagacaucccacuuaaaaagcgaaucuuugagggacuauuccucgagaaaaccaaagugacccauacaucucucaagaaauggcucgcagaauacgaacacaugaccgugucagucguacaaggaacccaaaaagaaaccgaguucgcaaccucccuccaagccuuccauagguucgucaaaaucuucgaccgagaaacagucagcaaccccgccaacgaagaaauguucgagaaaaucauauacuggagcacagucuucgaagacaaaaagaucaugagacgcaaacucagugaauauccacaacugacagagcaacagcagguacaacuugcccaaguacgcuuccgcggcugggggagacugagccagagacuuaucaaccggaucaaaacgcccgucagcggcgacgaagaccacaagcucuccaucaaugagauccucuggcaaacgaaugagaauuucaugcaaauaauacggaauaaagacuaccucuucaagaagaucaucgaggaacaguucgagaacgaaacagcccuccuuaacaaacagcggauagacgagcucgccacaucgccagcuaacaaaaagggaaucuggcaagccauuaaaaucguaaaagaacucgagaagguccuccaacagcccgccgaaaacaucuuuauagaguucgcacgguccgacgaagaguccaaacgaucuaccccacgcgacaaauucaucgaaaaagcauacgcgcaacugaaaaaggaaacugacacguucaaccuagagcacuugaaggaauugaagcaacgaucaaaacaauugagcagccagcgccucuuccuauacuucauucagaacggcaaaugcauguauuccggcgagcaccucgacauagagcgccuagauagcuacgaagucgaccacauccucccccagucguacauaaaagacaacagcaucgaaaaccuagcccucgucaagaaaguagagaaccagcgcaagaaagacagccuccuacugaacagcagcaucauaaaccaaaacuacucccgcugggaacaacucaagaacgccggccucaucggugaaaagaaauucaggaauuugacgcgaaccaaaauaaccgauagggacaaagaaggguucaucgcacgccagcuagucgaaacccggcaaaucaccaagcacgucacacaacuccugcaacaagaauacaaagacaccacaaaggucuucgccaucaaagcaacgcuaguauccgacuugcgccgaaaguucgaguucaucaagaaccggaacguuaacgacuaccaccaugcgcaagacgccuuccucguagcuuuucuaggcacaaacaucaccuccaacuacccaaaaaucgagauggaguaccucuucaagggauaccagcacuaccucaacgagguuggaaaaucagcggcaaagccaaaauucaccuucaucgucgaaaaccucuccaaacagcaauacaacuccacuaccggcgaagucaaauggaacccugaagucgacaucgcaaaacuaaagcggauccucaacuuuaagcaguguaacauaguccgcaaaguugaagaacaaucgggcgcacucuuuaaagagaccauauaccccguagaagaauccuccuccaaaacgaucccccuuaagaagcaccuugauacagcaauuuacggugguuacacagccguaaacuaugcuuccuacgcgcuaauucaauucaagaaaggccgaaaacucaaacgggagauaauagggaucccacuugcgguccaaacucggaucgacaacagcgaaacaucccuacagacauacauugcagaacaaaucaaauccgagguugagauccucaacggaagaauccugaaguaccaacucaucucaaacaacggcaacagacuuuacauagccggcccccgcgagcgccacaacgcacgccagcuaaucgugucugaugaagccgcgaaggugaucuggcucaucuccaccaaacaagcagucgaggcaacauuucuaaagcauuacacgcucgagcaccuggaagccgucuucgaggaacucauuagaaaacaggccgccgacuaucaaauauucgaaaaccuaaucaagaaaauagaggucaauaaagcauacuucuauuccugcaccuacaacgaaaaaguaaaaguaauugaggaacuuuugaaaaucacgcaagcgaacgcaacgaacggcgaccuaaaacuccucaaaaugaccaaccgagaagggcgacucggauccguuuccgucgcacuagacuucaaaauuaucaaccaauccguuaccggccuuuaccagagcauugaggacuacaauaacuga

SEQ ID NO: 6460 - RNA, 4020 nt, Artificial Sequence
  Cas9 variant
augucgcugaacacgaacaagaaauacaacaucggcuuggacaucggaacaacauccguuggcugggcggucacggacgccgacggccagaagcugcucaaagcgaaaaacaaaaaccucuggggagugucccuauucgaagcggggaaaaccgcagccgagcgucgcggcuaccggagcacgcgccgccgacucaaccaccgcaaauuccgccuucgacuccucgaagauauguucgagaaagaaaucuuaagcaaggaccccagcuucuucauccgccuaaaggaggcuuuccucagcccaaaagacgaacagaaacaauucaagggaaauauccucuucaaugacaaggacuacaccgacgcagacuauuacgaacaauacaagaccaucuaucaucugcgcuacgaccucaucucccaacacagacaguucgacauaagagaagucuaccuggccauacaccaccucauuaaguaucgaggccacuucaucuaugaagaccaaacguucacgacagacggaaaccaacuacaacaccacauaaaggccaucauaacuaugauaaacagcauacugaacagaaucaucaucccggagaccauugacaucaacguguucgagaaaacuuuacucgacagaaccaugaaucgcuccucaaaggucaaguuccuaaucgaacuaacuggagaagacaaacaggacaaaccccuacugaaagagcuguucaaucuaaucgucggacugaaagcgaaaccggccuccaucuucgaacaagagaaccuggcuacuaucgucgagacgaugaacauguccacagaacaaguccagcucgaccuauugacgcuagcagacguacucgccgacgaagaguaugaucuccugcuaacagcccagaaaauauauagugccauuauacucgacgaguccauggacggauacgaguacuucgcagaagccaagaaagaaagcuaccgaaagcaccaagaagaacuuguccuugucaaaaagaugcuuaagucgaacgccaucacgaacgacgaacgugccaaguucgaauauuucuacacggacuacauaggagccaaauccagcaacuacgaagaaagcaagaucaucaagaagggucuaagcgccgcauacggcaaauauuccaaagaagaacgccuguucaaacacauugaacuacuacucgcaaaggagaacguucuaaccacaguagagcacgaccuguuggagaaaaacauaacuuucgcgucgcugcugccccuacaacgcuccuccagaaacgcgguaauccccuaucaaguccacgaaaaagaacugguagcaauccuagaaaaucaagcaacuuacuaucccuuccugcucgaacaaaaagacaacauacacaaacuucuaacauuccgaauccccuacuacgucgggccccucgccgaucaaaaggacuccgaguucgcauggauggugcgaaagcaagcagguaagaucaccccguucaacuucgaagagauggucgacaucgaugcauccuccgaagcauucaucaagcggaugacaaacaaaugcacguaccucauacacgaagacgucauaccaaaacacaguuuuuccuacgccaaauucgaaguccucaaugaacucaauaaaauccgccuggauggcaaaccaaucgacauaccccuaaagaaacgaaucuucgagggucucuuccuugagaaaacuaaagugacacauaccagccucaagaaauggcucgccgaacaugagcacaugacgguaagcguaguacaagguacacagaaagaaaccgaguucgccaccucgcugcaagccuuccaccgcuucgugaaaauuuucgaccgggaaacagucucaaacccagcuaacgaggaaauguucgagaaaaucauauacuggagcaccguauucgaagacaagaaaaucaugcgacgcaaacugucagaauacccccaacucaccgaacaacaacagguacaacucgcacagguacgcuuucgggguuggggccgacucucccagcgacucaucaaccgcaucaaaaccccgguuaguggagacgaggaccacaaacucagcauaaacgaaauauuauggcagaccaacgaaaacuuuaugcaaaucauacggaacaaagacuaccuauucaagaaaaucaucgaagaacaauucgaaaacgaaaccgcacuucuaaauaaacagcgcaucgacgagcuagcaacaucgcccgccaauaagaaaggcauuuggcaagccaucaaaaucguaaaagagcuagaaaaaguacuccaacaacccgcagagaacauuuucaucgaguucgccagaucggacgaagaaagcaaacgaucgacuccacgcgacaaauuuaucgaaaaagcauacgcccaacucaagaaagagaccgacacauucaaccuagaacaccugaaagagcuuaaacaacgaaguaaacaacucagcucccaacggcuauuccuauacuucauccaaaacgggaagugcauguacuccggcgaacaccuggacauagaacgacucgacagcuacgaagucgaccacauccuuccccaaucauacaucaaggacaacucaaucgaaaaucuagcgcuaguuaagaaagucgaaaaucagcggaagaaagauucacugcuccugaauagcuccaucaucaaccaaaacuacucccgcugggagcaacucaaaaacgccggccuaauaggcgaaaagaaauuccguaacuuaacacgaaccaaaaucaccgaccgcgacaaagagggauucaucgcccgacagcucgucgagacacgccagaucaccaaacacguuacccaacuacuccaacaggaguacaaggacacuacgaaaguauucgccauaaaagcgacucuggugucagaccuccggcggaaguucgaguucauaaagaaccgcaacgucaacgacuaccaccacgcucaggacgccuucuugguggcauuucuaggcacgaacaucacauccaacuacccgaaaauagaaauggaauaccuuuucaaaggauaccagcacuaccucaaugaagugggaaaaucugccgccaagcccaaguuuacauuuaucgucgaaaaccuauccaaacaacaguauaauaguaccaccggcgagguuaaauggaaccccgaggucgacauagccaagcucaaaagaauccuuaauuucaaacaaugcaauaucgucagaaagguggaagaacaauccggggcccuauucaaggagacaaucuacucaguugaagaaagcagcuccaagaccauaccacucaagaaacaccucgacacagccaucuacgggggcuauacagcagucaauuacgccaguuacgcccuaauccaauucaagaaaggacgcaaacucaaacgcgaaauaauaggcaucccucuugcaguccagaccagaauugacaacucagaaacaucccugcagacguacauagcggagcaaaucaaaucagaaguugaaauccuaaacggccggauacuuaaauaccaacucaucuccaacaacggcaaccgucucuauauugccggcccccgagagcgccauaacgcacgccaacucaucguuuccgacgaggccgcgaaagucaucuggcuaauaagcacaaaacaagcagucgaggccacuuuccucaaacauuacacccuagagcaccucgaagccgucuuugaggagcucauccgaaaacaagcggccgauuaccagauauuugaaaaccucaucaagaagaucgagguaaacaaagccuacuucuacuccugcaccuacaacgaaaaaguaaaaguaaucgaggaacuacucaaaaucacacaagcgaacgccaccaacggcgaccucaaacuccucaaaaugacaaaccgcgaaggcaggcucggcucaguaagcgucgcacuggacuuuaaaauaaucaaccaaucagucacuggacuguaccaaucaauagaggacuacaacaacuga

SEQ ID NO: 6461 - RNA, 4020 nt, Artificial Sequence
  Cas9 variant
augaagaaagaauacaccauaggacucgacaucggaacaaacagcgucggaugguccguguuaaccgacgauuaccgacucguaagcaagaaaaugaaaguagccggaaacaccgagaaaucaagcaccaagaaaaacuucuggggagucaggcuauucgacgaaggacaaaccgcggaagcaagacgcuccaaacgaacagcccgccgccgacuagcaaggcgccgccaacgcaucuuggaacuacagaaaauauucgcgccagaaauacugaagauagaugaacauuucuucgcacgacucaacgaaucauuccugguccuugacgagaagaaacaaucgcgacaucccguuuucgcgacaauaaaacaagagaaaagcuaccaucagaccuaccccacaaucuaccaucucaggcaggcccuggcagauuccagcgaaaaagcggacauccggcuagucuaucuggcuauggcucaccuacucaaauaccgcggccauuuccucauagaaggagaauugaauaccgaaaacagcucugucaccgaaacuuuccgccaauuccuaucaacuuauaaccaacaguucagugaagccgacgacaaacaaaccgaaaaacucgacgaagcgguagacugcuccuucguauucacggaaaagaugaguaagaccaagaaggccgaaacacuccuuaaauauuucccccaugaaaagucaaacggcuaccucucccaguucauaaaacucauggucggcaaccaagggaacuucaaaaacguguuuggacuagaagaagcuaaacuccaguucaguaaggagaccuaugaggaagaccuagaagaacuacuggagaaaauaggagacgacuauauagaccucuucguacaggccaaaaacguguacgacgcaguccuacucucagaaauacucucagauagcaccaaaaacacccgagccaaguugagcgccggcaugauucggcgcuacgacgcccauaaagaggauuuaguacuacugaaacgauuugugaaagaaaaccuacccaagaaauaccgagccuuuuucggcgacaacagcgugaauggauacgcgggauacaucgagggccacgcaacgcaagaagacuucuacaaauucgucaagaaagagcuaaccggaauaaggggcucagaagucuuccuuaccaaaauagaacaagagaacuuccugcgcaaacaacguacauuugacaacggagucauaccccaccaaauccaccucacugagcuuagagcuaucauugcaaaccagaagaaacacuauccauuccuuaaagaggagcaggagaaacucgaaucucuacugacauuuaaaauaccuuacuacgucggcccacucgccaaaaagcaggaaaacuccccauuugcauggcucauucguaaauccgaggagaagaucaagccguggaaccuaccagagauaguggacauggaaggcagcgccguccgguucaucgagagaaugaucaacaccgacauguacaugccccacaauaaaguccugccaaagaacucacugcuauaccaaaaauucucaaucuacaacgagcucaccaaaguccguuaucaagacgagcggggccaaaugaacuacuucuccucgauagagaagaaggaaauauuccacgaacucuucgagaagaacagaaaaguaacgaagaaagaucuucaagaguuccucuaccuaaaauaugacaucaaacaugcggaacucucuggaauagaaaaagccuucaacgcuucauacaccacauaccacgacuuccugaccauguccgaaaacaagagagaaaugaagcaaugguuagaagacccagaacuagccuccauguuugaagaaauuaucaaaacucugacgguauucgaagacagagaaaugaucaaaacucgacuuagccaucacgaagccacucucggaaaacacaucauaaagaaacucaccaagaagcacuauacaggcugggggcgccuauccaaagaacuaauccaaggaaucagagacaagcaaucgaacaagaccauacuagacuaccucaucaacgaugacgacuuuccgcaccaccgcaaccgcaauuucaugcagcucauuaaugacgacagccuauccuucaagaaagaaauaaagaaagcccaaaugauaaccgauaccgaaaauuuagaggaaaucguaaaagagcuuacaggaagcccagccauaaagaaaggaauccugcagagcuugaaaaucgucgacgagaucgucggaaucaugggauacgagccagccaacaucguaguagagauggcgagagagaaccaaaccacgggcaggggauuaaaauccucaagaccaagacucaaagcccucgaagaaucccuaaaagacuucgggucccaacuccugaaagaauaccccaccgacaauuccucacugcaaaaggaccgacucuaccuguacuaccuacaaaacggacgggauauguacaccggcgcaccccuagauauacaccgccucagcgauuacgauauagaccacaucauuccccgcuccuucacgacagauaacaguaucgauaacaagguccucguaagcucaaaagaaaaccgccugaagaaagaugacguccccagcgagaaagucgucaagaaaaugcguagcuucugguacgaccuauacucauccaaacuaauauccaaacgaaagcuagacaaccuaaccaaaauaaaacugacggaggaagacaaagcaggcuuuauaaaacgacaacucguggagacacgucaaauaaccaagcacgucgccggcauacuucaccaccgcuuuaacaaagcugaagacaccaacgaaccaauccgcaagguccgaauaaucacgcuaaagagcgcccuggucucacaguucaggaaucgauucggaaucuacaagguccgagagaucaacgaguaucaccacgcacacgacgcauaccugaauggggucguagcccucgcacuacucaagaaauacccacaacuagccccggaguucgucuacggcgaauaccuuaaauucaacgcgcacaaagcaaacaaagcaacaguaaagaaagaguucuauucgaacaucaugaaauuuuucgaauccgacacaccggucugcgacgaaaacggagaaauauucugggacaaaagcaaauccauagcccaaguaaagaaagugauaaaucaucaccauaugaacauugucaagaaaacagaaauccagaaaggaggcuucagcaaagaaaccgucgaaccuaagaaagacagcagcaaacugcuaccccggaaaaauaacugggaccccgcgaaauacggcggccucgguagccccaacguagcguacaccguugcauucacguacgagaaaggcaaagcccgaaaacggaccaacgcgcuagaaggaaucaccauaauggaacgagaagccuucgaacaauccccaguccucuuccucaaaaacaaaggcuacgaacaggcggaaaucgagaugaaauuaccgaaguacgcccucuucgaacucgaaaacgggagaaagcgcaugguagccagcaacaaagaagcccaaaaagcaaauagcuuccugcugcccgagcaccucguaacccuccuguaccacgcuaaacaauacgacgaaaucucccacaaagaauccuucgauuacgucaacgaacaccauaaggaguucagcgagguauucgcccgaguccuagaguucgcgggcaaguacacucuugcggaaaagaacaucgagaaauuggagaaaaucuacaaggaaaaccaaaccgacgaccuggccaaacuugcauccagcuuugucaaccuaaugcaauucaacgccaugggagcgcccgcagacuucaaguucuucgacgucaccaucccacggaagagauacaccucccuaaccgaaaucuggcaauccaccaucauucaccaguccauaaccggacucuacgaaacccgaauccgcauggguaaauga

SEQ ID NO: 6462 - RNA, 4023 nt, Artificial Sequence
  Cas9 variant
augaagaaagaauauacaauaggacuggacaucgggaccaacucagucggauggagcguacuaacugaugacuaccgccucgugucuaagaaaaugaaagucgcaggcaauacugaaaaaucaagcaccaagaaaaacuuuuggggcgucaggcucuuugacgaaggccaaaccgcagaagcgagacgcagcaaacggacggcacggagacgacuggcacgcagacgccaaagaauccuagaacuccagaagauauucgcccccgagauccuaaaaauagacgaacacuucuucgcccgccucaacgaguccuuccuuguccucgaugaaaagaaacaaucucgacacccggucuucgcuacaaucaaacaggaaaaaucguaucaccagaccuacccaacaauauaccaccuccggcaagcgcuugccgacucgagcgagaaagcagacauaagacugguauaccucgcgauggcccaccuccucaaauaccggggccacuuccuuaucgaaggcgaacuuaacacugaaaacuccucugugaccgaaaccuuccgccaguuccucagcaccuacaaucaacaguuuucugaggcagacgacaaacagacagaaaaacuugacgaagccguagacugcagcuucgucuuuaccgagaaaaugagcaaaaccaagaaagcugagacccuacuaaaauacuucccccacgaaaaguccaacggcuaccuaucccaguucaucaaacucaugguaggcaaccaagggaacuucaaaaaugucuucggccucgaggaagaagcgaaacugcaauucucaaaggaaacguacgaggaagaccucgaggaacuacuagagaaaaucggcgacgacuacauagaccucuuuguucaagcgaaaaacgucuacgacgcaguccuguuguccgaaauccucucagacagcacgaaaaauacacgagccaaacucucagccggcaugauaagacgcuacgaugcccauaaagaagaccucguacugcuaaaaagauucgucaaagaaaaccucccgaagaaauaccgggccuuuuucggagacaacagcgucaacggcuacgcaggguacaucgaaggccacgcaacacaagaagacuucuacaaauucguaaagaaagagcuaacuggaauccgaggcagcgaaguauucuugaccaaaaucgaacaagaaaacuuccuccggaaacaacgcaccuucgauaacggggucauaccacaccaaauacaccuuaccgaacucagagcaauuauagcaaaccaaaagaagcacuaccccuuccuaaaagaggaacaagaaaaacuggaaucacuccuaaccuucaaaaucccauauuacgucgggccacuagcaaagaaacaagagaacucacccuucgcauggcucauccgaaaaagugaagagaagauaaaaccuuggaaccugcccgagauaguggacauggaaggcuccgccguccgcuucauugaacgcaugaucaacacagacauguacaugccacacaauaagguccugccgaaaaacagccuccucuaccagaaguucuccaucuacaacgaacucaccaaaguccgcuaccaagacgagcgcggccaaaugaacuacuucucaaguaucgagaagaaagaaauuuuccacgaacucuucgagaaaaacagaaaagucaccaagaaagaucuucaagaguuccucuaccugaaguacgauauaaagcaugcggagcugucaggaaucgaaaaagcauucaacgccucguacacaaccuaccacgacuuccuaacaaugucggaaaacaagagggagaugaagcaauggcucgaagacccagaacucgcaagcauguuugaggagauaauuaagacacuaaccguauucgaggacagagaaaugaucaaaacucgacucucacaccacgaggccacgcuaggcaaacacaucaucaagaagcugacaaagaaacacuacaccggcuggggccgccugagcaaagaacucauccagggaauccgcgauaaacaaagcaacaaaaccauccuggacuaccucaucaacgaugacgacuucccccaucaucggaaucgcaacuucaugcaacucaucaacgacgauagccugucauucaagaaggagaucaaaaaggcccaaaugauuaccgacaccgaaaaccuagaggaaauaguaaaagagcucaccggaucucccgccaucaagaaagggaucuugcaaucccuaaaaauaguagacgaaaucguagggaucaugggauacgaaccugcaaacaucgucguggagauggcucgagaaaaucaaaccacaggacgcgggcucaaauccucccgaccgcgacucaaagcccuggaagagucucuuaaggauuucggaagucagcuccucaaagaguacccgaccgauaacucaucgcuccaaaaagaccgcuuauaccuauacuaucuacagaacggacgagacauguacaccggagccccucucgacauccaccgacucagcgacuacgacauagaccacauaaucccccgcucguucacaacggacaacucgauagacaacaaaguacucgucucgagcaaagagaaccgacugaagaaggaugacgucccgagcgaaaaagucguaaagaaaaugcggucauucugguacgaccucuacuccagcaaacugaucuccaaacgaaaacuggacaaccucacaaaaaucaaacuaacggaggaagacaaagccggauucauaaaacggcagcuagucgaaacacgccaaaucaccaaacacgucgccggcauccuacaccaccgcuucaacaaggcagaagauacaaacgaaccgauccgaaaagugcguauaaucacccuaaaauccgcccuagucagccaauucaggaacagauucggcauauauaaaguucgcgagaucaacgaauaccaccacgcacacgacgcauaccugaacggaguaguagcacucgcacugcuaaagaaauacccccagcucgcucccgaguucguauauggcgaauaccuuaaauucaacgcccacaaagcaaacaaagcaacgguuaagaaagaauuuuauagcaacaucaugaaguucuucgaaagcgauacgcccgucugcgaugaaaacggcgaaauuuucugggacaagagcaaguccaucgcccaggucaagaaagugaucaaccaccaucacaugaacaucgucaagaaaacggaaauccaaaaaggcggauuuucgaaagaaacuguggagccaaagaaagacucguccaaauuacucccccgcaaaaacaacugggacccugcaaaauacggcgggcucggcagccccaacguggcauacacaguagccuucacguacgaaaaaggcaaagcucgaaaacgaacgaacgcacuagagggaauaacaauaauggagcgcgaggccuucgaacagucaccaguacuguuccugaaaaacaaaggauacgaacaagcggagaucgaaaugaaauuacccaaauaugcacuuuucgaacucgagaacgggagaaagcgcauggucgccuccaacaaagaagcccagaaggcaaauagcuuccuucucccggaacaccuaguaacacugcuuuaccacgccaaacaauaugacgagaucagucacaaggagucauucgauuacgucaacgagcaccauaaggaguuuuccgaagucuuugcgcgcguacuagaguucgcaggcaaguacacacucgcugagaaaaacauagaaaaacuugagaaaaucuacaaggaaaaccaaaccgacgaccucgcgaaacucgcaagcucguucgucaaccuaaugcaauucaacgccaugggcgcacccgcagauuucaaauucuucgacguaacuaucccccgaaaaagauacacaagccucacagaaaucuggcaaagcaccaucauccaccaaucgaucaccggccuauaugaaacccgaauccggaugggaaaauga

SEQ ID NO: 6463 - RNA, 4023 nt, Artificial Sequence
  Cas9 variant
augaaaacagacuacuucaugggacuagacaugggcaccggcucccucgggugggcgguaacagauucgagcuaccaccugugccgugcacauggaaaagaccucuggggaguacgacuuuucgaaacggcccagacggccgaagaacggagagucuuccggugcaacagaagacgccuagaccgaagaaagagacgcauacaacuccuccaagauauauucgcccccgaaaucuauaagauagacccaggauucuuuuuaagacucaaagaaucccgguaccuccccgaagacaaaaagaaucuagaagggaaaacaccagaacuccccuacgcccuguuuguagacaagaaauacacagacaaagacuuccacaaagaauacccaaccauauaucaucuccgccugcgccugaugcaagaccgcaccccggccgauguuaggcuagucuaccuggcucugcaccaucucauuaaacacagaggccacuuccucuucgcuggaauagaggccgacaaaguaaccgacuucagcgccgccuuuucagaauuuuugcggaucguacaagagcaagaacucgacaucagcuucacccccgaugaggaaucgagccaaauaauaaaggaaacccuacaaaacaccaacuucaccagauccaagaaauccacagagcuaauaaaagggcuaaaagccagcacagggugcgaaaaggcccuacugaagcucaucuccggaugcaaaguaaaacuuuccgccguauucgacgacccugguugcgacgcuuacgaaaaaccacaagucugcuuugccgaauccucauacgaagacuacgccgccauccuagaggacgaacuagaagaccgauucaucguaauagccgcggccaaagcccuguacgacuggucaguccucgugaacauacuaggcgaagcaucaaccgucagcgaagccaaagucggaauauacgaaaaacaccgccgcgaucucaaauaucucaaacaccuggucaaaacaaaccucaccagggaggacuaccaagaccuauucguuaaggccggugccaaaaagaacaauuacugugcuuauauaggcaugaccaagaaaaacaacaagaaggucgugcucgaggaaaaacgcuguacgaaggaagacuucuacgccuaccucaagaaagagauauacucgaaaguacaagaaaacccagaggccgaauaucugcuagaggaacuagagaaagggacguuccucccgcgccaagucucuaaagacaacggcgugauccccuaccagcuacaauuccuagagcuacagaaaauccucaaaaacgccgucgaauaccuacccuuccugaaggaggaauccgagaaaauccaacagaucaugaccuuucggaucccuuacuacguaggcccacucaacggaaagaaggaaggccaaaauacauucgccugggcuguccguaaaaacaacgaaccgguauacccguggaacuucgaagaagucaucgacaccgaagccagcgccgaacaauucauacggagaaugacaaauaaaugcaccuaccuccccggggaagacgugcuaccaaaagaaucacuccucuacucaaaauuuaugguccucaacgaacucaacaaucugcgaauaaacggcaccaagaucuccgucgaacuuaaacaggagcucuacgaaaagcuguuucagcgcuaccguaaagucagcgcaaagaaacuccgggacuaccucguccgcaacggaaucacagagaaagaugccgaaauaagcggcauugacggugacuuuaaaggcacgcugcgagcguaccacgacuuuaaagagaaacuaacggguguugaacuaacagaggcagagaaagaaaccauuauccugaacaucacacucuucggagaagacaaaguacuucucaagaaaaggaugcaaagacuccuaccgaaccuaaccgaagggcaaaagaaagcaaucguaacgcuuaacuacuccggauggggccgccugagccgagaauuucucgaggaagugcaagcaccaaaccccgaaucaggagaaauccuaagcauaaucagggcccucugggaaaccaacgcgaaccuaaugcagcuccuaagcaaccaauacggauaccaagagauucuagagcagaugcgcgcagacuggaccggacauaaacucgauuaccaaaccguagaagaacucuacgucagccccgcggucaaacggcagaucuggcaaacgcuacaggucguaaaggaguuaaagaaaguaaugggaggggaaccaaaacgaguuuuucucgaagucgcgagggaaaagauggaaucagggcguaccgucagcaggaagaaacaccucaaggaccucuaccucagcuguaagucagaagaacgcaacuggcuugcugaacuggaccggcacgaagaacacuccuacaggagcgacaggcuauuccuauacuacacccaaaaaggcagaugcauguacugcggaaaaccgauagaccucggccaucucugggauguaaacauguacgacaucgaucacaucuacccacaaucaaaaguaauggacgacucuaucaggaaccgcguccucaccugucgaaccugcaacgccgagaaaaccgaccacuauccgcugaaagccgaaauccgccaaaagaugcgccccuuuugggauagccuaaaagcaggcaacuucauagaagaagaaaaauggaaaaggcuaaucagguccgaagaguucaccagcacggaacucgcaggguucaucgaacgccagcuagucgaaacgcgccaauccacuaaagcugucgccgacauacuaaaacaagccaugcccgagaccgagaucgucuaugucaaggcaaagaacguauccgccuuccgacaagacuucaacuucgucaaaaaccgagacguaaacgacuuccaccacgccaaggacgcauaccugaauauagugguagggaacaccuacuucguaaaguucacgaaaaacgcguccugguucauugaaagaaacccgggaagaagcuacaauuuaaaacgcauguucaccucagacuacgacguaaugaguaacggggagaucgccuggaaagccgggaacagugggaccaucaccaccguccgaaaaaugaugaagaagaacucaguacuauucacucggcgcucguucgaaguuagcggcgggcuguucgaccaacaacucaugaagaaaggaaaaggccaagucuacgucaaguccggggacgagagacuccggagcaucgaaaaguacggaggauacaacaaagcuacaggagccuacuuuaugcucguagaaagcgaaggaaagaagggagucaaaaagcgcacaaucgaguucgucccacucuaccgaaaagcagaacucgaagccucugaagagaaaauguuggaauaccuccgaaccgaaaucggacuaaaagaaccgcacguacuacuccacaaaaucaaaaccgacacgcuguuccaagccgacggauucaaaaugcaccucagcggccggacgggaaaacagcuaguguuuaaaggggccaaccaauuccucguggcggaagauuacgaaaggcuccuaaagaaaguagggaaaguaacggaacagcugaaaaccaacaaaaacuacaaaaucaacgacuacgacggcauaaccgaggaaggacugaaggcccuguacagcgaguuccucucuaaacugcaaaaagccccauacggaaauagauuaggaacucaagccgaaaccuuggaaaacgggaaggaaaaauucgacaagcuaagccuagaaaacaaaugccagguccuuucggagauccuacacuuauuccaauguaacuccucagcggcugaccucagcaaacucggaggucccggucauggcggcauacucguuuuauccaacgaaaucaccaaaugcaacaagaucucaauaauccaccagagcccggccgggaucuacgaacaggagauagaccugaaaacccucuga

SEQ ID NO: 6464 - RNA, 4023 nt, Artificial Sequence
  Cas9 variant
auggagcaggaguacuaccuuggccucgacaugggaacgggguccgucggcugggcagugaccgauucagaguaucacguacuacgcaagcacggcaaggcgcucuggggaguccgacuauucgagucagcaucaaccgcagaggaaagacgcauguuccgaacuucgcgaagacggcucgaccgacgaaacuggaggauagaaauacuccaagagauauuugcggaagagaucagcaaaaaggacccggguuucuuccucaggaugaaggagagcaaguacuaccccgaagacaagcgggacaucaacggaaacugccccgaacugcccuacgcacucuucguggacgacgacuucaccgacaaggacuaccacaagaaguuccccaccauauaccaccuacggaagaugcucaugaacaccgaagagaccccggacauacgccuuguauaccucgcaauacaccacaugaugaaacaccgcggccacuuccuacuuagcggcgacaucaacgaaaucaaggaauuuggcaccaccuucucaaaacuccuggaaaacaucaaaaacgaggaacuagacuggaacuuggaguuaggaaaagaggaauacgcaguaguggaaagcauacugaaggauaacaugcuaaaccgcuccacgaagaaaacccgauuaaucaaagcccuaaaagcgaaaagcaucugcgaaaaagcaguauugaaccugcuugcgggagggacggucaagcucucagacaucuucggccuagaagaacugaacgaaacggagcgacccaagaucucguuugcggauaacgguuacgacgacuacaucggcgaaguggaaaacgaacugggugaacaauucuacauaaucgagaccgccaaagccguauacgacugggccguccuaguugaaauccuuggcaaauauacuuccaucuccgaagcaaagguggcaacuuacgagaagcacaagagcgaccuacaauuucugaaaaagauagugcggaaauaccugacgaaagaggaauacaaagacauauuugucaguacgagcgacaaacuaaagaacuacucagccuacaucgguaugaccaagauaaacggcaagaaaguagaccuacagagcaaacgaugcagcaaggaagaguucuacgacuucaucaagaagaaugugcugaagaaacucgaaggccagccagaguacgaguaccugaaagaggaacucgaacgagaaacguuccugccaaaacaaguuaacagagacaacggagucaucccguaccaaauacaccuguacgagcuuaagaaaauccucggaaaccucagagacaaaauagaccugaucaaggaaaacgaagacaaacugguacaacucuucgaguuccgcauacccuacuacgugggcccccucaacaagauagacgacggcaaggagggcaaauucacgugggcgguccgaaaaaguaaugaaaagaucuaccccuggaacuucgagaacgucgucgacauagaagcguccgccgagaaauucauacgucgcaugaccaacaagugcaccuacuuaaugggagaagacguucuuccgaaggacucauuacuauacucaaaauacauggugcugaaugaacuaaacaacgucaagcuagacggagagaaacuaagcgucgagcugaaacaacgccuauauacagacguuuucugcaaguaccgcaaagugacggugaagaaaaucaaaaacuacuuaaaaugcgaaggaaucauaagcggcaacguggaaauaacgggcauugacggcgauuucaaagcgucacugacggcauaccacgacuucaaagaaauacuaacgggaaccgaacucgcaaagaaagacaaagaaaacauaaucacgaacauagugcuuuuuggcgacgauaagaaacuacugaagaaacggcuaaacaggcuauacccacagauaacgccaaaccaacucaaaaagaucugcgcgcuaagcuacacuggcuggggacgguucuccaagaaguuccuggaagagaucacagccccagaccccgagacuggagaagucuggaacauaaucaccgcgcuaugggaaagcaauaacaaucuuaugcagcugcucagcaacgaauacagauucauggaagaaguggagacguacaacaugggcaaacaaaccaagacacucaguuacgagacuguagagaacauguaugucuccccgagcgucaaacgccagauuuggcaaacacugaagaucgucaaagaacuggagaaaguaaugaaagaaucccccaaacggguauucaucgagauggcccgcgaaaaacaagaaagcaaaagaacagaaagccgaaagaagcaguuaaucgaccuauacaaagccugcaagaacgaagaaaaagacugggugaaggagcuaggagaccaggaagaacaaaaacuacgguccgauaaacuguaccuguacuauacccaaaaaggccgcugcauguauaguggagaagugaucgaacugaaggaccucugggacaacacaaaauacgacaucgaucauaucuacccccagucgaagacgauggacgacagccuaaacaaccgggugcuaguaaagaagaaauauaacgcaaccaaaagcgauaaauauccucuuaacgagaacaucagacacgagaggaagggauucuggaaaagccuccucgacggcggcuuuauaagcaaggaaaaguacgaacgccuaauaagaaacacggaacuaagcccugaggaacucgcaggauucaucgagcgacaaaucguugaaacccgacaaagcacgaaggcggucgcagagauccuaaagcaagucuuccccgaauccgaaaucgucuacguaaaagcuggaaccgucucccgauuccgcaaggacuucgaacuacucaaggucagggaaguuaacgaccugcaccacgcgaaagaugccuaccugaacaucgucgucggaaacagcuacuacguaaaauucacuaaaaacgcuucgugguucauaaaggaaaaccccggccgcaccuacaaccucaagaaaauguucaccuccggguggaacaucgagagaaacggugaaguagcaugggaagucgggaagaaagguacaaucguaaccgugaaacaaaucaugaacaaaaacaacauccuagucacccgacaaguacacgaggccaaaggcggucucuucgaccaacaaauaaugaaaaagggaaaaggccaaauagcaaucaaggagaccgacgaacgacucgcuaguaucgagaaguacgguggauacaacaaagccgcgggcgccuacuucaugcugguugagagcaaagacaagaaaggcaaaaccauaagaacgaucgaguucaucccccuauaccugaaaaacaagauagaaucagacgagucaauugcguugaacuuccuagaaaaaggacgcggacuaaaggaaccaaaaauacuacucaaaaagauaaaaauugacacccucuuugacguagacggguucaaaauguggcugucgggacggacaggagaccgacuacucuucaagugcgcgaaucagcuaauucuagacgaaaagaucaucgugacgaugaagaaaauagucaaauucauccaacgacgccaagagaaccgggaacugaagcuaucggacaaggacggcauagacaaugaagugcugauggagaucuacaacaccuucguggauaaacuggagaacaccguguaccgaaucagauuguccgagcaggccaaaaccuugaucgacaaacaaaaagaguucgaacggcuaagccucgaagacaaauccagcacccuguucgagauccuacacaucuuccagugccaauccagcgccgcgaaccucaagaugauuggagggccaggcaaagccggcauucucguuaugaacaacaacaucagcaaguguaacaagauaaguauaaucaaccagagcccaacagggaucuucgaaaacgagauagaccuacugaaaaucuga

SEQ ID NO: 6465 - RNA, 4023 nt, Artificial Sequence
  Cas9 variant
augggcgaagaauacuuucucggauuagacaugggaaccggcucacuaggaugggccgucacggaugacaaguaccaaauucuaaggagacacgggaacgcucucugggguguccgccuguucgaaaccgcaaacaccgcagaagaacgacgaauguuccgcacaaaccggcgcagacuagaccgucagggcuggcgcauaaaaauccuacaggagcuauucgcagaagagaucugccgaguggacccaggguucuacuuacggaugaaagaauccaaguacuacccggaggacaagcgagaugcaaacggcgaaugccccgcacuaccguacgcacuauucgcggacgcccaauauaccgacaaagacuaccaccgcgaguucccaaccaucuaccauuuacgcaagaugcuaauggaaacggaaacgacccccgacauacgccuaguauaccuagcauuccaccacaugaugaagcaccgcggacacuucuuacucuccggcgacauuucccaggugacagaguuccgaaacaccuuucuucaaaugaucgcuaacaucaaaagcgaagaacuagacuuuagccucgaaaucgaagaaacgcagaugggccaaaucgaggccgugcugaaagaucacaaacucacacgcuccgagaagaaacggcgacugacacaaauccuaaagccagcuaccgccugcgaaaaagccaucuucacacuccuguccggcggaaccgucaaacugagcgacaucuucggcaaagcagagcucgacgaaggcgaacgcccgaaaauuaguuucgcagacaacgguuacgacgacuacucugcaagcguugaggccgaucucggagagcaauacuacaucauagaauccgccaaagccguauacgauuggagcgucuuaagcgacauccugggcgauagcguaagcauaucagacgcaaaagucaaacuauacgaaaagcacaaaaaggaccucgcguaccucaagaaagugguacgggagaaucuacccagggaaguauauaaccaaguauucgugaacacggacgaaaaacucugcaacuacugcgccuacauagggauggcaaagaaaaacgggcgcaaaguugcacuagaaggaaaacggugcacgagagaagaguucgaauccuuccuaagaaagaaaauagucaacaaaauagaagacaaagaaauccaagaauaccuauccgaagagauagaaaaaggcaccuuccucccccgccaaguaacgaaagacaacggcgugauaccguaccaaauucaccuauacgagcuucggaagauaaucgacaaccuaucaccgaggaugcccuucauacgagacaauggggacaaaauaauccaacucuucacguuucggauaccguacuacguggggccccucggaaaaggagagggcagcgaaaaguucaguugggccguccgccgcacagacgaagccauauacccauggaacuucaaagacgucauagacguagaagcgagcgcagagaaguucaucugccgaaugacaaacaagugcaccuaccucuacggcgaagacguacucccaaaagacucgccacuauacuccaaguucaugguccuaaacgaacucaacaaccugaaacuugacggccaaucugugucgguagaacugaaacaacggauauaccaagaacuguucugccacacgaggaaggucacccagaagaaacugguaagcuaccuuguacgggaaggcaucaccgggaaaaacguugaaaucuccgguauagacggcgacuucaaagcgagccucacagccuaccacgacuucaaagaaaaacuaacuggagucgaacuaagucaacaggaacaggaggaaaucguccgcaacaucguccuuuucggggaagacaagaagcuacucaaacaacggcuagaagggagauucccacaacuaacccagaaacagauaucggucaucgcaacccuauccuauaaaggauggggaagacucucgcgcgaguuccucgaaaacaucacugucccagccccaggaacgggagaaguauggaacauaaucacggcccugugggaaacgaacgacaaccuuaugcaacugcuauauggugaauacggauuccaaacagaaaucgaauguuucaacgcaaaagagaagaagaaaucacuuucguacgaaaccauugaagaaagcuacgucucgccgucagucaaacgccagaucuggcaaacccuccaagucguuaaagaacucaagaaagugaugagaggcgacccaaaacgcgucuuuaucgaaauggcacgcgaaaaccaagaaagcaaacggacggaaucccgcaagaaaacgcuccuagaccuguacaagaacuguaagaaagaagaacccgaguggaucgccgaacucaccgagcaccuagaaaaacuggacgacagccaacucaggaaagacaaacuauuucuauauuacacccaaaaaggacgaugcauguacuccggggaacgcaucgagcucgaagaccuaugggacaacacacgguacgacaucgaccacaucuacccccagagcaagaccauggaugacuccgucgauaacagaguucuaguaaagaaagaguacaacgccaagaaaacagacgucuacccgauugcagcagacauaagagguaaaaugagccccuucuggaagaaauuacucgauaacaaacuaauaucgaaaaagaaauaugaccggcucguccgcaccgaagaacuaacgcccgaagaacuagccggcuucaucgaccggcagcuaguagaaacucgucaauccacgaagguaguugcagagaucuuaaaagaggcuuucccggacacagaaauuguuuaugugaaagcgggcaacguaucuaacuucagacacauguuugacauaguaaaaguccgagaauugaacgaccugcaccacgccaaagacgcauaucugaacauaguagucggcaacgccuauuacguaaaauuuaacaaaaacgccgcaugguucauaaaggaaaaccccggacgcagcuauaaccugaaaagaauguuugacuacgacauacgaagaaauaaugaggucgcauggcuugcaggcagcaccggcaccaucagccaaguaaagaacauggucaguaaaaaccauauccuggucaccagaaagaguuacgaggugaccggcggacuguucgaccagcaacugaugaaaaagggaaaaggccaaguccccguaaaaacgucggacgagcgccuuggaaacauugaaaaauacggagguuacaacaaagcaucaggggcauacuucaugcuagugaaaucgaaaaacaaaaagggcgaagaacaacgcaccauagaauacguuccaaucuaccucaaacacuauaucgaagaguccaaagaaaacgcccucgauuaccucaaaaacgaaagaaaauuaaacgaaccagaaauccuccucgacaaaauaaagaaagauacacucuucagaguaaacggguucuacaugugccugucaaaacgaaccggaaaacagcucgccuucaaaggggcgaacgaacugcuccugccagaacccgaaacacugcuacucaaaaagauaaccaaauacauccagcgccgcaaggaaaacaaagaccuaaaacuaacaaaacaagacaacauaaccgagaaggaacuucucgagcuguacgacguguucacugaaaaacuaaaccacuccgucuaugcggucugucuaggcacccaggggaaaacucugguucagaaaaagccagccuucguggcccuccccgucgaggaaaaauguaucguucucuccgaaauccuccaccuguuucaaugccaauccggcagcgccaaucucaaacucaucggagggcccgcauccgcagggauccuguaucucaacaguaauauaucagaugccggagagauacucaucauuaaccagagccccucgggcauauucgaaaaacggauagaccuccucagacuguga

SEQ ID NO: 6466 - RNA, 4023 nt, Artificial Sequence
  Cas9 variant
augaagaaagaguacacgaucggcuuggacaucggaacaaacaguguaggauggucgguccugaccgacgacuaccgucuagucucaaagaaaaugaaaguagccggcaacacugaaaaaucuucaacuaagaaaaacuucuggggcguaaggcucuuugacgaaggccaaacagccgaagcacgacgaucuaaacgcacagccagacgcagacucgcacgccgccgccagcgcauucuggagcuccagaaaauauucgcccccgaaauauuaaaaaucgacgagcacuuuuucgcacgacucaacgagagcuuccuaguccccgacgagaagaaacaaucccgccaccccgucuucgcaacaauaaaacaagagaaaagcuaccaccaaaccuacccaacaaucuaccaccuccgccaagcacucgcagacuccuccgaaaaagcggacaucagacuugucuacuuagccauggcccauuuacugaaauaccgcggccacuuccucaucgaaggagaacucaacacggaaaacagcuccgugacggaaaccuuccgacaauuccuuagcacauacaaccaacaauucuccgaagccggcgacaagcagaccgaaaagcucgacgaagccguagacuguagcuucguguucacagagaagauguccaaaaccaagaaagccgaaacccuccucaaauacuucccccacgaaaagagcaauggcuaccugucccaauuuauuaaacuaauggucggcaaccaagggaacuuuaaaaacgucuucggacucgaagaagaagcuaaacugcaauucagcaaagaaacauacgaagaggaccucgaagaacugcuggaaaagauaggagacgacuacaucgaccucuucguacaagccaagaacguguacgacgccguacuauuaucagaaauccuuuccgacucaaccaaaaacacccgcgcaaaacuauccgccgguaugaucaggagauacgacgcacacaaagaagaccuaguccuccuuaagcgcuuugucaaagaaaaccuaccgaagaaguaccgcgcauucuucggggacaacuccguaaacgguuacgcagguuauauagaaggacacgccacccaagaggcuuucuauaaauucguaaagaaagagcucaccggaauaagagggagugagguauuccuuaccaaaaucgaacaagagaauuuccucagaaaacaaagaaccuucgacaacggugugaucccucaccaaauacaccucucggaacugcgcgcgaucauagccaaccaaaagaaacacuaccccuuucuaaaagaggaacaagaaaaacucgagucccuccugaccuucaaaaucccguacuacguuggcccacucgccaagaaacaagaaaacagcccuuucgccuggcucaucagaaaauccgaggagaaaauuaaaccauggaauuuacccgaaauugucgacauggaaggcagcgccguccgauucaucgaaagaaugaucaacaccgacauguacaugccccacaacaagguccuaccuaagaacuccuuacuuuaccaaaaauuuaguaucuauaaugaacugaccaagguccgauaccaagacgaacgggggcaaaugaacuacuucagcucaaucgagaagaaagagaucuuccacgagcuuuucgagaaaaacaggaaagucaccaaaaaggaucuccaggaguuccuauaccucaaauacgacaucaaacacgccgaacucucgggcauagaaaaggcauucaaugccucauacacaacauaccacgacuuccuuacaaugagcgaaaacaaacgagaaaugaaacaauggcucgaagacccagagcucgccucgauguucgaagagaucaucaaaacucuaaccgucuucgaagaccgcgagaugaucaagacccgccugagccaccacgaagcaacucuaggaaaacacauaaucaagaaacucaccaagaaacacuacaccggcugggggcgccucucuaaagaacugauccagggcauacgagacaaacaaucgaacaaaaccauccuggacuaccucaucaacgacgacgacuucccacaccacagaaaccggaacuucaugcaacucaucaacgacgacucacucuccuucaaaaaggaaaucaagaaagcccaaaugaucacggacacggaaaaccucgaagaaaucgugaaagaguugacaggcucuccagcaauuaagaaaggaauccuacaaucacuaaaaaucgucgacgaaauagucgggauaaugggcuacgaacccgccaacauuguagucgaaauggcacgcgagaaccagacuaccggacgaggucuaaaaagcuccaggccccgacucaaagcucuagaagaguccuuaaaagacuucggcagccagcuccuaaaagaguaucccaccgauaauucgucacuacagaaagaccgccuauaccucuacuaccuccagaacgggcgggacauguauacaggagccccacucgacauucaccgacuaagugacuacgauauagaccacauaauacccagauccuucacaacagacaacagcaucgacaacaaagugcuagucuccagcaaggagaaucgacuaaagaaagacgauguccccagugaaaaagucguaaagaaaaugcgcuccuuuugguaugaccuauauucuucuaaacugaucucaaaacgcaaacuggacaaucucacgaaaaucaaacucacggaagaggacaaagcuggauucaucaaaaggcaguugguagagaccagacagauaaccaagcauguagccggcauccuccaccaucgcuuuaauaaagcagaagacaccaacgaccccauucgcaagguacgaaucaucacccucaagucagcacuugucucgcaauuuaggaacagauucgggauauauaaaguaagggagaucaacgaguaucaccacgcacaugacgccuaucucaacgggguagucgcccuagcccuccuaaagaaauacccacaacuagcgcccgaauuugucuacggcgaauacuuaaaauucaacgcccacaaagccaacaaagcgacagucaagaaagaguucuacuccaacauaaugaaauucuucgaauccgacacacccguaugcgacgagaacggagaaauauucugggacaaaucaaaauccaucgcccaaguaaagaaagucaucaaccaucaccacaugaacauagucaagaaaacagaaauccagaaaggcggguucucgaaagaaaccguagaaccuaagaaagauuccuccaaacugcuaccaaggaaaaacaacugggaccccgccaaauacggaggccucggcagccccaacguagcguacacagucgccuucacguacgagaaaggcaaagcucgcaaacgaaccaaugcgcuagagggaaucaccaucauggaacgggaggccuucgaacagucaccagugcuguuccugaagaacaaggguuaugaacaagccgaaaucgaaaugaaacucccgaaguacgcacucuucgaauuagagaacggacgcaagcggaugguagccucaaacaaggaagcucagaaagccaauaguuuucuccuaccggagcaccucgucacucuacuguaccacgcuaaacaauacgacgagauaucccacaaagaaucauucgacuacgucaacgaacaccacaaagaguuuucggaggucuucgcccgcguccucgaguucgcaggaaaauacacccuagccgagaaaaacaucgaaaaacuagagaaaaucuacaaagagaaccagacagacgacuuagccaaacuagcaagcucauucgugaaccucaugcaauucaaugcaaugggggcacccgcagacuucaaauucuucgacgucaccaucccacgcaagagguacaccagccuaaccgaaaucuggcaaucaacgauuauacaccaaagcauaacaggccuguacgagacccgcauacgaauggggaaauga

SEQ ID NO: 6467 - RNA, 4023 nt, Artificial Sequence
  Cas9 variant
auggagcaagaauacuaccuaggguuagacaugggcacggguuccguuggcugggcagucacagacagcgaguaccacguccuccgcaagcacggcaaagcgcucuggggaguccgucuuuucgaaucggcaagcacugcugaggagcgcagaauguuccgaaccagccgccggcgccucgaccgccgcaacuggcgcauugaaauacuccaagaaaucuucgcagaagaaaucagcaaaaaggacccaggguuuuuccucagaaugaaggaaaguaaauacuaccccgaagacaaacgagacaucaacgggaacugcccagaacuaccauacgcucuauucgucgacgacgacuucacagacaaagacuaccacaagaaauuccccacgaucuaccaucugcgaaaaaugcuaaugaacaccgaagaaacaccagacauccgcuuaguguaccuagccauccaccacaugaugaagcaccguggacacuuccuacucuccggcgacauaaaugagauuaaggaguucgggacaaccuucuccaaguuacuggaaaacauuaaaaaugaggaacucgacuggaaccuagagcuuggcaaagaagaguacgccgucguagaauccauccuaaaagacaacaugcugaacagaagcacaaagaaaaccagacugauuaaagcacugaaagcgaaaucuauaugcgaaaaagccguacuaaaccuccuagccgggggaacggugaaacugucggacaucuucggacucgaagaacugaacgagacagaacgaccgaaaaucagcuucgcggauaacggauaugaugacuacauaggcgagguagaaaacgaacugggggagcaauucuacauaaucgaaacagcgaaagccguauacgauugggcgguccuuguagaaauccuaggaaaauacacguccaucagcgaggcuaaggucgccacauaugaaaagcauaaaagcgaccugcaauuccucaagaaaaucguccggaaauaucucaccaaagaagaauacaaagauaucuucgugucaaccagcgacaagcucaaaaacuacuccgccuacauagggaugaccaaaaucaauggaaagaaagucgaccuccaguccaaacgauguuccaaggaagaguucuacgacuucaucaagaagaacguccucaagaagcuggagggccaacccgaguacgaauaucugaaagaggaacucgagcgcgaaaccuuucuccccaaacaagugaaccgggacaacggagucaucccauaccaaauccaccuauacgaacugaagaaaauauuagguaaucuccgcgauaaaaucgaccuaauaaaggaaaaugaagacaaacucguacaacucuucgaguuccguauacccuacuacguaggcccucucaacaagaucgacgacgggaaggaaggcaaguuuacaugggccgucaggaaguccaaugaaaagauauacccauggaacuucgagaaugucgucgacaucgaggcauccgccgagaaguucauacgccgcaugacgaacaaauguaccuaucucaugggggaagacguccucccuaaggacuccuuacuauacuccaaauacauggucuuaaaugaacuaaacaacguaaagcucgauggagagaaacuaagcgucgaauugaaacagcgacuauacacagacguauucugcaaguaccggaaggucacagugaaaaagauuaaaaacuacuuaaagugugaaggaaucauauccggcaacgucgaaaucaccggcauagacggugauuucaaagcgucauuaaccgcauaccacgauuucaaggaaauccucacagggacggaacucgcaaagaaagacaaggaaaauauaauuacaaacauaguccucuucggagacgacaagaaacugcugaaaaagcgauuaaaccgccuuuauccccaaaucacuccgaaccaacuaaagaagaucugcgcccugucguacacgggcugggggcgcuucuccaagaaguuccuagaagaaaucacagccccugacccagaaaccggcgagguguggaacaucauaaccgcccucugggaguccaacaacaaccuaaugcaauuacucagcaacgaauacagauucauggaggagguggagacguacaacaugggcaagcaaacaaaaacccucucauacgaaacagucgagaacauguacguauccccaagcgucaagaggcaaaucuggcaaacacuaaagaucgucaaggagcuagaaaagguaaugaaagaaucacccaaacgggucuucaucgagauggcaagagaaaaacaggagucaaaacggacggaguccagaaagaaacaacucauagaccuauacaaagcgugcaaaaacgaggagaaagacuggguuaaagaacucggggaccaggaggaacagaaacucagaagcgacaaacucuaccuauacuacacacaaaaaggacgcugcauguacagcggggagguaaucgagcugaaagaccugugggacaacaccaaauacgacaucgaucacaucuacccacagagcaaaaccauggacgacagccuaaacaaccgcgugcucguuaagaaaaaguacaacgccaucaagagcgacaaguacccacugaacgaaaacauacggcacgagcggaaggguuucuggaagucccugcuggacggaggguucauauccaaagagaaguaugagcggcucauaagaaauaccgaacucucaccggaggagcuggcgggguucaucgaacgccaaauagucgaaacaaggcagucgaccaaggccgucgcagagauccuaaagcagguauuccccgaaagcgagauuguguacgugaaagccggcacugugucacgcuucagaaaagacuucgaacuccuaaaggugcgggaggucaacgaccuucaccaugccaaagacgccuacuugaacaucgugguaggaaacuccuacuacguuaaguucacgaagaacgcuagcugguucaucaaggaaaaccccggcaggacauacaaccucaagaagauguucaccucgggguggaacaucgagcgcaauggggaggucgcaugggaggucggaaagaaaggaacgaucguaacagucaaacaaauaaugaacaaaaacaacauccugguaacccgccaaguacacgaagccaaaggcggccucuucgaccaacagauaaugaagaaaggcaaaggccagauagcgaucaaagaaacagaugaacgccuggccagcaucgagaaauacggaggcuacaacaaggcggcgggagccuacuucaugcucgucgagucgaaagauaagaaaggcaaaacgauacgaaccauugaauuuauaccacuguaccucaaaaauaaaauagagagcgacgagagcauagcgcucaacuuccuggaaaaaggacguggccucaaagaacccaaaauccuccugaagaagaucaaaaucgacacacucuucgacguggacggcuucaaaauguggcugagcggacggaccggagaccgccuacuauucaagugcgcaaaccaacugauccuagacgaaaagaucauaguaaccaugaagaaaauagucaaauucauacaaagaaggcaagagaacagggaacucaaacucuccgacaaggacggcauagacaacgagguccucauggagaucuauaacacauucguagacaaacucgaaaacaccgucuacagaauacgccugagugagcaggcaaaaacacucauagacagacaaaaagaauuugaacgacuaucccuagaagacaagucauccacgcuuuucgaaauacuacacaucuuccaaugucaaagcagcgcggcaaaccuaaaaaugauagguggaccaggaaaggccggaauccuggugaugaacaacaacauaucaaaaugcaacaaaaucuccaucauaaaccagagccccacaggcauauucgagaacgaaaucgaccuccuaaagauauga

SEQ ID NO: 6468 - RNA, 4026 nt, Artificial Sequence
  Cas9 variant
augcgcuuccagaacaagaagacaggcgacuacuucgucggacuagacaucggcaccaacucggugggcugggcaguaaccaaugaaaaauacgaaauacugcgagcaaagaaccaccgcauguggggauccagacuguucgaagaaggaaaaaccgcagaagaacgaagggugcaccgcgcaggaaggagacgccucaaccgacgaaaugaccgccuaaugauucuagaagaccuauucgccgaagagauaucuaagguggacaaagcauucuaccagaggcuucaugagagccaauaucgacaagaacauaaaacagucucagggccauacuucuuauucaaugauaaggaguucacagacgaagacuaccacaucgacuauccaacaauauaucaccuccgcgucgcccuaaugaaagccccggccaaagacgugcgacuacuuuuccucgccauacaccacaucaucaaauaccggggaaacuuccuacacgaaggcgagacauucaagacuacaggaggccucacggacauucugcagcgggugcuggccuguaacgaguucuccggacucaagcaacacauugacgacaccgcacucgugaaacucuuaacaaacaaaggcaucacccgaucggauaucgcaaagcaaaucuccgaacucgccacggacaaacucuaccggaagcaagcaaaggcuuucgcguccuuagucuuagggcucaaagccaaccuugacgaccucuucaacgagcccgaguauaaagaacuagacuccgaaauacgcaccguggaguucuccggcaaagaauacugggaagaaagagacaaauacgagcccuaucucggcgaaucauuauucgcucucgauggcugcaagacccuauacgacacccuccuccucuccaacaucaaaccugacggcaaauaucuuuccgaggccaagguagaaacauucgaaaaacaccacgagcaccuugaaucgcucaaagaccuccugaaauccaacaaagcccucuacaaccgcguccuccgcgacgacgaaaagaaucucaacaacuacaucaccuacaucgggaaauccgaauuuaauaaacgaugcagucgcgacgaguucuacaaauuccucaaacagacaaucaaggacauuuccgacaacgagaauaaagcggagaucguacagcucauggaacucgacagcuuccucccacuucuuagggugagggagaacggugucauacccuaccagauacacgaggaagaacucgaacagauucuuaacgucuccagcgagaaguaccccuuccucaauaaagcagacggcuccggguuuacaauagcucagaaaauccuuaagcuccucacuuuccgcauccccuacuucgucggaccccucaauccagcacacaaggaccgcgacaacggauucgccuggguaguucgcaaggcacccggcaaggucuacccguggaacuucgaagacaaaguugacauaucagcgagcgccaccgcauucauagaaaaucucacaaauaagugcaccuaccugauuggcgaagacguacucccgaaguauucacucgccuauagcaaauucucgcuccugaaugaacucaacaaccuccgcuacgacggaaagccccuauccuacgaaacaaaacaaucguucaucaaggacugcuuugaaaaagagcauagaaaaaugaccgaaaaacguauccgcgaguuucucaaacaccucggggguacggacggcaaaggcgcgcucacgggacuagacgucgauauaaaaagcgaccugaagucguaccgcgacaugguacgcauccucggagacggauucgacgagaccauggccgaacgcaucauccgguacgucacgcucuuuggggaggccaagaaaguccuccuauccacacucgagauagaguucggcgacgaccuguccgacacccaaaagaaacaaauacucaaacuacaauaucgcgacuggggucggcucagugcuacacuacuaaaaggaaucaaagggguugcgggcgacaaccccgagugcuccauccuagaaugcauggaacagcaaccucuaaaccucauggaagugcucucaucccacaauacguaccucgcagcuaucgaggaauuuaacaaagaaagaaccgaaccaacagacaucguggacuacaaacugguggacgaccuauacaucuccccagcagucaaacgaucaguuuggcaaacacuaaggauucuggacgaaaucacaaaacuacgagggagcguaccuaagaaagucuucguagaggucgcccgcaccaaccgagccgagaaaaagaaaacugacaguagaaaagaacgccuccuacaguuguauaaaacuauaaaagaugaaggacggaacuggacagaggagaucaaacaacgcgacgccggggacuuuaacuccaagaaacucuuccucuauuacacccagcagggccgauguauguauucgggagagaaaaucaccagcaucggagaccuauuuacaucaaaauaugauaucgaucacauauacccacgcagugucaccaaagacaacuccugggacaaccuaguccuagucaaagcagaauuaaacagagagaaaaaggacauauacccgaucgaaaaggauacccaggaccgcugcaucucccucuggaagcaacuccuugaacaaggccucaucagcgaacgcaaauacgagaggcuagugagaaccacuccccucaccgccgacgaacucgcggacuucgucaaccgacaacucguagagacgaaucagagcgucaaagccgucacgaaccugcucaagcgacucuaccccgacacgacgaucugcuacgucaaagcagaaaacgugagugacuuucggcaggagcgagaguucguaaaacuccguucucugaacgcccaucaccacgcgaaggacgccuaccugaacauugucguaggcaacgucuaccacgagaaguuuacgaauaacccccgcaacuucaucaaaaacgcaagaagcgacaagaaacggccauacagccuaaaccacauguucgacuaccuucuacagguaggcaacaaagagauauggaauccaaaaaccgacaacaaccucguaaagaaaaugaugcgcaacaaugauguacaaguaacacgaaugcucguagaacagaccggagcauuauacgacgcaaccaucuacaaagcgagcgugaccaagagcgagucauaugucccgcucaaguccucugacgcaauucucagcgacgucaagaaauacggaggcuucacaagcauaaagaucgccuacuacucaaucuuccgauuuuacaagaaaaauucagaggaguucgaaacccacaucauauccauccccguuuugaaagcgggaacccucaauaguaaggaggauuacguagcauacggggaagaaaucaugaacaaacaaaaauucgaccggguggaacucgucuauaagaagcuaugcaugaacucgcuaguucgcauaaacggcgucauguacuaccucggaggcaaaaccaacaacucuuuguacaucgacucugcaauuucccucguucucccugacaacaucgccaagaaaaucaaagccgucgaaaaauacauagcgcgaguugcggaaaacggcaacuacaaaccgcagccagaccaggucaguccggaguucaacaugauuauauacaaagcgcuaaccgagaaaaugaaacaaccagcauucgucggccuaaaaacuaacagagaaaacgaacuagaaaaagaaaccaccaucaccgccuucaucgccaugacccucaucgaacaaugcaaaaugcuaauggaaauacuaaaccuccuaacacagcagaagacaacauacgcccugaagcccauaggagucagcgccucacgcagcacucucggcaugaacaucacaggccugucugaguucacaaucauuacucagucggucacgggccuacaggaaaaagaaauccguaucauauga

SEQ ID NO: 6469 - RNA, 4026 nt, Artificial Sequence
  Cas9 variant
auguggggcucucgccuguucgaggaagcauccacagcccaggaccgucgggagcaccgcagcaaccgaaggcgucucgaaagacgaaaauacagguuggaccugcuagaagaacuguucgucgaggaaauuaauaaaauagacccagaguucuucauccggcuaagagaaagcaaguuccacuuugaagaucggucccuuaaaaacacauucauccuguucaacgacaagauggagggaggauacaacgauaaggucuucuucucuaaauacccuaccaucuaccaccuacguucagcccuaaucaacggcaacaaagaagacguccgcgccgucuucuuagcuauacacaacauucucaaaaaccgggggcauuuccuccucgcaggcaacgauaucaacaucucccugucccucaacgacacacugacagaucuguucgaauaccuaaagauccaccuaggcaucgaagucgaguucgaaaacaaacugaaagacaucgagaaaauagcccucgacaaaaaccuaucuaaauccgacaaacagaagaaaauagugcaacuccucgaaaccgacuacaaaaagcagcucgccgacguguuuaaauuaucgcucggccuuaccgccaacauggaaaacaucuucggcaaagaaaaugaacaaggccucgaguucauuaacgcagaaaacaagauaaagaaaauacaauucgacucaagcuacgaagaaaacaucgcggaguucgaccaauuuuacggagaguacuucgagauaaucgacaucugcaaaaagauauaugaugccauaucacucagccagauccucgucgacgguaaaggacuaagcgaaagcaaaguccucucuuacgaaaaacauaaagaagaccucaagcuccucaagaaaguacucaagaacaucgauaaggcuuaugauaacaaaggcgaagaccgccucgucuacaagguccuaaaggaggacaaggacaaagggaccaacuaugugaacuacagcaaacuuucuaacaaugggacagcuaccaccaaggaggaguucuacaaauucuuauccaagaaucuugaccucaagaaguucgggaaacucaacaaggaagacaucgaaacauuagauuacauuaacucggagauccuguuaggucgcuuccuaccacuccaaaaagagaagaucaacggagucauuccuuaccaacugcaaaugaaagagcugacgcagauacucaacaacgcguccaaauaccuccccuuccuaaacaaaauagaagauggcaugacaguuaaggauaaaauaauaucacugaucaaauucaggaucccauacuaugucggaccgcucaacgaauacaaccgcaucgaaaacggaaacggcuucgcauggaucgaaaagaagaaaaacgagaaaauauuccccuggaauuucaacgacgugguagacauagagaaaagcgcagaaaaguuuauaaacaaccuaaccaacaaaugcacguauauaaaagaagaaacuguccuacccaaaaacucuauuauauacucaaaguucauggugcuuaacgagcuaaacaaccuucaguacggaaacaaaaagcucgacaucgaguuaaaaaugaaaauguauacggaccuauuccuagagaagaaagacaacagaaaagugaccgaaaaacggauauuggaguauuuccgaauaaacggcaucaacgacgguaaagaaaaacucaccgggcucaacaacgaaauccacgcggacaugaaguccuaucgcgacaugugugagaucaugggagaaaacuucaacauaaacguggccgaaaacaucaucaacuggauaacggucuuccacggcgaaaagaaaauccucaucaacaaaaucaaaaauguguacggaaagauguucaacgacgagcagauaagcaagcuauccaaacuaaacuacagcgacuggggccgccuauccaaaaagcuauuaaccgacauaaagugcuacaucgacgccgacggcaucaauuucccugucagcauccuagaggccauggaagucagcaacaagaaccucauggaacuccugaguaacaaauacgaguucaucuccugcauagacgacaucaauaacaaauacuucggcgaccgcgacauaucugcgagugaauugauagacgagcucuacgucagcccugccgucaaacgaggcauuuggcagucagugcgaauccucgaggaaauuguaucaaucauaggacacaacccgaagaagaucuucaucgagaugacaagacauaacgaagaaaaaguccaaaaaucaucgcgucggcauaaccucgaggaacucuacaaagcuauccgcaaagacccggaauacguggagcugauuaaggaauuugacagcaccaccgacacagacucguuuaagaucaaaaagcucuaucuuuacuucaugcaacucggaaagugcgcguauuccaaagaaaagaucgacuucgacaaacucuucaccgacuccuacgacaucgaucacaucuacccacguucgaagaccaaggacgacagcauacacaacaaccuaguacucguuaaagcuaaauacaaccgagagaagaccgacguauauccaaucgacauaaacauacagaagaacaugaacucauucuggaacuuccucuacaccaagaaauucaucaccgaggaaaaauauaaacggcugauccgcacaucagaccuaaccgacgaagaacuagcaaaauucauaucacgccaacucguagagacaagccagucaaccaaagcaaccgcggagguucucaaacagauuuacggagacagcgacaucugcuacgucaaagcggaaaacguaagcgauuuccgcuaugggucgagccgccagaaggacaagaacgacauccaaaaacuguucgucaagugccgagaagucaaccacuuccaccaugcaaaagacgcguaccucaauaucgugguaggcaacguguacgacgucaaauucacgaagaacccagucaauuucauuaagaaaaacaaaauggguaacaaauccaacuauucacugaaccacauguuuugcuucgacguagagaggaacggcuacaaagccugggacucaucagaaacaauaaaaacugucggaagaaugaugaaaaguaacgacgugcgaaucaccaaacacguccaccccacgcgaggcgaacuuuacgacgccacgauauacaaagccaaaaucgccaagacgggaucauauaugccacuaaaaagcagcaagaacaccccacugagcgacguuacaaaguacggaggauacacuaaaauuaaaaucgccuacuauagcgucuacaaauacaaguucucggacaaaaaccuuauaaagacugaaauucgacucaucccaaucccgauauaccucuccaagaaugaugacgacaucaaggaauacgucaaaaacuaccuuaacgauagaguaaacuccaaacucaucgacuuuacaaagauauacgacaaacuuuacguuaacagcuuaauaaagaucaacggauaccuuuacuaccuagggggaaaaaccaacgaucgagucuggaucgacaacgcggucucaauagucuuagaugacaaaaucgaguaccucauuaagcguauuucaaacgauaucaaauacggguaugagaucaacguuuccgacgacgaacuaauggacauauacgagagccuggccgagaaagccaacaagaagauauucuauaaccgccucagcgacuucgaaaagaucuucucuaauauggacgucaagaaaaaguucgucaaacucgagaaaaacgauaaaugccgcguucuccuccaacuccucaacgucuugaccgacucgcaaaccacauacaaacuggaaauggucgggcugaaacacagccgcucaaacauagggaugaaaauuuccaaucuugaggaauuuaaagucaucaacucgucuaucaccggccucuacuccaacgagaucgacauccuaaacauauga

SEQ ID NO: 6470 - RNA, 4026 nt, Artificial Sequence
  Cas9 variant
auggaaaaagacuauuaccucggccucgauaugggcuccgguagcgcgggcugggccgugacggacgaccaauaccacgucuuaagggcacacggaaaggcgaugugggggacucgccuguucgaaagcgcaaacacggccgaagaacggcgaaucaaucgaaccgcacgacgacgccucaaacgcagaaaccaacgaaucgaauggcuucaagagauauucgccgaagaaaucaacaccaaagacucuggcuucuucagacgaaugaaagagagccgcuacugggcagaagauaaacgcgaugagaacggcagcugccccgagaugcccuacucccucuuuauagacgaagacuucaccgacaaggaguaucacgaaaaguucccaacgauauaccaucugcgcaaauaccucaugaccacagaggaaacaccgggcauccgguugguauaccucgcguuccaccacaugaugaaacaccggggucacuuccuucucaacgggaacauagaggagauacgcaaauuccggaagaccuucgaucaauuccucgaagucgucagaaacgaggaaaugggauuugcuggagaaaucgaagaagaaacguacaaaaagauagaaaugacccucaaagacguaaaccuaacccgcagcgcgaaaaagacuacccugauuaaaagccucaaaguaaccaggguagaagagaaggagcugcuggcacucaucagcggcugcaccgugaagcuaucaaacaucuuuaacgacaaaucccuggacgaaaccgaaagaccgaaaaucucauuugcggacgccggauucgaugacuacgaggcagagauccaaagcaaccucaacgagaaauacuacaucaucgagagugccaaggcaguauaugacugggccgcgcuggccgacauacucggcgaguacagcugcauuucggaagcaaaagucgccuuauacgaaaagcaccacaaggaucucaagcgccucaaggaucucgugcgcaauaacaucagcucugaagucuauaaagaaaucuucgucgacguuuccggcaaguacaagaauuacugcgccuacaucgggaccaccaacauaaacggcaagaagaaggacuucgaagggaagaaaugcaccaaagaggacuucuacgcauacuuaaagaaauccgucauagagugcauaaaugacucggagaaaacagacuggcucaagcucgaauuggagaagggcaacuuucuaccaaagcaacuaacgggggaaaacucggucauacccuaccaagugcaccuauacgaacucaacgccaucaucacuaaccuacaggaacgaauaccgcuuuugaagcgcgacggcgagaaaauccgccaaaucuucaccuuccgaguaccuuacuaugucggcccacugaacggcaucagcaucgauggcaaaaagacgaauuggguaaagcgaaaggaaggggugaucuauccuuggaacuucagcgacaucguagacgaagaaagcuccgcggaaucauuuauccggcggaugacgaauaagugcacguaccuuauccacgaagacgugcuacccaaguacucgcugcucuacucacgguucgagguacuaaacgaacuaaacaacgugcgccucaacggagaacuacuguccgucgaacuaaaacaaaagaucuacgaagacgucuuccaaagauauagaaaggucacgcaaaagcgccucaagagauaccuacuaacagaggggauaaucgacgaaaacacaguaaucaccggucuagacggcgacuucaaagggucacucaccgccuaccacgacuucaaagaaaaacuaacaggccuaaaccuaacagaacgggaaaaggaagaaaucauccugaacauaacccuauucggcgacgcgcgaagucugcuccgaaaacggauaggaaagauaugcucacaacucucggacaaacaaaaggagaaucuaucgaagcuguccuaccaggggugggggcgccugaguaagaaauuucucaacggcauugccauauccgugcaaggcgaggaagaauggacaaucauuaaagcccugugggagacucaggacaaccuuucacaauuaaugggcgccaaguacacauuuaggaacgcggucgagaaggaaaacggagaacuggaaaaucgugaaaucucauacgaaacuguaaaggaccuguccaucucacccagcguaaaacgccaagucuggcagagccuacuaaucguaaaggagauaugcaaaauacagaaaaagcccccuaggaagguuuucgucgaaguagcaaaggagaagacaaacucaggacgcaccgaaucacgcaagaaacgccuucaagacuucuacaaauacugcucgaaauacgagaaggagcuguacgacgaaucuauccagaacaaacuggagaaaugcucagagucggaccuacggucugacaaacuauuccucuacuacaugcaaauggguaggugcauguacacaggacagccgauugacuucgacgagcucuggaacaaucaaaaauacgacauagaccacauauacccccagucaaaaacaauggacgacucaaucgacaaucgcguccuagucaaacggauauccaaccaagagaaaacggacgucuaccccauucgggcagacauacgagaaaaacgacggggcuucuggaaagaacucaagaacgucggacucauauccgaggaaaaauacaagagacucaccagagccacagaauuugagccagccgagcuggccggcuuuaucucccgacagcuaguggaaaaccgacaaaccacaaaagugguagccagcauccuaaagcaggcuaugccggacacagaaaucgucuacgugaaagcgcgcaccgucagcgaauuucgccacaaguucaacuucaucaagguccgcgaaaugaaugacuuccaccacgcaaaggacgcuuaccugaacguagugguaggcaauaccuaccucgucaaguucacaaaguccccggucaacuucaucgaaaaccacuccaauagauccuacaaucucaagaaaauguucacggacggaagagucgaacguaacggagagauagccuggauuagcggcgagaacggcacgaucggcaccgugcgcaacauaaugaagaagaauaauaucuuggugacacgccgagcccacgaagcuacgggcggcuuuuucgaccagcaacucaugaagaaaggaaaaggacaaguccccgucaaaggaucggacgaaagacugcuggacaucgagaaauacggaggauacaacaaagaaaccggcgcauacuucguccuaguggaaucagacgaaaagaaaggaaagaagaaacgcaccaucgaauacguccccauuagacucaagaaacaacucgaaaauaacagaaaagcccucgaaaauuaccucugcgagcagcguggccugaccaacccaguagugcuaaucgacaaaauuaaaauggauagucuauuuagaguugacggcuucuucauguggcucagcgggcgcacggguaaucaacuacuauucaaaugcgccaaccaacucguccuaucaacggaagacgaggccacacucaagaaaauaguaaaauucguaaaccgacgcaaagaaaacaaagaaaucaaaauauacgaaagcgacaaacucaaugaggaaaugcucaacaggcuauacaacacauuccucuacaaauugcagaacucaaucuaugggaaccggcuaggcgaacaggccaaaacccugagcucaaagaaagaaaauuucgacaaacugcagaucgaagagaaaugucuagugcuguacgagauccuccacauguuccagugccaaagcgccacaagcgaccuccagcuaaucgaaggacccggcaaagcgggaacccuccgacuaaacucaaauaucaccaaauauaaaaacaucaacaucaucaaccaaagcccaacggguaucuacgaacagguuauagaccuccagaaaauauga

SEQ ID NO: 6471 - RNA, 4026 nt, Artificial Sequence
  Cas9 variant
auggggaagggcuacuacgucgggcuggacaugggaaccggaagcguagggugggcagucaccgacgaaucauaccagauccugagacggcacggaaaagccauguggggcguccgacucuucgaguccgccaagacagccgaagaacggaggauguucagaaccggaagacgccgccucgaccgccgcggcuggcgcauagaaauccuacaagagaucuucgccgaagaaauauccaggguggacccgggguucuuucuccgcaugaaagaauccaaauacuacccggaggauaagagagacauccaaggaaacugcccagaacuucccuacacccuauuuguggacaagacguucacugacaaggacuuucacaagaaauacccaacgaucuaccaccuccgcaaaaugcucauggagacagaagacaccccggacaugagacucgucuaccucgcgcuacaccacaugaugaaacaccguggacacuuccuacuguccggggauaucagccaggucaccgaguucaaaaauaccuucaaucaauucauagaaaauaucaggaacgaagaaauggacuucgaaauagaacuggacgaauccgcaguacaaaugaucgaggaaacgcuaaaagauaaaaaccuaacaaggagcgcgaaaaagagcaagcucguaaaggggcucaacgccaaaaacgugcgcgacaaagccuuccuaacccuucucuccggcggaaccguaaaacucuccgaccucuucggcauggaagaacuaaaugagggggaaagacccaaaauauccuucgcagacaacggauacgaagaguacgcagcggucgucgaaauggaguugggcgaguuauauuacauaguggagagcgcgaaagccgucuacgacugggcaauccuauccgacauacuaggaggcagcacgaguguuagcgacgcaaaaguaagggccuacgagaagcacaaggcagaucucaaauacuuaaaagcuguagugaaagaguacuuccccaaggaagucuauaacgccguguucguagaaucaagcgacaaguuaaacaauuacccggccuauauaggcaugaccaaaaagaauggcaagaaagugucgcucgaaggaaaaaggugcucccgagaggaauuuauggacuuccuaaagaaaaacaucgucgucaaacucccggacgaggaagcaaaaauguacuugcaaagcgaacucgaaaaagacagcuuccucccaaaacaggucaacaaagacaacggcgugauucccuaccaggugcacaaauacgaacucaaaaagauccucgacaaccugggcgacaagauaccguuccugaaggaaaacgcagaaaagaucgagaaacuguuuagcuuccgcauuccauacuacguaggcccucuccguacagguaauggggaaaacucgaaauuugcaugggcggaacgaaaaucuacagagaaaaucuaccccuggaacuucgaaaacguuauagaugucgaacaauccgccgagaacuucauccgccgaaugacaaacaaauguaccuaccuuaucggcgaagacguccuaccgaaagacucacuacucuacagcaaauucaugguacugaacgaauuaaacaacuuacgccuggacggccagaaaauuuccgucgaacuaaaacagaaaaucuaccgugacguguucugcagaagucgcaaaguaacgcaaaagaagcucaaguccuaccuaauacgcgaaggaaucgccggcaaaaauguagagcuaacgggaauagacggcgacuucaaaggcucacucacagccuaucacgacuucaaggaaaaguuaaucgacguggagcucacgcaaaaagagaaagaggagauaauccugaacauaguccucuucggcgaugacaagaagcugcucaaacagcgccucaaaaagaaguucccacaacuaacagaaaaacaaaucaacacagugacggcacugaguuauaagggcuggggaaggcucagcaagaaacuccucgaagaggugacgguaccugcaccagaaaccggcgagguguggaacauaauuacagcccuaugggagacgaacgacaacuucaugcaacuccuaagcaaagaauaccaguuuagcgaccgcaucgaagaguucaacgaagaaaaggccgaccccgaaguguccuaccagaccauagaggaccuauacguaagccccgcagucaaaaggcagauauggcaaacacuacagaucauacaagaaauugagaaagugaugggcgagaagccuaagcgcguauucgucgaaauggcacgagaaaaacaggagaacaaacggacugaaucaagaaagaaaacacuaagcgaccucuacaccaaaugcaagaaagaggaacccgaauggaucgaagcccucugcacaagccucgagaaacacgaggagcaccaacucagauccgacaaacuauaccuauacuacacgcaaaaaggccgauguauguacucgggcgaacccauagaucuggaagaccuaugggacaacacuaaauacgacaucgaccacaucuacccgcagucaaaaaccauggacgacucacugaaaaaccgcguccuagucaagaaagaauacaacgccaaaaagucagacacuuaucccaucgcagcggacauucagaagaaaaugaugccauucuggaaaagccuucuaaccggaggcuucauacccaaagaaaaauacgauagacucguacgcaacaacccccucgacgcgaacgagcuagcaggauucauagaacgccagaucguagaaacccgccaaaguaccaaggcaguggcugagauacuaaagaaaauccuaccagacacagaaauaguauacgucaaagcaaaaacaguaucgaaguuccgccaggacuucgacuucaucaaaguccgagacaugaacgaccuacaccacgccaaggacgccuaucugaacauagugguaggcaacguguacuucgugaaguuuaccaagaacgccgcgugguucguaaaagaaaacccggggcgaaccuauaaccucgaaaagauguuuauaugggacgucgcacgagauggugaaauagccuggaaggcaggcaaaagcggguccauaguacaaguccgagcaaugauggagaaaaaccacauacucgucacccggcgcagcuacgaagucaaagggggccuauucgaccagcagauccucaagaaagguaaaggacaaguacccgucaaagaaagcgaugaacgacuacgcgacaucgguaaauacggaggcuacaacaaagcggccggcguguacuuuaugcuaguaagcagcaaagacaagaaagggaaagagcaacggaccaucgaguucgugcccauauaccucaaagaucggguggaaaaagacauggaauccgcgagaaacuaccuaauggaagaacgaggccucagagaacccaaaauccugauaaagaaaaucaaaaucgauacacuguucaaaguggacggauucuacaugugguugaguggccguacgucgaaccagcuaauauucaaaggagcaaaccaacucauacuaucgaaagaggacaugaaaacccucaagaaagucgucaaauacauacagcgccaaaaagaagacaaaaacguaaaaaucagcaugcgggacggaaucaccgaggaggaacuccuaaaacuuuaugagaccuuccucgacaaaauucggcacucgaucuacggagcgcgacuguccucgcaggagaaaacccucgugaacggaaaagaaaaauucaucgauuuaagcguagaagcaaaaugccaggucuuauacgaaauucuccaccuguuccaaugccaaagcggagcugccaaucugaaaaugaucggaggccccgcaagcgccggaauccuagucaugaacaacaacauauccaagugcaagaacauaagcauagucaaccaaucgccaaccggaauauaugaaaaagagaucgaccugcugcgaguauga

SEQ ID NO: 6472 - RNA, 4026 nt, Artificial Sequence
  Cas9 variant
augacccaaaaaguuaucccauacaacauaggccuagauaucggcacgaacagugucggaugggcgguaaccgacaacgagaacaaacucuugcacaucaaaggacacaacggcauagguguccgauuauucaaagagggacaaagcgccgccgaacgcugcggauuccgaaccaccagaagacgacugucucgacggaaauggcgucuuagacugcucaacgagaucuucgcagacaaaauagcaaaaguugaccccuccuuuuucgcgcgccuaaaacaaagcaacguaagccccaaggaccccaacaaaaccauguucggaaacauccucuucgacaacggcaaccuaaacgacaagucauuucacgacgaauacaaaacgauauaccaccucagacaaucgauaaucgaccauccggaaaagaaauucgacauccgccucauauaccucgcaaugcaccacauaaucaaguauaggggccacuuccuaaaccaagcgaacguacaagacuucaaagggggaaaaaucgaccuagaagagagcuuuaaagaccucaacucaauauucgaaaaccaaggacgcgaccuucgucucguaaccgaagacgccaacaaauaugugaaggaacugucggacaacuccaagaccaggaacgaucgccagaaggagcuaucuaaaguccucuacauaccaaucgacaagaacuccgauaaaaacaacaagaaagugaccacagaaaucaucaaggcaauccuagguaugaaagccaaguucgauguaauauuuggaaucgacgccgaaaacgccaaagaguggagccuaacuuucaacagcgaugacuucgacgauaaaauagaaggucucucggcccagaugacagacgaagccggugaaauccuacuaaucuuaaaagaacucuacuuugcacucaaccuuagugacauacucaacaacagcguaacagacaaaaacgcgaaaacccuaucagaggccaugauaaaucgcuacgacgaccacaaagaacaacucaccaugcuaaaacaagucaucgauaacuccgacaagaaacacgccaaggcacucaaagcggccuacagcgccuacaucgacggcgaaaacaacaagaaaaucagcuucgaggaccucagaaaaagaauccaaaagaaucucgacaacagcgaaacguccaagaaaaucaacgaccuccucgaacacgacuauuucuugccuaagcaacgcaguaaagagaacggcgcgaucccccaccaacugcagcaacaggaacucgacaaaauaaucgaaucccaaaaacacuacuaccccuuccucgcagaacucaacccaaacgaaaagcggucacgucaggcgaaauacaagcucgacgagcuagucgccuucagggugcccuacuacgucgggcccauggucaaagcaaccgaaaacaaucaguccaacaacgguaaauucgccuggaugauuaaaaacgacaacauaucggacaaacucaagaaagaagaaaucacccccuggaacuucgacaagaaagucgaccgcacggaaaccgccaccaaauucaucacccgcaugacaacgacagauacauaccuaauaggcgaaccgguguuacccaaaaacucgcugcucuaccaaaaauucguagugcuaaacgaacuaaacaaccuaaaaaucaacaaacaacccauaacaccagagcagaaacaguaugucuacgaacacguaaugaaacagacaaaacgagucucacugaaaaagaucgcggaugcucuagugaucaaaggggacuauccauacgcccccgaaaucacaggcaccacugaccaaaagaacaugaacaacggccugagcaccuauauugaccucgcaaaaaucuucggugacgagcucgacgacaucgaccggaaagaggacuuugagaaaaucaucgaauggucaacaauauucgaagaccaacacaucuucgcccucaaacuuaaggaaauuaaauggcuaacggaggaccagaggaaacaagucgucaaacucagauaccaaggcuggggaaaacucuccaagaaacugcuagcagaccucguagacgacaacggccagaggauaaucgaccugcuaugggacucaaaacaagauuucaugcaaaucgugaaccaaaauuccuucaaacaggccauagccgaacacaacggagcucaccuugaagagaaggaccuaaaagauaucaucaacaaccucuacacaucgccacaaaacaagaaagccauccgacaaguaauccuaguuguagacgacauaauacgcgcagugggcuacgaaccggucaauaucaugauggaguucgcaagggaagauuccaaagaccaccggcucaccaacucucgaucgcgccaacuggagaaggucuacaaagacaucaccaauuccugguucgacgacgacaacgucaaggacgagcugaaggauaaaaucaaggacaaagcgaaauucacggaccggcuguaccucuacuuuacccaaggaggcaaggaccuauauacgggcgagccauuggacaucgacaacuugagcaacuaccagaucgaccauauucugccacagagcuucauacuagauaauucucucgacaaccgcgugcuaaccucgaagauaaacaaccaaaucaaaaaggacaaccuccccggcgaguucuucggaagcaagaugcacaacuuuuggaaacaccuaaaggaacuccaccuaaucagcaauaagaaauacuacaaccucacccugacccccaacagcauaucaaaauucaacaaccaaggucgcuucauaaaccgccagcuaguggaaacacgacaaguuaucaaacuugcagccgaaauccuacacaaccgcuacagugaagaaaauggaacuaacaucgucaccguaaaagccaaucucacccaccacaugcgcgagaaauucaacuucuacaaaaaccguaacgucaacgauuaccaccacgccuucgaugccuaccuagccgcauucgucgggaacuggcuccuccaacaguacccuaaacuaaaaccuuauuucguguacggcgacuuugccaagacggaaauagauaaccuaaaaucauucaaccugauauacaaguucgagcaggcccaccaacuaaaugaagaggacggcaaaauugcaaaggauaccgacgcacugcugggcuacaugaaaaacguguaccacuucaagaaaaugcuggucaccaaagaguuagaaaccaaccacggaaaccucuucaaacagacucuguacccaagccauggcaaaaugaagaaccuaaucaauccaaaggagaaccgguccuccgauauuuauggaggguacagcagcgaaacuggcgcuuacgugucacugaucaaagucuucaaaaagaacaagauagaaaacaagaucauaaaaauaccgcuucuauacauugauaaacugaaccggcaagcgaacgcaaaacaguuuauccggaacuucaucaucaaagacgacucaaacaaauucgacauacuauccgaaaagauauuccugaaccagcucgucauugacggcgacgagcuauucaccauaucuggcuccggugaccggcagaacgcccaacaacuaauucucagcgacaaaucacucaagauccucuccaagaacaucaacgucaucaguaagaacgaucucaucauaauauucaacgaaaucaucgacgacaucugcaaguauaugaagauguacgaagucgaaaacucagacgaaacaaaagccaaauucgaggaaaucaaugacaaagacagaaugcucaaaaucaucaacgaccuucucuugggccuccacgccaacgccagccgcagcaaccucagcuccaucgggcucucccccaguuucgggcgcuucuucucgggaaacgccggcaucaaacucagcgagaacgccaaguucaucuaucaaucccccacaggguuauucagccguaaaguaaagauauccgaccuguga

SEQ ID NO: 6473 - RNA, 4032 nt, Artificial Sequence
  Cas9 variant
augacauauuaccuagggcucgacauggguaccucaagcgucggaugggcagugacagacgagaacuacaaucugauacaccgccaucgcaaagaucuauggggaauacgugaguucgaagaagccaaaacggccguggaacggcgcacccaacgcaucagccgcaggcgcagacagagggaaguagccaggaucggacuacugaaggacuacuuucacgacgaaauacaaaaaguagaccccaacuucuaucagcggcucgacaacucaaaauacuuuccggaggacaaggaggaggucgucaaagguaaaaacgggaucuucgccgacgagaauuacaccgaucgagacuacuucgcggaguacccaaccauauuccaccuccgacgagaacuacuuaauagcaaggaaccgcacgaugugcgacugcucuaucuggcccuacucaauauguacaaacacagaggacacuucuuaaacaccacgcucggaaccgauggcgagaaccgcaaacuaagugacguguacagagacuucguaguaaaaacagaggaaguacuaggccugaccuucccacaggagaccgauaacggaaaaaugcaagaaaucaugugcagccgggaguucucccgcaagcggaaagcugaacuacuaugcgcccuccuggaaauagacaagaagcagaagcaacaaguagcacucaucgaaugcguauuaggacuagacaagagcgucaagcaaauguacggaacggcgguaccggaugacuucgacaaguccgucaagguaaacuucucggacucgagcuucgaagaaaaaguaagcgaaguagaagaacugcucgacgaagaaaaguacgagcuaauccuaugcaugaaggaguuguacgacaccgccguauuaaaccagauaaugggagacugcaacuaccuaucagaagcacgaguccaggaauacgaaaaacauaaggaggaccuaaagcuacugaagcgaaccgucaagaaauacgggacggccgaggaauaccaguuccuguuccgcucaagugagaaagcgucauacaacgccuacguccacuccgugaacaguggcgagaaaaucagaagaaacauggacggccggagccgggacgacuuauacacaguacucaagaagaugcucaaaaauuacccgcaagaagacgcagauugcaaauauauccuugaagaaauagagaaagagcaauuccugcccaagcaacucgucagcgacaacggggugauacccaaccagauucacuacaaagagaugaaaaagauacuggagaacgcagaacaguaccuucacuuccuucgcgaaaaagacgagucggguuacacgguagccgaacgcauacucaaacucuucgccuuccaaaucccguacuacauaggaccgacaagcgaaaagucuggcaaaaacggcgggaacggauggguggucaggaaagaacagggccaggugcuacccuggaacaucgaagaaaagaucgacaugaaggccaccuccgaaacguucauaucgcgaauggugcgccgcugcaccuaccucagcgacgaaauggugcucccuaaagcaagccucgaguacgaaucguuuugcguacugaacgaacugaacaaccuaagaauuagaggggucaagcucccgaucaccgucaaacaagacaucuacaaagaccuguucgagaggggaaagcgggugacucggaagcagaucgugaacuaccucaaaggcguaggaauacugcaagagggagaagaagacgagcugaccgguaugauggacacguucaacucgagccuagccucguacgggaaauuuaaaucaauccuaggagagaagauacaagaggacucgugcaagcggauggucgagcaaauaauuuucugguguaccaucuauggggacgccaagaaguuccuaaaagagcagcucgaagaaaaguauggcgaugucuuaacccgggaacaaaucaaacgaauacuaggguucaaacugaaggacuggggcaaccugagcaagaaauuccucgaacuaaacgggugcgauagaaauaccggagaagugaugucacucauacgaaugcugugggaaagcgaugacaaucuaauggagcuacucaaagacaguucauacacauaccgggcggagcucgaggaacagcaggagaaacuaacaaaaacccucacggagaucuguccggaagaccuugagggauacuauuucucggcacccgucaagaggaugauauggcagacgcuccuaauccucaaggaaguggaaaaaguaaugggcgagccgcccaaaagaguauucgucgagaugacacgggagcacgacgagcgcagagagaugaaagacagccggggaaagaaauuccaggaacuauacaaaaacaucaaagacgaggaacauaacuggaaggccgaaaucgaggacgcggagaaagauggccgcauaaggagcaagaaaauguaccuauaucuaacacagcgcggccggugcauguacacgggaaacccaaucgaccuggaggaacucuucacaacuaaauacgacauagaccauaucuacccacgucacuucgugaaagacgacaaccuagacaacaaucucguacucguagaaaaagagaagaacgcccacaaaagcgaccaauaccccuugggagacgacauauacaccggucgacucucgugguggaaggaacugcaccgagagaaacuaaucaacgacgaaaaauacaagcgacugacagggagagccccauucagcgacgaacaaaaggccggguucauagcucggcaguugguggagacgagucaaggaacaaaaggaguagccaguauauugaaagagguacuaccggaaacaaccacaaucguguaugcaaaagcccgcaacguaagcgacuuccgaaacaccaacgaacugcucaaagcacggagcgucaacgacuuccaucacgcccaagacgcguaccugaacaucguaguaggaaacgucuauuacgucaaauucacgaacaacccacucaacuuuguuaggucaggcgagggauacaaucuggacggagucuucaggaagaacgugauccgaggccaggagaaugcguggaucgugaagccggagaagggagagaaaaugacgcucgaaacaguaaaacgaguaauggcuaaaaacacaccacugcugacccgacuuagcuucgagggcagaggagggcuggccaaccaaacacuauauucagccaaggaagcggcgggagaaggguacgucccccucaaauccucggacucacgacuacaagauguaaccaaauacggcggcuucacuagcguuacaaccgcuuacuucauccuaguggagcacgacaugaaaaagaaacgcguacgcacaaucgagucagugcccauauuauggaaagagcggaucgaaaaagagucaggacagcuagaaauauacugcagagaagcauuaggccucgucaaucccgacaucagaguacgaaagauacugauacaaagccuuguaaagaaggacggguuuuacaugcaccuaucagguaagaccggcaacagauucauaaugcgaaacgcgguagaacucugccuaaagcaggaauggaucaacuacagcaagaaacucgagaaagaggggugcgacgaaaguauaacgaaagagaaaaaugaagaacucuaugaaauacucaaggaaaagcauaucaacgggauauacagaaaaagacccaaccccaugggagaaaaacuacacauaagacaggaaacguuccgaaugcugacacuggaagaacagaagaaaguccugcugagccuccucaaccucacaaagaucggccccgucgaagcuaaucucgaacuuauaggggaaagcgcgcacaccggcaaaaugcugaucuccaaaaacaucaccgaggucaaagaguucuacuuaauccaccagucugugacuggaaucuacgaaaaacaaguaaacuuacugacagucuga

SEQ ID NO: 6474 - RNA, 4032 nt, Artificial Sequence
  Cas9 variant
auggccaccaagaaagaauacaacauaggccucgacaucggaaccacuucgguggguuggagcgucguagaaaccgacaaucaaaaagugaugagaaaaggcaauaaggcacuauggggaguccgacucuuugaagaagccacaaccgccgaaucaaggcgaaugcagcgaucaacacgccgccguuacgaccgacgccgggagcgcauaaaacuccuacaggaggaauuuucggaagagaucaacaagguagacaaaaacuucuuccaaaaacucaaggaauccaaauacguagaaaaugauaagaucaacaaaaagaucguccugacaaaggaagaaaagcaagaacucaaggacuaccagaacaaguacaagacuaucuaucaccuccgagaugaacugauaaacaauccagagaaaaaggacauacggcuggucuaccuggcuauacaccacaucauaaaauacagagggaacuuccucuaccaaaacgccaacuucaauauagacaaccuagacaucaaggacaaacucaacgaacucuucucgauccugucaaacaacauucaagaacucgaaauacccgaggacuacauuaacaucauagacuucgacgaacuagaagcggaucugcucaaggacaccaaaaaugaugugaaggcucuccuuaucgacaacuugacagaacuaacaaacaagagcagugcgaccgaguucgggaagcugaugguaggaaacaaaggcaacaucaauaaacuccuaaugcuagaaacagacaacaaaaucgagauuucguucagcggcacagacuacgacgauaaauacgaggaguaccaggaagcacugggggagaacaucgaaauccuagauauacucaaacaaauauacgacugcaucuuccucaagaaaaucuucaaaggcaacaaaaacacauccauauccagccuaauggucaagucguucgaacagcacaaaaaggaccugaacuuccugaaggaacucuucaaagauaaccgcgaacucuacaacgaaaucuuucguacaaagaaagaucuuugccucuacgagaaguacauaacaaacaagauagacugugaugaguuccggaaggaaauaaacaaacuacuagagagucuauucucggacgaaaacauaaaacagaaccuccuagacgaauacaaucuagagguuaaggagcgaauagagaauggcacuuuucugccccgaauaacgaccacagacaacggcaaguacccuuaccaauugaacaaaagugagcuaauaaagaucaucgagaaucagggcaaauacuauccguuccuccucaacaaacucaacgauaacaagaccuacaaaaucguaaagcuauuagaguuccguauaccauacuacgucggcccccucguuuccgaaaagcggagcgaaaacucaugguuggaacgaaaaauaaacaacgucaaaauaacaccauacaacuucgacgacgucguugauaaggaaaagaccgcggaaaaguucaucaaacggaugauaucccauugcacuuaucuccuggacgaauacgcacuagcaaacaacagcauccucuacagcgaguucaaggucaugaacgaacucaagcaaauccgggugaacgaccgaaaguuggaacucaaauuccagcaacaaauccuugaagacuucuucaaaaagacuagcggaaccaucaccgaacggaaauucaagaacuaccucauaucaaccggagaauauagcauggaaggcggcaacuuuagaauaacuggcuacuccgccgacggaaaguucgcgaauaacaugcagagcuacgucgacuucuucggcgaaaacgguauuuuugccgacaccgacuacaaccuagagaaugccgaagagaucaucgaauggauaaccaucuuugaagacaaagacauccucgaaaagaaagucagggacaacuacagcaaacuaaacgagaaucagaucaagaaaguacuagccaaaaaguacagcggcugggggucacucucgaaaaagcugcucaaaacaaaauacuacaaggacaaggcaaccgaacucuacaaguccauccucgaccucauguacgaaaccgacaaaaacuuuaugcagaucauaaacgacgacaaauacaacuuucaagaaaugaucaaaaaguucaacaauaaagaagaaaacaagaaacucaauuacagcauagucgaggaacuagcaacaucgccggcaaccaaacgaggcaucuaucaggcacucaaaguugucgaggagcuaguugacuacauaggcuacgaacccaaaaacaucucaaucgaaauggcgcgcuccgaagaggagaaaguccggaaagacagucgaaaagacuacauuaacaaccuauacaaagguugcaaagacucgaucgaaaacuauaaaaagcucaaacaugagcuugacagucacgaaauaacuagccagcgccucuuccucuacuucauccaagaaggcaaaugucuguacaccgggacaccacuuaacaucgaagacaucgaaaaccagucacuguacgaaaucgaccacaucauuccccgcagccucaucaaagacgacagcauagacaacaaagccuuaguacugaaagaaugcaaccaggacaagaaagccaguuacgugcuccccuccaaauuucgaaacagcaaacagaagaccugguggaaacaccucaaagacaacggacucaugagcgcaaagaaguuucacaaucuaaucagggaaaaauacaaugaagaggauaucaauggcuucauaaacagacaacucguugagacaaggcaaaucaccaagcacguggccaacauucuaaacaaccuauacaaggacacaaacguaaucuaccucaaagcagaccucucgcacaacuacagagaaaaguacgaccuauuuaaauucagagacaucaaugacuaccaccacgcacacgaugcauaccucgcagccguccuaggcgaauauaaagagcgcuucaugaaaagaaagaucaauuucgacauggucaaggagcucaacuccaaaauuguagaaauggacgagggcaaacgcagaaaccuccgguucggcuacgugaucaauucacuagacgagaaucucaacgacauaguccugaaaauuagcgaaaaccucgucgacaaugaaaccggcgaaguacuguucgaugcgcacgaauuuaacaaacgcgucgaggacacccuauaccgaaaugacauccuaaucuccagaaaaacggagauacgcaccggacaauucuacaaggaaaccauauacaagaaaggaaaagggacuauucccaucaaauucgguaugccaaccgauauauacggaggcuacucaaacaccaacgcccgaaaacucaugcugauagaguacaacgaaucgaaaaugaaaaucauagggcucccaauggcccucgcagucagaaacaacgacgcggaaaucaacgacuauaucaaaacccagauaaacuugaagaaaaacuccaccuucaaaaucaaaaagugcuccaucccguucgagacagagaucauauacaacaaccagaacgucuucauaaaaggguacagcauaggccauaagaacugcgaaaucucaaaugccauccagcucaaaaucgccaaagacaagaugaaacacuggaaauacgcccuacaauaccuccucaacgacaagaaacaauacaucgacuucgcagagaaauacgugaaugaaauuuacgauuuccugauaaaccucgaccuauucccccuuuucaauaaagaacucgacaagaucaagaacaaggugaacuucgaagaccuggcccuggaucagcaaaagaagaucaccaaggaacuguucaaaaugcuccacugcaacuccguuaacgccaaccucagugaauuuggacucggugaccggaugggcaggcucucaggguacaauauaacagacggcaucaucaucucaaaaagcguaacugguauccgcgaaagccgcuacgaguucuga

SEQ ID NO: 6475 - RNA, 4035 nt, Artificial Sequence
  Cas9 variant
augagccaaaauaacaacaagaucuacaacaucggcuuggacauaggggacgccucagucggcugggccgucguugacgaacacuacaaccuguuaaagagacacggcaagcacaugugggggucaagacuguucacgcaggcaaacacagccgucgagcgacguucuagccgaagcacccgucggcgcuacaacaagaggcgcgagcgaauccguuugcuacgagaaauaauggaagacaugguucucgauguggaccccaccuucuucauaaggcuagcgaacguaucauucuuggaccaagaggacaaaaaagacuauuuaaaggaaaacuaccacagcaacuacaaccucuuuaucgacaaagauuucaacgacaagacauacuacgacaaauaccccacuaucuaccaucugcgcaaacaccugugcgaaucgaaagaaaaagaagauccacgacugaucuaccuagcacuacaucacauagucaaguaccggggcaacuuccucuaugaaggccaaaaguucuccauggacgucucgaacaucgaagacaaaaugaucgacgugcuccgccaauuuaacgaaauuaaccuguucgaauauguagaggaccgcaagaaaaucgaugaagugcucaacgucuuaaaagaaccccuuuccaagaagcacaaagccgaaaaggcguucgcccuauuugacaccacgaaagacaacaaagccgcauauaaggagcuuugcgccgcccucgccggcaacaaguucaacgucacaaaaaugcuuaaggaggccgagcuccacgacgaagacgaaaaggacaucuccuuuaaauucuccgacgcuacauuugaugacgccuucgucgaaaagcaaccccucuuaggcgacugcguggaguucaucgaccuacuccacgacaucuacucguggguagagcuccaaaacauccucggcuccgcgcacaccagcgagcccagcaucagcgcagccaugauccaacgcuacgaagaccacaagaacgaucucaaacuauuaaaagacgucauacgcaaauaccucccuaaaaaguacuucgaaguguuucgcgacgaaaaguccaaaaagaacaacuacuguaacuacaucaaccacccaucaaaaaccccggucgacgaauuuuacaaauacauaaaaaaacuaaucgagaaaaucgacgacccggacguaaagacuauacucaacaaaaucgaacuggaaucauucaugcuaaagcaaaacucccgcacaaacggggcaguuccauaccagaugcaacuagacgaacucaacaagauccuagagaaccaauccgucuauuacuccgaccuaaaagacaacgaagacaaaauccgcucaauacuuacauucaggauacccuacuacuucgguccccuuaacaucacaaaagaccggcaguucgacuggaucaucaaaaaggaaggcaaagaaaacgagaggauucucccauggaacgcaaacgaaauagucgacgucgacaagacagccgaugaguucauaaaacgaaugagaaacuucugcacguacuucccugaugagcccguaauggcaaagaacucacuuaccgucucgaaauacgagguccucaacgaaauaaacaagcuccgcauaaacgaccaucuuauaaaaagggacaugaaagacaagaugcuacacacccucuucauggaccacaaaagcaucucagcaaacgccaugaaaaaauggcuagucaagaaccaauauuucucaaacacggacgacaucaaaauagaaggcuuccagaaagaaaacgccuguucaacgagccuaacccccuggaucgacuucacaaaaaucuucggcaagaucaaugaguccaacuacgacuucauagaaaagaucaucuacgaugugacagucuucgaggacaagaagauccugcgccggagacugaaaaaagaauacgaccucgaugaggaaaaaauaaaaaagauucuaaaacucaaauacuccggcuggagccgacuuucgaagaaacugcucuccggaauaaagacgaaguacaaagacuccacccggacgcccgaaacgguguuagaggugauggagcgcaccaacaugaacuugaugcaaguaauaaacgacgaaaaauuaggauucaagaaaacgaucgacgacgccaauaguaccuccgucagcgggaaauucagcuacgcagaaguccaagagcuagcaggauccccggccauaaaacgcggcaucuggcaagcccuacuaaucguggaugaaaucaagaagaucaugaaacacgagcccgcccacguauacauagaauucgccaggaacgaggaugagaaagaacgcaaagacucauucguaaaccagaugcuaaaacucuauaaagacuacgacuuugaagacgagacagagaaagaagcgaacaaacaccuuaagggagaagacgccaaauccaagauacgaagcgaaaggcuaaagcuauacuacacacaaauggggaagugcauguacacaggcaaaucccucgauaucgaccgacucgauaccuaucaggucgaccacauagucccccagagccucuugaaagacgacagcaucgacaacaaaguacucgugcuguccucggagaaccaacgaaaacuugacgaccuagugauacccucaaguauccggaacaaaauguauggguucugggaaaaguuguucaacaacaaaaucauaucgccaaagaaauuuuacucccuaauaaagacagaguucaacgaaaaagaccaggaacgcuucauaaauaggcaaaucguagagacaagacaaaucaccaagcacguggcccaaaucaucgacaaccacuacgaaaauacgaaaguggugacggugcgggcggauuuaucacaucaguucagggagcgcuaccacauauacaaaaaccgggacaucaacgacuuccaccacgcacaugacgccuauaucgccaccauacucggcacguacaucggccaccgguuugagagccuggacgccaaauacaucuacggagaguacaaaagaaucuuccgaaaccaaaaaaacaaaggaaaagagaugaaaaaaaacaacgacggauuuauucucaacagcaugagaaacauauaugccgacaaagauacgggcgagauaguuugggacccaaacuacauagaccgcaucaaaaaaugcuucuacuauaaagauugcuucgucacaaagaaacucgaagaaaacaacggcacauucuucaacgugacuguccucccaaacgacaccaacagcgacaaggacaacacccuggcuaccgucccggucaacaaauaccgaagcaacguuaacaaguauggcggauuuucgggcgucaacucguucauaguggcaauaaaggguaaaaaaaagaaaggaaaaaaaguuauagaggucaacaagcuuacgggcaucccccuuauguacaaaaacgccgacgaagaaaucaagaucaacuaccucaaacaagccgaagaucuugaagaagugcaaaucgggaaggaaauucuaaagaaccagcuaauagagaaagacggcggguuauacuacaucguagcuccgaccgaaauaaucaacgccaaacaacucauacucaacgagucacaaaccaaacuaguuugcgaaauuuacaaagcaaugaaguacaaaaacuacgacaaucuagauagcgagaaaaucauagaucucuaccgacuacucauaaauaaaauggagcuguauuaccccgaguacaggaaacaacugguaaagaaguucgaagaccgcuacgaacaacucaaagucaucagcauagaagaaaaaugcaacaucaucaaacaaauccuggcaacccuacacugcaacucguccaucggaaaaauuauguacuccgacuuuaaaauaagcacaaccauaggccgacucaacgggcgcaccauaagccucgacgacaucagcuucaucgcagaauccccaaccggcauguacuccaaaaaauacaaguuauga

SEQ ID NO: 6476 - RNA, 4035 nt, Artificial Sequence
  Cas9 variant
augaaaaagacaaacccguacauacuuucacucgacauaggaaccgcgagcaucggcuacgccugcauggaccuagacuucaacauccugaaauaccacgauaaggacgcaauagggguacucacauucgaaggcgcggacacagccgcagaaagacguggauuccgaacaucucgaagacggaaaaaccgacguaucaaaaggcuuggucugcuccaagagguccucgcaccccuagugaagaacccaaacuacuaccaacugcuuaaucuacacaaauggaaaaauagcaacgaagacuucaaacaucgcagucuaucagaagucuugaaaauccucgguaaaaacccaaaaacauaccccacaauauaccaccuccagcaggacauccagaaccacccggagaagaaauuugagccagagcucaucuuucucgcgcucuaccaccuagucaaguaccgcggacacuuccuauucaacaaccugucauuugacaaaggcaagacagucgacaacgaagcacaacucagcgaacuccuggaacaguaccaaucaauaaaccccuacgaagacucaauaucuaacaaggacauaaacgucaucgucgacacgcuaaaagacgaccaacucacacgaaacgacaaaucgaaggagcucaagcgcaacguaucgaaaacacacgcggagcuguucaaaaugcucgucgggcuaaaguuuaaacaaagcauccuauucgagaacauggaaaaugcagaagacauaaaagagagcgccaccggauccgacgccaucagccuaagcgacgacuauuacgaaaaucuaagcgaguuccucacagacgaacagcugaacuucauagaaagcgcaaacaccuucuuuaugggcaucaugcucgaccgcauccuuaaaggcgcaacauccaucagugcggccaaggugcgcgacuacaaaaucuucaaaaaccaacucaaaaucaucaaagacauagucuaccaaaacaaguacgacaaguaccacgaguucuucgucacauccaaagaagacaugcgagccuaccaagaaaaccccgacgcaaaaacguucggcaaacugagcaaauucgaccaauaucucauccaucccaaagaccaauaugcuaaacuaaugaaggaccucaaaggcaucgugcccaagaaauacaccgaaguacuuaaccuaauagacgaacaaaaauuccucgugguccaaaacacgacugacaaugccagcauaccauaucaaaacaacgucuucgaagccgaaaacauacuccgcaaccaacaaaaauacuaccccgagaucaccgaagaaaugauuggcaaaguaaucaaccucaucuccuuccgcauacccuacuacguaggcccccugaccaacaaaaacggccaguccgacuuugcauggaugauacgcaaguccgacgaacaaacccuucccuggaacuucgacaaagucauagacaagucgaaauccgccgagaaauucauccggaggaugacgagcaaaugcacauaccugcuagaagaggauguacuuccuaaacauucccuccucuaccaagagauggaagugcucaacgagcucaacaacguccagcuccggggcgaaaacgaaccaaaacaucgcauacacagauuggaucccaaaguuaagcaauucauuuaccacaaccuguuccagaagaagaaaaacguaacccacaaagaccucaucacacuccuacagaacagcgaacaccgcaacacccucaacaagacaagcggccaaaaacuaaaaguauucggcacccaaaacgacagcaaguucgcguccaaacuauccacauacaaugacaugaaggccauauucggcagugucgaaaacaagcgacaaaugaucgaggagcuaguacucuggauuacgauauucgaagacaaagcaauacucaagcagaaaaucggagagaaauacccgaacaucaccgaaaagcaacucaaccagauaguaaagcuaaacuacagcggcugggggcgccucagcgaaaaauuacuaaccaaagaaguuaacggcagaagccuaaucgaccucauguacagcaccgaaaacaacuucauggagauaauuacggacaaaacacucggauucgacuguuucauuaaaaacagcaacaagguaaagaacgcaaaaaucuccuacaaagacgucgcugaauuacgcaccagcccggcacuaaagaagggcaucuggaacgccaucaagauggugcgggaaaucucagaccucuucggcgcgcccgaaaagaucauaauagaguucgccacagaagaccaggucaaagggaagcgacaaaaaucccggucagaauuaugggacgaccuagucaaaaagaacaaccuaaagcgcaacaagaaauucaaaggacuuuucgaagaacuuaaggcauaucccgauuuagauuucagcaaccccaaauugugguuauacauccaucagaacggcaaaugcauguacaccaagaaaccaaucgaccucgaacgacucauguccgacaccaacaaucaacucuaugaaaucgaccauauccuaccgcgcacguucgucaaagacgauucuauuaacaacaaaguacuggucauucaguccgcgaaucagaaaaagucaggcgauaaaaugccucucgaaauuuucgacaaccacgugcucguccccuucuggaagaugcuguacgagaacgaccucauaagcagcuccaaacucuccaagcugaugaagaaagaguucaaugaccucgacaaagaaggauucauccaaagacaacuggucgaaacccggcagauaauaucccacgugagcgacuuccugacugaagaauaccccuccaccacaguagugcccaugaaagcgaacgucgucucggaacucaggcggaaauucgacaucccaaaaauccgccagcucaacgauuggcaccacgcaguggaugccuaccugaacggcuucgucuaccaggcagcgcguguauucuaucccaaggucaacuuguucgaguucaacuucaaaugggagaaagugcgggaaaaauggcgccagcucggcgaguucaccgagaauaacaagaaaagggaguucuuucuauuuaaacgcauggaaaacuacguaaacgaacacggggaggguaugauaagcaaacuaaucuucgaccucgacaauuucaaauucaacuauucccgcaaaguggaaucuacagaguccgcuuucuacaagcagagcgcguucucccccaaaaacaccacagcccaauaugacagcgacaaaaacaaaaccgcaaucuacaaagaaaugaagaacaaacgaggcauaguagucucguacaccuacguuaagaaggaucaggagcuuaucggcuacggggucuucaaugaaacgguuuucgaguaugucaauaacgcggacgucgacaugaacacgcgcgcccuaaaaaucguccgcaaagccuucccaaaacucgauauaaagaaagcucaauaccucuucagcauaaacaaaggugacgcccuccugguaaacgggcacccauuccuauucgucagcgccaaagaacgcaucaacggcaaacaacuagaguucgacauaaauaugcaacggcgccucaaaaaggcacuacgcccauauaacaaaaugaccgaacaggaaaaaguaggggucuacaaccaauuugcagaaaaaguuguccaagaauacgaaaacucacuaggggccaaaacacggaacgagaaacuagagcucauacggaaccaauucaacgaguccgauaagucaaacgaagcacucauccaaugcauccuagaagugcuuaaaaugacaaagguaucggcggagcgcucaguaaaacugaagauccgguggggcucccagaccccaaacacgcugaucgacaucaacaacaaggcgaaaauaauguacaacuccaucaccggucuaaaacaaacucgccuaaaaagcauauacaaauuagcugaguccaaaaacgaacuuuga

SEQ ID NO: 6477 - RNA, 4035 nt, Artificial Sequence
  Cas9 variant
augaacaagaacuacuacaucggccuagacaugggcacaaacaguguuggaugggccgucacagaccaagaauacaaccucaucaaacucaagggaacacaugcauggggagcccguaucuuccaagaagcuaaagauaagaaaggcaccagagccauaagaucaagucgacgacgaauggacagacgcaaguaccgcauccaccuccucaaccagcuauuugcccaagagauccaagccaucgauucuacguucuuuauaagacuagcuuacagugcuuauugggaagucgacaagaaagacaaaggcauaggacgcaacauccuuuuuaagacaaaacaggaagaaucccaguucuacaaaaaguacccaacgauauggcaucugcgcaagagccuccucgaaaaccagccugaugcuuucucggacuugcgguacgucuacuuagccuuccaccacaucaugaaguaccgaggaaacuuccuccacgaaggcgaaauaaagaccaacgagcuccaaguacagcagaucgaacaacugaaucaguuccugaucaacaaauacaaggaaaucuacgacaacgacgucgaggagcgcaccuucauagccaaccaccaaaucgacgcacuaaaagagauccuccucaacaagaacacaaacaaaacuacaaaggaaaaggaaaucaagaaacucuucgauuaugccgacugcgaaucccucgagcccuauaucuccugcuucagcaaauuggcagucggcgguaaauucgacuugucaaagcucggauacgaaggcaacauacaguucagcgacccauccuucgaagaaaaagcaagcauccuccaagacgacuuccgcuuaaucgcaauagcaaaagaaauguacgacuucgucauucuaaacgaccuccuaaaagaccaacccaaccucuccacugcgaugguccacgucuacgagacgcaccgccaagaccucaaaaagcucaaagacaucaucauagacauagacgcaaacaaaggacugcaaaauaaugaccguugguacuucaaacuuuucaaggacaaaaacgccccgaagaacuauuccgccuuuauucacaaaaacucgaaccagaaacgacccucaaucgacgaauuuaacgacgagauaaagaagauccucauagaacaccguaacgacguaucacuagaaaaacaagacgaucuuaagaugcuauucgaaaaggucgaaaacaaaacccuccucaaaacgauugccauucaaagcacuuccgucauaccccaccaacuacaccuggacgagcucgagaaaauuaucgauaacgccaguaccaaauaccccuuccuauccaacaucagggauaaacuuguccuccucuuuaccuuucgagugccuuacuauuacgggccccugaacgacaaaucuccauacagcaacgucgaacggaagcaauucgccacgguuacgcccuggaauuucgaugaaaucuuugacgaaaacaaaaccagggaaaaguuuaugaagaaacucaccaacaacugcaccuaccugaguggagaaacuguaaugccuaagaaggcucucgccuacgaagacuaccuuauauacgaccgacucaacguacuccucguaaacggagaauaccucagccuacaggaaaaggaaaagaucuaccacuaccucaucagccgccccaaaacuacgcuagaccaacuuaagaaagaacuagccaaauggcacaaccaaagccccaucgacauuauauucagcaacauacacgaagaaauaccauucgaagcguccagccacgcccaccugaugaaaaguuucgaccucgaaaaacagaaagaagaacuggaacgcuauaucaccuuagcaacaauauacgcggacgacaaaaagagccuaaaagagcuacucaagaaugaaagccuccucgacgaaaaccaaaagaacgugauccucacccuaccuacaaagaaaugggcgccccuaucauacaaacuacuccagaacaucguauauaccgacgacuacggugucguccauucaauacuagacaucaugaaagaaaccaaccaaaacuuccagaugguauuacauaacgagcaguaccauuuuaaagagcuaauugaacaagaaaaccaaaaguucacccaagagaaaaccaucgaggaccucauagaagaaaaacucgagucuaucccuagccuuacacaaagaucaauccgccagacacugcugaucauagacgacauaaucaaagccagccaccagaagguccccgagaaaaucuucauugagguaacaagaaacaacgacgacaaacgaaaaggccaagacgguaaccaacucgcucgugauaaggaacuaaacagauuucucaccaaccugcugaaagacgaaaaagcaaaucaauucugcgauguaucacaacuacugaaggaccucgaagaagucgacaaggucaagcuaaaaggcaagcacaucuaccucuacuucaagcaacuuggcaucgaccuguacacaggcaagaaaauaguacuaaaccagcuccuaacgagcaccaaauacgacacggaucauaucaucccacagucccucaucaaagacgacucucucgacaaccuuguccuaguagaaagggaagucaaucuuaaagugaagggcaaccacuaccccgucccuagucggauacaagacgagcagaaaaagcucuggcacuuucuccugcagaaaaaggcuauaucagaaaagaaauauggcaacuugacccggaccucaaaaaucaagcucgaggaaguagaagacuucgucgcccgccaaaucaacgucaucaacuacucgaacgucaucauucgcgauauucuaaaacucaaguacccgcacacagauauaaucuucucuaagucacaauacccguccuucauacgcaagcaccuaaaaaucguaaagaaucgagacgucaacgacgcacaucacgcggucgacgcauaucuaaacguugugucaggcaacuuacugaguaccaccuucuccaaagcauacauacgcaagaaauacauccaaauacaagacggggagaaagaaaccuucaacauggaaaccauacucgagaacuacuucaaaaacaacgagaaccaacucaagauaaaaacuaacugccugcgacgggacgcccuaaucaccuucaaagucgacuacuucaguggagaguucuauggucagacccgccucccaaagggcaaugagaaccucauucccaucacauuaaacgaggauaaccccauguccgacaccuccaaguacggcgguuacacuaaccucgcucaagccuaucucuucgcugucucuuaccaagaagacggggaaaugaagaaagccauacuccgggucccuuaccucuacgacacgcuuuacaaaaaugacucugacaaacuacucucaaaaguacucgacaacccuaaagcgaccaauauccaaauccugcgcaaaauacaucugaaccagaagauccgcuucaacgacggcaucuaccuccucuacacgaaugagaaagaccgcaacaaauauaaaauggcauaccagaacuacauagacaaugacuaccuuuacuaccuacacugggccaacaagcaccuggaggaacuccucgauaaccaagaaaaacagaccuuuauuuacaacuccaagaacgaccaauucgagguaucgaaagccaagaauaaagagaucuuccaauaccuacuccagaaaacaaaagcaaaggucuacgacacaugcaauuacauaguaaaagcccgugagaccaacauagagaucuucgaacaacucacacucaaagaacagaucaccaugaucaaucaauggaucaaaaugaugucacgagacugugaaaaaguaaaauucgacgcacguuuuacgaauuucuccaacugccuccuccgccuaucaaauaacaucaaccccaaggacagcaucacaaucaucuaugaauccccaaccggacucuucaaacaugaagucaaaaucuga

SEQ ID NO: 6478 - RNA, 4035 nt, Artificial Sequence
  Cas9 variant
augaaaaagacaaacccguacauccucagccuggacaucggcaccgcuuccaucggcuacgcaugcauggaccuagauuucaacauacugaaauaccacgauaaagaugccauaggcguauuaacauucgaaggugccgacaccgcggcagagcggcggggauuccgcacuucccgccggcggaaaaaccggcgcauaaaacgccucggguugcuccaagaaguccucgcaccccuagugaaaaaccccaacuacuaccagcuucucaaccuccacaaguggaaaaacagcaaugaggacuucaaacaccgcucgcucucugaggugcucaaaacccuggggaaaaaccccaaaacuuacccgacaaucuaccaccuccaacaggacauccaaaaccacccagagaagaaauucgaaccagaacucaucuuccuggcccuauaccaccuagucaaauaccggggccacuuccucuucaacaauuuguccuucgauaagggaaaaaccguggacaacgaggcacaacucucagagcuucucgaacaguaucaaucaaucaacccguaugaaggcuccaucuucaacaaagacaucaaagugauaguggacacacugaaggacgaucagcugacacgcaacgacaaaagcaaagaacucaaacgcaacgugagcaaaacacacgccgaacucuucaagaugcuagucggccucaaauucaagcaaagcauccucuucgaaaauauggaaaacgucgaagacauaaaagaaagcgcgacaggcucggacgcgaucagccuguccgacgacuacuaugaaaaccucagcgaguuucucaccgacgaacaacuaaacuucauugaauccgccaacaccuucuuuaugggaauaaugcucgacagaauccuaaagggagccaccucgaucagcgcagccaaaguaagagacuacaagaucuuuaaaaaccaauugaagcugaucaaggacauaguguaccaaaacaaauacgacaaauaccacgaguucuucgucaccagcaaggaagacaugcgagcuuaccaagaaaaccccgacgccaaaaccuuuggaaaacucuccaaauucgaucaguaccugauccaccccaaagaccaguacgcuaagcuaaugaaagaccucaaaggcaucguacccaagaaauauacagaaguucuuaaccucaucgacgaacagaaauuccucguuguucaaaacaccaccgacaaugcaucaaucccuuaccaaaauaacgucuucgaagcugaaaacauccuacgcaaccagcaaaaauacuacccagagaucaccgaagagaugaucggcaaagucaucaaccucauuagcuuucgcaucccuuacuauguaggccccuuaacuaacaagaacgggcagagcgauuucgcauggaugauccguaagucagaugaacaagcccugccauggaacuucgacaaagucauagacaaauccaagagcgcagaaaaguucauacggagaaugacguccaaaugcacuuaccuccuugaggaagacguacugcccaaacacucccuauuauaucaagagauggagguccuaaacgagcucaacaacguccagcuacgaggcgaaaaugagcccaaacaccguauacaccgccuugacccgaaagucaaacaauucauauaccacaaucuauuccagaaaaagaaaaacgucacacacaaagaucucaucacacuccuccaaaacucagagcaccgcaacacgcuaaacaaaacaagugggcaaaaauuaaagguguuuggcacacaaaacgacucuaaguucgccuccaagcugucaacauacaacgacaugaaagccaucuucggcuccguggaaaauaaacgccaaaugaucgaagaacucgugcugugggucacaauauucgaagacaaagcaauccucaagcaaaagauaggcgagaaauaccccaacaucacagaaaaacaacucaaccagaucgucaaguuaaacuacucgggcuggggccgccuuuccgagaagcuccucacaaaagaaguaaacggucgcucacugauagaccuuauguacucaacagagaacaacuucauggaaauaauaacugacaaaacccucggauucgauugcuucaucaaaaacucaaacaaagugaaaaacgccaaaaucuccuacaaggacguggccgagcuacgcaccucccccgcucugaagaaaggaauauggaacgcaauaaaaaugguccgcgaaaucuccaaccuauucggagcgcccgagaaaaucauaauagaguucgccaccgaagaccaagucaaaggcaaacgccagaaaagccgcuccgaacucugggacgaccucguuaagaaaaacaaucucaaacgaaacaaggaguucaaaggcuuauuugaagaaaucaaagcauacccugaccucgauuucagcaacccgaaacuguggcucuacauccaccaaaacggcaaaugcauguacaccaaaaagccgauugaccuagaaagacuccuuucagacacaaacaaccaacuuuaugaaaucgaccacauucuaccucgcacguucgugaaagacgacucaauaaauaacaaaguacugguaauccaauccgccaaccagaagaaaucaggcgacaaaaugccgcuugagaucuucgacaaucacguccuagucccguucuggaagaugcuauacgaaaacgaccuuaucucauccuccaaacucucuaaacuaaugaaaaaggaauuuaacgaccucgacaaagaaggcuucauccagcgccagcuagucgaaacccgccaaaucauaucacacgucagcgacuuccucacagaggaguaccccagcacaacggucgugccaaugaaagccaacgucgugagcgaacuacggcgcaaauuugacauccccaaaauccgccagcuuaacgacuggcaccaugcagucgaugcauaccuuaacggcuuugucuaucaagcagcccgagucuucuaccccaaagucaaccuguucgaguucaacuucaagugggaaaaaguccgcgaaaaauggcggcaacucggggaguucacggaaaacaacaagaaacgcgaguucuuccuguucaagaggauggaaaacuacguaaacgaacacggcgaaggaaugaucuccaaguuaaucuucgaccuagacaauuuuaaguucaacuauucccggaaaguggaaagcacggaaucggccuuuuacaagcaaucggccuuuucgcccaaaaacacgacagcccaauacgacucagacaaaaacaaaacagcuauuuacaaggagaugaaaaauaaacggggcaucgucguaagcuacaccuauguuaagaaagaccaagagcuaaucgguuacggcgucuucaacgaaaccgucuuugaguacgucaacaacgcagauguagacaugaacacgcgugcccuaaagaucguacgcaaagcauucccaaagcuagauaucaagaagguccaauaccuauuuuccaucaacaagggcgacacauuacucguuaacgggcacccguuucuguucguuuccgcuuacgagcguaucaacgguaagcaacucgaguucgauaucgccaugcaacgaaaaaucaagcaggcacuuaguccuuacaauaacaugaccgaacaagaaaaaguggaguucuacaaccaauucgccgaaaaaguuaucgaagaguuuagaaacaguauuggacuccagucccgcgaccggaaaguaaaccuaaucaaaaaccuuuucaacaacacugaaaaauccaacgacucuaugacacagucuauccuggaaguccucaaaaugaccaaagucagcgcggaacguagcaaggaacugaagauccgguggaacggccagacgccaaacacauucaucgacaccaaaaacaacgcagaaauucaauacaagucgaucaccggccucaaaaccacgaaaccuaagagcauauucaaacuugccgaguccaagaaugaacucuga

SEQ ID NO: 6479 - RNA, 4038 nt, Artificial Sequence
  Cas9 variant
augaagaaaccuuacucgaucggccucgacaucggaacaaacagcgucggaugggccguugucacagacgacuacaaagugccagcaaagaaaaugaaaguccucggcaacaccgacaaaucacacaucaaaaagaaccugcugggcgcccuccuauucgauucaggcaacacggcagaggaccgacggcugaaacgaacagcccgacgccgauacacccgacgaaggaauagaauacuguaccugcaagagaucuucucugaagaaaugggaaaggucgacgacuccuucuuccaucggcuagaagacucguuccuggugacggaggacaagcguggcgaacgacacccaauuuucggaaacuuagaagaggaagugaaauaccacgaaaauuuccccaccauauaucaucugcgacaauaucucgccgacaaucccgaaaagaccgaccuccgacucguauaccuggcacuagcgcacaucaucaaauucggcggccacuuucucaucgaaggcaaguucgacacccgaaacaaugaugugcaacgucucuuccaggaguuccucgcagucuacgacaacacauucgagaacucaucccuacaagaacaaaacguucaggucgaagagauccuaaccgacaagaucagcaagucagccaagaaggaccggguacuaaaacucuucccuaaugagaaguccaauggccgauucgcagaguuccugaaacucaucguaggcaaccaagccgacuucaagaaacacuucgaauuagaagaaaaagcaccccuccaauucucuaaagacauauaugaagaagaacuagaaguccucuuagcccaaaucggggacaacuacgccgaacucuuccuaucagccaagaaacuguacgauucaauccuuuuauccggaauauuaacagucacugacguauccaccaaagcaccgcuaagcgcaagcaugauacaacgauacaacgaacaccaaauggaccuagcucagcucaaacaauucauacgucagaagcuaagcgacaaauacaacgaaguauucucagacgucagcaaagacggauaugcaggcuacauagacggaaagacgaaccaagaggcauucuacaaauaccucaaaggacugcuaaacaaaauagaaggcagcggguacuuccuagacaagauagaacgcgaagauuuccuacgaaaacaacgcacguucgacaauggaaguaucccccaccaaauacaccuacaggaaaugcgggcuauaauccggcgacaggccgaauuuuaccccuuccucgccgacaaccaggaccgcaucgagaaaaucuuaaccuucagaauaccauacuacgugggccccuuggcacggggcaaauccgacuucgccuggcuauccagaaaaagcgcggauaaaaucacgccguggaacuucgacgaaauaguggacaaggagagcucaguagaagccuucaucaaccgcaugaccaacuacgaccuguaccuccccaaccagaagguccuccccaaacacucacuucucuacgagaaauucacgguguacaacgaacucaccaaagucaaguacaaaaccgaacagggcaagacagcuuucuucgacgcaaacaugaaacaagaaaucuucgauggagucuucaaagucuaucguaagguuacaaaggauaaguugauggacuuccuggagaaggaguucgacgaguuccggaucguagaccuaaccggacuagacaaggaaaacaaagccuucaaugccuccuacggcaccuaccacgaucuacggaagauccuggauaaggacuuccucgacaacuccaagaacgagaaaauucuggaagacaucguccugacccucacgcuuuucgaagacagagaaaugauccgcaaacgcuugaaaaacuacuccgacuuacugacgaaggaacagcucaaaaagcuagaacgccgacacuacacgggcugggggcggcuaagcgcagaacugauccacggcaucagaaacaaagagucacgcaaaaccauccucgacuaccucaucgacgauggcaacucaaaucggaacuucaugcagcuaaucaacgacgacgcacuuagcuucaaagaagaaauugccaaggcccaagucaucggcgagacggauaaccugaaucaggucguauccgacaucgcggguucccccgcuaucaagaaagggauccuccaaucccucaaaaucguagacgagcucgugaagauaaugggacaccaacccgagaacaucguaguggaaauggcaagagagaaccaguucaccaaccaaggcagaagaaacucucaacaacgacucaagggccuaaccgacuccaucaaagaguucggaagccagauccucaaggaacacccuguagaaaacagccaacuccagaacgaccgccuauuccuguacuaccuccagaacggccgagacauguauacaggcgaagaacuggacaucgauuaucucucccaguacgacaucgaucacaucauuccccaggccuucauaaaagacaacucaaucgauaacaggguccucaccucgucaaaggaaaacaggggcaagucggacgauguccccucgaagaacguaguaagaaaaaugaaaagcuauuggagcaaacuccucucagcgaaacucaucacgcaacgaaaauucgauaaccucacaaaagcugaacguggcgggcucaccgacgacgacaaagccggguucauaaagcgccaacucguggagacccgccaaaucacgaagcacguugccagaauacuugacgagcgauuucacacggaaacagacgagaacaacaagaaaauccggcaagucaaaaucgucacgcugaagaguaaccuagucagcaauuuccgcaaagaauuugagcucuacaagguacgcgagaucaacgauuaccaccacgcucacgacgcauaccugaacgcagucaucggcaaagcacuccugggggucuacccccagcuggaacccgaguucgucuacggagacuacccacacuuccacggccacaaggaaaacaaggccaccgccaagaaauucuucuauagcaacauaaugaacuucuuuaaaaaggacgacguccgcacagacaagaauggggaaauuauauggaagaaagacgaacacaucucaaacauaaagaaagugcuaagcuacccacaaguuaacaucgugaaaaaggucgaggaacaaacggguggcuucucaaaagaaagcauacugcccaagggaaauuccgacaaacucaucccucggaaaacaaagaaauuuuauugggacaccaagaaauauggaggguuugacagccccaucgucgcauauaguauccuagugaucgccgauaucgagaaagggaaaaguaagaaacuuaaaaccgucaaagcgcuugucggcguaacaaucauggagaagaugacauucgagcgagacccugucgcguuccuagaacgcaagggauaccgaaacguacaggaagagaacaucaucaagcuacccaaauacucacuguucaagcucgaaaacgggcgcaaacgccugcuagccagcgcccgcgagcuucagaaaggcaaugagauaguucucccaaaccaccuagggacacuccucuaccacgccaaaaacauacauaaagucgacgagcccaagcaccucgacuacguagacaagcauaaagacgaauuuaaagaacuacuagacguggucuccaauuucuccaagaaauacacccucgcagaaggaaacuuagagaaaauuaaagaacuguacgcacaaaacaauggcgaagaccugaaagaacuugcguccucguucaucaaucuccucaccuucacugcaauuggggcacccgcaaccuucaaauucuucgacaagaacauagaccggaaacgauacacaucuaccacagaaauccugaacgccacccucauacaccaauccauaacuggccuguacgaaacccgaaucgaccucuccaaacugggaggcgacuga

SEQ ID NO: 6480 - RNA, 4038 nt, Artificial Sequence
  Cas9 variant
auggagaauuacaacauuggccuggacaucggcacaacaucagucggaugggcgguaguaaacgacgccaccaacaaagugaugcgaaagggcgggaaggcgcuuuggggaguccgucucuucgaccccgccgucacagccgaagaccgacgcgcuaaacgagggacgcggcgccgauacgacagacgccgagagcgaauaaagcuacugcaggaugaguucaaggacgagaucaauaaagucgacuccaacuucuuucuaaaacucgaagaaaguaaauacaccuccaaagacaucaaaaauaaaacggucuuaauaucgauggaggaagaaaaagcaauaaagaaauacaaccaagaauaccccaccauuuaccauuuacgccagaaacuaaugaacuccaaugaacagauggacauccgccucguauaucucgccauacaccacauuaucaaguaccguggaaacuucaucuacgaggguaacuccuucuccgucaauaaccucaacaucgauaacaaacucaaagagaucuuccugucccuauccgaagacgucgacgaacuggacaucagcgaggaauguaucaauaacaucaacuacaaacaauuagccaacaucuucaacgagcagagcaaaaacgaccuaaaagucaagcucaccagcgaacucaccuccuauucucuuaacaaaaacuucauaucggaguucugcaaacucaucauagggaacaaauucucagcaaagaaacucuucaaccucgagaccgacaacgacgucucacucuccuucgacggcaccgauuucgaggauaaggcaggcgaccucgaaagccuccucaacgacuaccucgagguccucgagcagcucaaggaacuuuacgacaugguauucuugaagaaaaucuucgggggauccaaagaaacaaccaucucuggccuaauggucgagcgauacaaccagcacaaaaaggaccugaaacugcuaaaggacaccuucuccagcgaucggaaaauauacaauaaaauauuuagaagcaagaaagacaucaaagacgacaaagacaugugccucuaugaucucuacauacacaacaaacuugaaacuacggacuuccugaaagaaaucaagaaguacguaaacacggacaauuucauaauaaccgacgaagacuuccucaagcgccuggaaaauaaugagguccucccccgcaucacgucaaaagagaacggcaaauacccauaccaacucaacaaggacgaacugguaucaauaauagagcaccaaggcaaacacuacccguuccuucugaacaaaaccgacgacggcauauacaagcuggugagguuacuagaguuccggauacccuacuucgucggaccccuaguaagcaaggacauguccgaaaaugccuggaugcuccggaacgaaggaaugcaaggaguccacaucacaccauauaacuuuaaaaagguaauuaaucuggauaagaccgccgaaauauucaucaaaagaaugaucagccacugcacauaccuccucgacgaagaagcucuccccaauaacagcauccuauacucggaguucaagguacucaaugaacuuaaacagaucaaaguuaauggagaacaccuaacuaaggacgaacaacacaaaaucaucgaagaacucuucaugaaaacguccggcacaaucacggaaaacaaauuccgggaguuccugcucaacacccuggacuauaacuucuaugaaaacgaguuaaagauaaccggauacagugccgacugcaaauucgccaacaacaugcagucauacauagacuucuucggcgaaaacggcauauucgagggcaccagcuacaacacgaaugacgccgagaaaaucaucgaauggauuacgauauucgacgacaaagacauccuaaaacgaaaagucgagaacgaguacccugaacuaaagagcaaccaagucaaaaacauccucaauaagaaauacuccggcuggggacgacucagcaggaaacuucugcuagaccugcgcguguuggauaaggaaaccgacaucccaaaaaguauaauggaucucauguacgagacagacgaaaacuucaugcagaucaucaacaacgauaaguacaacuuccagaagcuaauugcgaaggaaaauaaaauagagaacacauccaacgaccucuccuacgacgucgucgaaaaccuggccacaagcccggccacaaagcgaggcauauaucaggccuuaaaagucgucaaggaaauaaccacauacaugggcuacgagccaaagaacaucaugguagaaauggcucgcggcgacgaaaagaaaauccgaaaagacgacaggaagaaauaucugcaaaaacucuacgacaacaucaaagacgagguagacucaaacuacaaaaaccucaagaaagagcuagccaaagaagagaaaauagauaccgacaaguuguaccuauacuaccugcaagagggcaaaugcuuauauuguggaaagccaaucaacguagacgaucucaacaccaaaaacagucuguacgagaucgaccauauacucccacgcacauuaaucaaagauaacucaugggacaaccgcguacugguaugccgcggcugcaaccagaagaaggcugccucacucguacuucccaaagaguuccgaaaugacuacaccaaaaguauuuggauacgccugaagaauaacaagcucaugucgaauaagaaauucuacaaucuaacccgcaagagcuauuccgaagaggauaucaaaggcuucaucaaccgacagcuaguggaaacgagacagaucacaaaacauguugcaaacauccuaaacugcuuuuaccccaaaacaaaaauuguauaccucaaggccaacaucucccacaguuacagggacaaauaugaccuauucaaguuccgagauaucaacgacuaccaccaugcccacgacgccuacuuagccgcaacacuaggauccuaucaagaaaaguaccugcauuacgaccucgacuacaacaagaucaaugaauuuaacgaaaaacucauuaagaaugaagacuacaaacgccuccacuacggcauagucgucaacucucucgacgaagaguuccaaagcgcuuucgcagaaaucgcaccccgccuuauaaacgaagaaacaggggagcuccucuucaacgccaagaaauucaaugaucugguagaagauacccuauaccgaaacgauauccuaaucucacgaaaaaccgagauccgcaccgggaaguuauacaaggaaacgaucuacaagcgagggaaagggaacaucaaaauuaaggaaaacaugcccacggaaacguacgguggguacuccaauauggaaacgucauaccugacccucgucaaguaugggaacaaaacgaagcuaauagggauccccaugagcaucgcaaacaacaaagacgucaaagucaaacuagacuucaucaaagaacaccuagaccugaaaagccucgauaacaucguuauacugaaagacaacaucccauacgacgucuccauaaacuacaaaaaccaggaugucuacgucaaaggauacagcaccgccaauaaaaacugugaacucucgaacgcucaccaauuaaaaauaaagaaagacaugaugaaaaagugcaaguacguacucaacaagguauauaagaacaaauacgacgacaucaccaacauggauauagaaaacgccauaacauucaucaacuaccuauucgaaauaaagauagaguucccccuauuuagcaaggagauaacaaaaauucaagacaacaucaaccuuaccgaguguucauucgaacaacucgccaacaucaucaagcaacuauugauaauauaccacugcaacagcaagaacggcaaccuaaaagaguucgggcucuccgaucgcaucggacgccuaucuggcgcgaacgugacgggcggagacuucauauuuacguccguaacgggacugaaagagaaaacagcuagcuacgacggcgaauga

SEQ ID NO: 6481 - RNA, 4038 nt, Artificial Sequence
  Cas9 variant
auggucgaaaaguacggaauuggccucgacauagguacaagcacacucggcuggacaucugucgacgaaaacggaaagauccaacgguuaaaaggccaaacagcccuaggcacccggcuauucaacgaaggacagacugccgaggagcgccggggauuccggaccacacgccgaagaauacaacgccgccgcuggcgacugcgccuccucagggaaaucuucgacgaaccaaucggauccgucgacgcaggauucuucgcccgccagaaaauguccucacuaucaccccaagacgacagguucgaagacaccuaucgcuuauucaacaaccaaaccgacaaagcguuccacgacgaguaccccacaacauaccaccuucggcaagcacuaaugaacuccgaccgccaauucgacauaagagaaaucuaccucgcgauacaccauaucgucaaguaucgaggaaacuuccuucgaucgggaaaaccagcagacuucaaaaccggcaagcucgaccucaaggaaaaauuugaagaaauaaacgcagacuggcaaacacuuaucucagaagaugcgccccaacucccaguagacgacuuaacgacaauaaaggccguacugguugacggaagccgcucacgauccgaccgacaacgcgggcugguuaaacuguggauggcaaacgagaccgucgagaaaaacuggaagccuguuaugacagaacucgccaaggccauucucggacuuaaaaccaagcucuaccucuugacagggcuagacuuaccaaaagaagaccagaaagcauggacauucucccucgacacccucgaagaccaccagggcgacaucgacucguucuucgacgaucacgcccaacaacuaaucgacagacuugcagaacugcgugcaaugauacaacucaccgagauuaucccuagcggacuaaacuucucccaaagcaugguccaacguuacgaggcacaccgcucacaccucgaaauguacaaacaguacgcacucgaccaaacugaucccaagcguaccaaggcacuccgcgccgccuacaacgcuuauauugaucaacacgaaauugccgacgacuucuacacagccguaaaacguguaaccaaagacgaccaauccgagacggcagaagaaaucaacaggcugaucgguuuagaacaguucaugccaaaacaacgaacaaaagaaaacggagucaucccauaccaaguccaucagcaagaacucgaucaaauaauagcacaucaaaagaaauacuaucccuucuugggcacggaaaaccccgugauagaccaccgcgagucacaacccuacaugcucgacgaacucgucagcuuucgaguacccuacuacguggggccaauggucgccgcaaacccugaacuaaaaacuaccgaaaaccccuucgccuggaugauacgcaaagcacaaggcgagauaacgccauggaauuuugacgaaaaaguagaccggaaagggucagccacagcuuucaucgagcgcaugaaaacuacggacaccuaucuacuaggggaggacguacuuccccagcaaucacugcucuaccaacgguucaugguucugaacgagcucaacaauauacguaucgacgacgaacuccugacgaccaaccaaaaacaaugggucuucgaccgagucuucaaaggcaaaggcacaauuucggcaaaacaccuucaagacgcacucaaacaccauggcgagacugacggacuaccgaaaaucuccggccuggccgauccaacgaaauucaauuccgcccuaacguccuaccgugacuuccagaaguggcuacccaaugacaucgaccgaaaagaccgcacagcagacaucgagacgauaauaaacuggucaacagucuuugaagacacccauauauucguggagaaacuaaaagaaauagaguggcucacagcagaucagcgcagacgaauagcgagcaaccgcuaccgcggcuggggacgccucagcaaacaucuccuaacggaaaucaaagacgaacagggucucucaauaauggaucagcucuggagaacccagcacaacuucaugcaaauaguccaugaacccgacuaugcaaagcagauagaagcagccaacacggugggcauggccaaacaagacaucgggaccgucaucaacgaccuauacaccaguccucaaaauaagaaagccauacgccaggugcucgcagucgucaaagacauccaaaacgcacaccacggcgucgcucccucuuggaucuucauggaagccgcacggggcgccgaccagaacccccaaagaucccgccagcgccaacgacagcuccaagaccuuuacgcuaagaccgcggccgaccuuguagacacugagguucaacaagaauugacagacaaaauaaaggacaaagcaaacuucaccgaccgacucaugcuguacuuccuucaaaacggccaagacauguacucuaaggagaagcugaacaucgacagacuuagcgaauacgacauagaccacauccucccgcaagcccuaaucaaagaugacucccucgacaaccgcguacucgugcaccaaucgaucaaccguaacaaauccgacaccuuugcaagcgaaaaauacggcgcaaaaaugcagggcgcuuggcaccaguggagagccgcagggcucaucucagcgagaaaacuaagaaaucuagaaaugcgaccggacgaaauaucaaaauaugccacgggcuucauucguagacagcuaguagaaacucgccaagucaucaagcucgucaccgaaauccuaucccaccaguacaacccugaagagacgaagcugguuucaguaaaggccggccucucccacgaacuccgacgcgaagcaggacugcccaagcugcgagacuugaacgacuaccaccacgcgaucgacgccuaccucgcagcccgaaucgggacauaucuccuaaagcgcuacccgcgccucgaaagauucuucguuuaugggcaauuccagaccucaagacucgaccuuagaagguuuaacuuuauccacgaccuugucaaaucaaagcaaggaguaauagucgauucugacaccggagaaauccugugggaccgccaaaaggauaucgauuacauaaagcacuuaaugggucuuaagcaccuucuuguaacacacgaaguguacgacucugccgccgaaauguacgcacagacaauauucaaggccagcgacaacgacuccaaaguucugauacccaccaagaacgaucggcccacagcaauuuacggcggauacacaaaacgccgaaacggcuaccucgcaauacuaaaaaucacggagaaaaaggccgaaacauaccggguaguuggaguacccacccucuacaugagccaacuggcuacagcacgcagccacagcguggaggccgagaaagcccuacuaaaaucccucauggccccagaaauucucucugaaucgaaaguugucuccuucgaaguagucguaagucacguacaucucaaucagcugguccgcgacaccgucuuuggaccagcacacuacuucggacucggccccuuccgcuacguuagaaauuuccaccaacucguccucccuuucaaggaucaagaaauucugguaaaacgcacacccaccgacgaggaacuaaacaccgucuucgaagacaucugcuggcaggucgaaaacuacuucgccgucuucgacauaaacggguuccgcaaugcacuuaagaaaucaaucgacaaauucgaacaacuccccaucgaaaauguuuucaaagauaaaaagcuagucacgcaaggcaagaaagaaguuuuagccuuuguaaugcaaggacugcacgccaaugcaaguuaccgaaaccuaaaagucagccuuggaaucaaaacaccucuggggcaauuacaacucacuaaauucaugcuaucacgagaugcugaacuuauugacgagaguccaaccggccucuucagacgaauccgccgcuugaaagaccuuuga

SEQ ID NO: 6482 - RNA, 4038 nt, Artificial Sequence
  Cas9 variant
augggcaacaagcuccgcaacguggacgacuacuaucuggggcuugacauaggaaccgaaagcgucggcugggccgucacagauaaauacuacgucauaccgaaguuuaaaggcaacgccauguggggaguacaucuauucgacgaaggagaaacaagcgugaaacgacgagguuuccgcagcgcccgcagacggacgcaacgcaaacgcgaacgccucgcacuccucgaagcccucuucgacgaagagaucugcaagaaagacugcacauucuucaggagacuacaugaaucggaccuguggcccgaagacaaaaguggcgacgauaaauacgcaguauucgccgacgaaaacuacaccgacaaagacuuucacaaggaguauccuacgauauaccaccuccguuaugagcuaaucaagaauaaggagccgcacgacguaaaauugguguuccucgcacuacaccacauaaucaagaaccgcggccacuuccuuuucgacucccucagcagcgcagaagacuucaacagugcuuacgagacaaugugcagcuaccugucagacaacgagauccagcucaacugcuccgacaucgagcaauucaaggcaaucuuaaaagacagacgccaagggaaaauagagaaaacgaaaaaccucgcaucacuguucggaauaaccaagaaaagcgauccagugagcuacgcaguaauggcaguccucucaggcagcaccgugaaaaugugugaccucuucggugacgacgaacuaaaaacgguugagaaaaacaauaucagcuucgccagcggcuacgaagagaaugaagaaaucuacgccucaguauugggcgaccgcuucgaacucgucaagauacucaaggcagucuacgacugggcagucuuagcagauauacucgacggcaaaaaguacauauccgaagcaaagguagcgguauaugaaaaacacaaaaacgaccucaaaacccugaagaaauaugucaaaacauaccuuccagagaaauauaacgaaaucuuuaagauaucagacggcaagaaggacaauuacgucgcguacagcgggcacaucaaagagagcgggaagaccggggaacuaaagaagaccugcaacagcgagaacuucugugcauaccuaaagaagaccuuggggaagaacgccgaccuguccuacaaggaaauguucgacgagaucgagaacaaaacauucaugcccaaacaagucaccaagagcaacggcguaguuccaaugcagguaaacgaagaagaacuuaaagccauauuagacaacgcaaaagacuaccucuccuuuuuaaacuccugcgacgagaacggagucucgguguacgacaagauaaucaaaaucuucgaauaucggauccccuacuauguuggaccccucaauacgcacacggaaaacuccuggcucaaacgcaaggacggcgucaaaaucuacccguggaacuucgacgacgucgucgacauagacucauccgcagaaaaauucaucaacaaccucaccuccaagugcacauaccugccggaaugcgauguaaucccaaaaugcagucuacucuacucgaaauucacagugcugaacgagauaaacaaccuaaaacucaacggcgaggauauccccguggaacugaagcaggggaucuauaaagaccuuuuuaugacucgccgcaagguaaccgucaaacagauaaaggacuaccucaaggcacgcggcugcuacgacaacaacgacguacucagcgggaucgacacgaccgugaaaucgucucucaaguccuacuuugacuuuaaaggcuuugaaagccuuaccuuugacgacaaagaauccauaaucgcaaguuccguuaucuucggcgacgacaaaaagcuccugaagaaacgccucaagaaacuauucccagagaaacugaccgacgaagacaucaagaaaauuugcaaacuuaaauacaccgggugguccagacucuccaaagaguuccucugcgacgucgaguucaccuacaagaagaccggcgaagucaugaacguaaucacagcccuuugggagaccaacuacaaccucaugcaaauccucuacuccgaagauuucugcugcgauggggacgagaaaaagaaccucaacgacaaacucgacgaacuauccuacaccggagaccagcacucacuccgcaaggcgguugacgcccuauaugugagccccaaaguaaaacgccccauccuacgagcacuucuuaucgccaaagagaucgagaagauccaagaaagaccgcccaaaaagaucuucguugaaguggcacgcgguaucgacaaccgagaagaacgucaccgugauuccagaaagaaccgccuaauggaacuguauaagaacugcaagaaagaagcggaaaaauucugucccuacuucgacgcacucuccaagaaacuauccgacgaagaugagucaaaacuccgacgcgacaaacucuacuucuacuacauacaguugggcaaaugcauguacacaggcgaagaaauaagccucggagagcugaugaacggcaacggccgcuucgacaucgaucacaucuacccccgcagcaaaauaaaagacgacagccugaccaacaaaguacugguaaacaaaacugucaacaacaacaagacgaaugucuaccccaucgacgccgcaauucagagcaaaaugagucccuacuggcaaaugcugcgcuccucaggguuaaucucugaagaaacauacaaacggcucacacgaaaaacaccccucaccgacgacgaacuauccgcauucgucucacggcagcucaccgaaacccaacaauccacaaaagccgucgcccacauacuagaacagcuauaccccaagcccaagaccgaaaucgucuacguaaaagcagcgcuaguacacgcauuccgccagaguaacgacaugcucaaaugccgcgaagucaacgaccuacaucaugcaaaagacgcauaccucaacaucgugguagguaacgccuauaacguaaaagucacccacaacaaagucaacuucaucaagggccuccaaaacaacgacaagggcuacacgguaaaucccgagaaauucuucagccacgacauacccggggcguggucagucaaggacuccaugaauacaguccgaagauuuaugaauaagaacaacauccgcuacacccgauucccgaggaaaaagcaagggggccucuucaaaauaaauccguuaaagaaagggaauggccaggucccccugaaagccagcggagccagaucaugcauagagaaauacggcggcuacgacaaagcaaccagugccuauuuuagcuacguagaauacacggacaaaaaggggaaagcaguccgccaaauguuccccguaaaccuauaugaaguaaaagaguacgaagcagauaugcaaggauucguaacaucacgaaucgcggaagccucaaacgugaaaauccucauaccaugcguaaaguacgacgcaugcaucagcuucgaugggugccgcauguucauaacuaagaaaacuggaaauagaauaggcuacaaaccugggaugcagcucguccuaggguacaaguacgaaaaauacauccgcaacauagaaaacuaccuaaccaaacauaaagacagagaaauaaucccgcgagacaacaucuccgcugaagagaacauagaacucuacgacauccucacugggaaaaugcuaaacaccguacuaagcgucaaauucuccgggauagggaagaaacucgaaaaacggcgagaaaaguucguacuaugcagcccugaagaacaaugcugcguccugaacgaaauccucaaaauccuccacgcgaacguccuauccggagaccucucguuaaucggagagucgcccaacacaggcacaaugaaaacgaaugcaaaguucucugaaauaaaagaugugcacagcaucaagcucaucaaccaguccguaacgggccucuucgagcaagaaaucgaccuccucaaauga

SEQ ID NO: 6483 - RNA, 4038 nt, Artificial Sequence
  Cas9 variant
augggcaaacccuacuccauugggcucgacauaggcacaaacucaguaggcugggccgucguuacagacgacuacaaaguuccagccaagaaaaugaaaguacucggcaacacggacaaacaauccauuaagaaaaaccucuuaggcgcccuacuguucgacaguggagaaacagccgaggccacacgauuaaaacggacggcucgcagacgguacaccaggcgaaagaacagacucagauaccuccaagaaaucuuuacaggcgaaaugaacaaaguagacgagaacuucuuucaacgauuagaugacuccuuccugguagacgaagacaagcgcggcgagcaccacccgauauucggcaauauagcggccgaagucaaauaccacgacgacuucccaaccaucuaccaccuccgccgacaccuggccgacaccuccaagaaggcggaccuucgccucguauaccuugcgcucgcgcacaugaucaaauucaggggacacuuccuauacgaaggagaccugaaagccgagaacaccgacgugcaggcucuuuuuaaagauuucgucgaagaauacgacaagaccaucgaagaaucucaucucagcgaaaucaccgucgaugcccuaucaauccuuaccgaaaaggucucuaaauccucccgccuagagaacuugaucgcccacuacccgacggaaaagaaaaauacccuauucggaaaccuaauagcgcucagccucgaucuccacccaaacuuuaaaaccaacuuucaacuaagugaagacgcgaaacuucaauucuccaaagacaccuacgaggaagaccuagaaggguuccucggcgagguaggagaugaauacgcggaucuauucgcuuccgccaaaaaccucuacgacgccauacugcucagcggcauccuaaccguggacgacaauagcacaaaagcaccccuuucggccuccauggucaagcgcuacgaggagcaccaaaaagaccuaaagaaacucaaagauuucaucaaagugaacgcccccgaccaguacaacgccaucuucaaagacaaaaacaagaaaggauaugccuccuacauagaguccggcguaaaacaagacgaguucuacaaauaccucaaaggcauacuccuuaaaaucaauggcagcggcgacuuccuagauaaaauugacagagaagacuuccuccgaaaacaacguacguucgacaauggguccauaccccaccaaauccaccuccaagaaaugcacgccauccuacgccgccaaggcgagcauuaccccuuccucaaagagaaccaggauaaaaucgagaaaauccugacguucagaaucccauacuacgugggaccccuagcacgaaagggaucacgauucgcaugggcagaauacaaggcggacgagaaaauaacgccguggaacuucgacgacauccucgacaaagaaaaauccgcagaaaaauuuaucacccgaaugacucuaaacgaccucuaccuaccugaagaaaaagugcuccccaaacacuccccauuauacgaagcguucaccguauacaacgagcugaccaaggucaaauacguaaacgagcagggcgaggccaaauucuucgauaccaacaugaaacaggagaucuucgaccauguuuucaaagaaaaccggaaagucacaaaagauaagcuacuaaacuaccugaacaaagaauuugaagaguucaggaucguaaaccucacaggccucgacaaagaaaauaaggcguucaacucaagucuuggaacguaucacgaccuucgcaaaauccucgacaaaucauuccucgaugacaaagccaacgagaaaaccaucgaagacauaauacaaacacuaacucucuucgaagaccgcgaaaugauacgccagcgacuacaaaaauacucagauaucuuuacgaaggcccaacucaagaaacucgagcgccggcacuacaccggauggggccgacucagcuacaaacugauaaacggcauccgcaacaaagaaaacaagaaaaccauccucgacuaccucaucgacgacggcuacgccaaccgaaacuuuaugcagcuaauaaaugacgacgcacucagcuucaaagaagaaaucgcucgcgcccagaucauagaugacguugacgacauugcgaacgucguucacgaccuaccaggaagccccgccauaaagaaaggcauucuccaaucuguaaaaaucguagacgagcuagugaaggucaugggccacaacccggcaaacauaauaauagaaauggcccgcgaaaaccagacaaccgacaaagggcgacgaaacucccagcaacgucugaaauuguuacaagacucacuuaagaaccucgacaaccccguuaacaucaagaacgucgagaaccaacaauugcaaaacgaucgccucuuccuuuacuacauccaaaacggaaaggacauguacacaggugagacccuagauauuaacaaucuaucccaauacgacauagaccacauuauuccccaggcuuucauuaaggacaacaguuuagacaaccgaguacucacucgauccgacaaaaaucgaggaaaaagugacgauguacccuccauugagguaguacacgaaaugaaaucguucuggucaaaacugcucucuguaaagcucaucacccaaagaaaguucgacaacuugaccaaagccgaaagaggagguuuaacagaagaagacaaagcuggcuucaucaagaggcaacuuguagaaaccaggcaaauaaccaagcaugucgcacaaauccuagaugagcgauucaacaccgaguucgacggcaacaagcgccguauccgaaacgugaagaucaucacacuaaaguccaaccuugucuccaacuuucggaaggaguucgaacuauacaagguccgagaaaucaacgauuaccaucacgcucacgacgcauaccucaacgccguuguaggcaacgcccuacugcucaaguauccacaacuagaacccgaguucgucuacggcgaguauccgaaauauaauucuuaccguucccgcaagucagccaccgaaaaguuccucuucuacagcaacauccugcgauucuucaagaaagaggacauacaaaccaacgaggacggagagaucgcauggaacaaagaaaagcacaucaagauucugcgaaaaguacucagcuacccccaaguuaacauaguuaagaaaaccgaagaacaaaccggaggcuucucgaaagagagcauccuccccaagggcgagucggacaaacucaucccccgaaaaaccaaaaacagcuacugggacccuaagaaauacggcggauucgauuccccagucgucgccuauaguauccucguguucgccgacgucgagaaaggcaaaucgaagaaacuccgcaaaguacaagacauggucggaaucaccauaauggagaagaaacgguucgagaaaaaccccguagacuuccucgaacaacguggauaccgcaacguacgccuggagaaaaucaucaaacucccaaaauacagccucuucgaacuagaaaacaaaaggagaagacuccucgccagcgcgaaagaacugcaaaaaggcaacgagcuagucaucccgcaacguuucacaacacuccuauaccacucguacaggaucgaaaaagacuacgaaccagaacaccgggaauacgucgaaaagcauaaggacgaguucaaagaacuacuagaauacauaucgguguucuccagaaaauacguauuggccgacaacaaccuaacgaaaauagagaugcuguucagcaaaaacaaggacgccgagguaagcucacucgcgaaaucauucaucagccuccucaccuucacggcuuucggcgcaccggccgcauucaacuuuuucggcgagaauaucgaccggaagagauacacaucgguuacagaaugccuuaacgcgacgcuaauucaccaaucuaucaccggccuguacgaaacucgcaucgaccuuuccaaacuaggcgaggacuga

SEQ ID NO: 6484 - RNA, 4038 nt, Artificial Sequence
  Cas9 variant
auggaccaaaaauacagcaucggccucgauaucggcacuaacuccgucggcugggcagucguaaccgacgacuauaaagucccagccaagaaaaugaaagucuuaggcaauacagacaaacaaagcauaaagaaaaaucuccucggagcccuccuauuugacagcggagaaaccgcggaagcaacccgacucaaacgcacagcccgacgccgcuacacacggcgucgcaaucgcuuacgauaccuucaagaaauauucgcugaggagaugaauaaagucgacgagaacuucuuccaaaggcuggacgauuccuuccucgucgacgaagauaaaagaggggaacgacacccaauuuucggcaauaucgcggccgaaguaaaauaccacgacgacuuucccaccauuuaccaucugcguaaacaccuggcugacaucucccaaaaggccgaccuccgacucguauaccucgcccucgcccacaugauuaaauuuagaggccacuuccucaucgaaggacagcucaaagccgagaacaccaacguccaagcgcuauuuaaggacuucguugaaguauacgacaaaaccgucgaagaaagccaccucuccgagaugaccgucgaugcccucucaauccucaccgagaagguguccaagucacgacgccuagaaaaccugaucgcgcacuacccagcggagaaaaagaacacccuguucggcaaccucaucgcgcucagccuuggacugcagccgaacuuuaagacuaacuuccaacuuagcgaagacgccaagcuacaauucuccaaggacaccuacgaagaagaccuagaaggccugcucggagagaucggagacgaauacgcagaccuauucgcaagcgcuaaaaaucuauacgaugcaauacuacucucagggauacuaacggucgacgacaauagcaccaaagcgccccuguccgcaagcauggugaagagauaugaagaacaccagaaagaccucaagaaacuaaaagacuuuauaaaagucaacgcgccagaccaguacaacgcuauauucaaagacaaaaauaagaaaggauaugcaggcuacaucgaaaacggagugaaacaagaugaguucuauaaguacuuaaaaggaauccuacuccagauaaacggauccggggacuuccuagacaagaucgaccgagaagacuuccucagaaaacaaagaaccuucgacaacggcucaaucccacaccaaauacaccuccaggagaugcacgcgauccuccgcaggcaagaggaacacuaccccuuucugaaagagaaccaagacaaaauugagaaaauauuaaccuuccgcauccccuauuacguaggaccccuggcccgaaaaggcaguagauucgcaugggcagaauauaaggccgacgaaaagauaacaccauggaacuucgacgacauacuagauaaggaaaaguccgccgaaaaauucaucacccguaugacccugaacgaccuguaccugcccgaagaaaaaguacuccccaagcauucgcuccuauacgaaacguucaccgucuacaacgaauuaacgaaggucaaguacguaaaugagcaaggagaggcaaaauucuucgacgccaauaugaaacaagaaaucuuugaucacguauucaaggaaaaccggaaagucaccaaagacaaacugcuuaacuaccuaaacaaagaguucgaagaguuccguauuguaaaccugaccggacucgauaaggaaaacaaggccuucaacagcagucuaggaacauaccacgaccuccgcaaaauccuagauaagagcuuccuagacgauaaagccaacgagaaaaccauagaagacaucauucaaacccuuacccucuucgaagaccgggaaaugauccggcagcgucuccaaaaguacucugauaucuucaccaaagcacaauugaagaaacuagaacggcgccacuacaccgggugggggagacuaucguauaaauugaucaacgggauacgaaauaaagaaaauaagaaaacaauacuugacuaccucaucgacgacggcuacgccaaccggaacuucaugcaacucaucaacgacgacgcccuauccuuuaaagaagagauagcaagagcgcagauuauuggggacgucgacgauaucgccaaugucguccacgacuuaccgggcucccccgccaucaagaaagggauccugcaaaguguaaaaauaguagacgaacuggucaaagucaugggacacaacccagcaaauauaaucaucgaaauggcccgagaaaaccaaaugaccgacaaaggccgcagaaauucucaacaacgacucaaacuccuccaagacucccucaaaaaucuugacaaccccgucaacaucaagaaugucgaaaaccagcaauuacagaacgaucgccuuuucuuguacuacauccaaaacggcaaagacauguacaccggcgaaacccuggacaucaacaaccucucucaauacgacaucgaccacauaauaccacaagcguucauaaaggacaauagcuuggacaacaggguucuuaccagaucagacaaaaacagaggcaaauccgacgauguacccucuauagaagucgugcacgaaaugaaaucauucuggagcaaacucuuauccgugaagcuaauaacacaacgaaaauucgauaaccuaacaaaagcggaacgcggagggcucaccgaggaagauaaagccggguucaucaaaaggcagcucguagagacccgacaaauaacaaaacacguagcgcagauccuggacgagagauucaacaccgaguucgacggcaacaagagacgcauacgaaacguaaaaaucauuacacugaaaagcaacuuggucuccaacuuuagaaaagaguucgaacucuacaaaguccgagaaaucaacgacuaccaccacgcccacgaugccuaccuuaacgcagucgucggaaaugcgcuccuccucaaauacccccaacucgaacccgaguucguuuacggcgaguaccccaaauacaacuccuaccggucgcgcaaaucggccacugagaaguuccucuucuacucaaacauccuacgcuucuucaaaaaggaggacauacaaaccaacgaggacggcgaaaucgccuggaacaaagaaaagcacauaaaaauccuccgcaagguccucuccuacccccaaguaaacaucgucaaaaagacagaggaacagaccggaggguucucgaaagaaucgauccuacccaagggcgaauccgacaaacugauaccccgcaagaccaaaaacucauacuggaacccaaagaaauacggcggcuuugacagucccgucgucgcauacagcauccuagucuucgcggacguagaaaaagggaaaucaaagaaacuaaggaaaguccaagacaugguaggcauaacaaucauggaaaagaaacgcuuugaaaaacacccuguggacuuccucgagcaacgcggauaccggaacguacgccucgagaagauaaucaagcuccccaaguacucccuauuugaauuagagaauaagcgccgccgacuacuagcauccgcacgcgagcuccaaaagggcaacgagcucgucauaccacaaagguucaccacacuccucuaccacucauaccagauagagaaaaacuacgagcccgagcaccgcgaauacguagagaagcacaaagacgaguucaaagagcuacuugaauacaucagcguauucucccggaaauacgugcucgcugacaacaaccucaccaaaauagaaaugcuguucuccaagaacaaagacgccgaaguaucaagccucgcgaagucauucauaagccuacucacguuuacugccuucggcgccccagcagccuucaacuucuuuggagagaacauugacagaaaacgcuacaccagcguuaccgaaugccucaacgcaacacuaauacaccaguccaucacagggcucuacgagacgcgcauugaccuaucuaagcucggagaagauuga

SEQ ID NO: 6485 - RNA, 4038 nt, Artificial Sequence
  Cas9 variant
augaagaaagaauacagcauaggccuggauauaggcaccaacucaguaggcugggccguaaucacagaugacuacaaaguaccagcuaaaaagaugaaaguccucggcaacacagacaaacaaucaaucaagaaaaaccugcucggugcccuacucuucgacagcggugagaccgccgaggccacacguuuaaagcggaccgcccggcgcagguacacuaggaggaagaaccgacuccgauaccuacaggaaaucuucacugaagaaaugaacaaggucgacgaaaacuucuuccaacgccuagaugacuccuuccucgucgaagaagauaaacaaggaagcaaauacccaauauuuggaacacucaaggaagagaaggaguaccacaagaaauucaagacuauuuaccaccuaagagaggaacuagccaacuccaaagagaaagccgaccuccggcuggucuaccucgcacuggcgcacaugaucaaguucagaggccacuucuuguacgagggagaccuaaaggcggagaacacggacguccaagcccuauucaaagauuucguagaagaguacgacaaaaccauagaagaaucacaucucagcgaaauaaccguugacgcccuaagcauucuaacggaaaaggucuccaaguccagccggcuagaaaaccuaauagcccacuaccccacggaaaagaaaaacacccuauucggaaacuuaauugcccucagccugggacuccagccaaacuucaaaaccaacuuccagcucucagaagacgcaaagcugcaauuuucgaaggacaccuaugaagaagaucuagaggagcuccuuggagaaaucggagacgaguacgcagaccuguucgccuccgcuaaaaaccucuacgacgccauacuacugucggguauacuggcaguagacgacaacaccacgaaggcgccacucuccgcuuccauggucaaacgcuacgaggaacaccagaaagaccuaaagaaacucaaagacuuuauaaaagucaacgcccccgaccaauacaacgccauauucaaagacaaaaauaagaaaggguacgcaggauacauagaaucuggagucgagcaggacgaguucuacaaauaccuuaaaggcauccuccuaaagauuaacgggucaggggacuuccuagacaagaucgacugcgaagacuuccuccggaagcaaaggacauucgacaaugggucgaucccccaccagauccaucugcaagaaaugcacgcaaucuugcgccgccaaggagaacacuauccuuuccuaaaagaaaaccaagacaaaaucgagaaaauacuaacauuccggauccccuauuacgucggaccccuugcacguaaaggaagccgcuucgcaugggccgaauacaaagcagaugagaaaauaaccccguggaacuucgacgacauccuagauaaggaaaaauccgccgaaaaguucaucacccgaaugacccucaacgaccuauaccucccagaagaaaaagugcuuccaaaacacaguccccucuacgaaacguucaccguauacaacgagcucacaaaagugaaauacguaaaugaacaaggagaagcaaaauucuuugacacaaacaugaaacaggagaucuucgaccacgucuucaaagagaaccgaaaagugaccaaagauaaauuacuaaacuaccugaacaaggaauuugaagaguuccgaauaguaaaccucaccggacucgacaaagagaacaaagcauucaacuccuccuugggcaccuaccacgaccuccggaaaauccuggacaaguccuuccuugacgacaaagccaacgagaaaaccauagaagacauuauacagacgcugacguuauucgaagaccgcgaaaugauccggcaaaggcuacagaaguacuccgacauauucacaaaagcccagcuaaagaaacuagagcggaggcacuacacuggauggggccgacuaagcuacaaacuaauuaacggcauacgaaacaaagagaacaagaaaacaauccuagacuaccuaauugacgacggauacgccaauagaaacuucaugcaacucauaaacgacgaugcucucuccuucaaagaggaaaucgccagggcccaaaucaucggagacgucgacgauauagccaacgucguccacgaccucccaggcagcccugccauaaagaaagggauccuacaaucagucaaaaucguggacgagcuugucaaagucaugggucacaaccccgcaaacaucauaaucgaaauggcccgagaaaaccagacgacagauaagggccgccgcaacucccaacaacgccugaaacuucuacaagacagccuaaagaaccuagacaacccugucaacauuaaaaacgucgaaaaccaacagcuccagaacgaccgucucuuccuauacuacauccaaaacggcaaagauauguacacaggagaaacucuagauauaaacaaccucucccaauacgacaucgaccacaucaucccgcaggccuucaucaaggauaacuccuuggacaaccgugucuuaacacgaagcgauaagaaccgaggcaaaagcgacgauguccccucaauagagguaguccacgaaaugaaaucauucuggagcaagcuccucagcgucaaacucauuacacaacgaaaauucgacaaccucaccaaggcagaacggggagggcucaccgaggaagacaaagcaggcuucauaaagcgccagcucgucgaaacaagacaaauaaccaagcacgucgcacaaauccucgacgagagguucaacaccgaguucgacggagcccaacgucgcauccgaaaugucaagaucaucacccuaaaaagcaaccucguuagcaacuuccgaaaggaauuugaacuuuacaaagucagagagauaaacgacuaccaccacgcgcacgacgccuaccucaacgcugugguugguaacgcgcuccugcuaaaguauccgcaacucgagccagaguucgucuacggagaauaccccaaauacaauagcuacaggagccggaaaucagcaacugagaaauuccucuucuacagcaacauccuccgcuucuucaaaaaggaagacauacagacgaacgaagacggagaaauagccuggaacaaagaaaagcauauaaagauccugcguaagguccucuccuacccacaagucaacaucgugaagaaaacggaggaacaaacaggcggcuucucaaaggaaagcauccucccgaaaggcgaaucggacaaacuaaucccccguaagaccaagaacagcuacuggaacccaaagaaguacgggggcuucgauucgccggugguagccuacucaauacucgucuucgcagacgucgaaaaaggcaagagcaagaaacuacguaaaguacaggacauggucggaauaacgauaauggaaaagaaacgauucgagaaaaauccagucgacuuccuagaacaacgcggcuaccguaacgugcgacuggagaaaauaaucaaacuuccaaaauauucccuguucgaacuagaaaauaagcgacgacgacuccuugcaucugcucgagaacuacagaaaggaaacgaacucgugaucccgcaacgauucaccacacuacuauaucacuccuaccaaaucgagaaaaacuacgaaccggaacaccgagaauacgucgagaagcacaaagaugaguucaaagaacuucuagaauacauauccgucuucucgcgcaaauacguccucgcugacaacaaccuuacgaaaaucgagaugcuguucagcaaaaauaaggacgccgaaguaagcucccuggccaaguccuuuauaagccuccugacguucacagccuucggggccccugcagcuuucaacuucuucggcgagaacauagaccgaaagcgguacacaucagucacggaaugucuaaacgccacccugauucaccagagcaucaccggacucuaugaaacgcgaaucgaccuauccaaacugggcgaggauuga

SEQ ID NO: 6486 - RNA, 4041 nt, Artificial Sequence
  Cas9 variant
augaaccaaaccaaaaacuacgacaucggccucgacaucggcguaggauccgucggauggacaauaaccgacucacagucccaaaaaguccucaaaguaaaaggaaagcaaggaaucggaguccaccuauuuaacgaagggcagacagcggaggaacgacggcaguuccggaccaaucgcagacgacuuaaacgccgcaaauggcgacuacgccuucucagagagcuauucgacgaacccauaucgucaauagacccggaguucuucgcacgccuaaaauacuuuaacgaauccucaaaggaucccaaaaacaagggcuaucaaccccaacuccacgacgaccucaaagacgucgacuucuaccgccaauaccccacuauauaccaccugaggcacgcccucaugacccaaaaagaaaaguuugacauccgagacaucuaccucgcaauccaccacauagucaaauacagaggacacuuccugaugaacgggcacaguucauccuucucgguggcgcagacagauuggaaggccgaccugaccaagcuauucgaacucauacaagaaaccagaacaaaucucgauuucagcuucgaccuuaccgaaaucgacacuaucaagucccuucucuucgauaaaaaccucagucgcaacgaucgacaaaaagaaauaguaggcuugaucaacaauaauucgcaacucgauaagaaagacaaagcccucacaaaacagcucgucgaaagcgucgucaaggguaucguagguaugaaaacacguacagacauccuucucggcuacgaaguagauaacaaggaacaaaguaaagccuggaacuuuucaaucgacgaacucgacgaccagauggccacaaucgaccccgcgcucucccaaaauucucaggcgcacgacaucaucacccugauacaaaaacuuuacaugacaguccaacuagcgcaaauaguccccgaggggcaauccguauccgagaugaugauaaaccgauacaaccucuacgccgaacagcugcagcaacugaaggacuauaagaaaauaaacuuagaaacaggacuacuccuacgcgaagcguacgacgagcugaugacaaaagcccuuaccgcagcaccaggcaaaaccauccaugauacauucuauaauaaggugaagaaaauacucaaagaccaagacaacaaacaggcccucucuaucaaacaagccaucgaagacucgaacuaccucaucccccuacggauuaaaagcaacggcguaauaccguaucaacuccaccaacgcgaauuagacgccaucaucgagaaccaaaaagaguuuuacccauuccucgccaccccaaacccaguagauggccaccaagaagcccucccguacaaauuagacgaacucaucgguuuuaaggugcccuacuacguaggcccaaugguagacccggaaguggacagugaccaaaacuucgcguggaugguacgcaaagagaaaggcgaaauaacacccuggaacuuccacaacaagguggacaucacccaauccgcagacaacuucauaaaaaggaugaaaacuacagacacguaccugauaggaaaagacguacucccgcaaaauucccuacuguaccagagguacaccguacucaacgaacuaaacggcaucaagguugccaacaagaaacuaacuauugaacaaaaacagcggcucuacgaucaacuuuuuaagaaaaagaaaacugucaagaaacaagacaucuuaaacaaccucgucgccgccggugaaauccacgaagacgauaacuuaacaggccucagcaacgguaccacauucaacaacaaucuuggcucguauauagacuacugcaaaauaaucggacaagauaaacucgaggacgcuuccaagcaagcggacaucgaacgcauuaucgagugguccacaacauucgaagacgccaacaucuuccucaccaaacuagcugagaucaacuggcuuaccgaagaccaaagacaaaaacuuagucagauuagguaccgaggcuggggacaguucucaaaaacccuccuaacugacaucaaagacaacaaagacaacagcauaauagacaaccucaugucuacaaagaaaguauuuaugcaaauaauaaacgacaccacuaucaaacagaagaucgacgauuacaaccaguaccaccugaaccacgccgaccuaaaagacacaaucgccaacuuauucaccucaccucaaaauaaacgugccaucaaccaaacuuugcucguaauagaagacauaauaaacgcagucgggcacaagccaaaccgaauuuucaucgaaagugccaaggauaaccggaaugccaaaaaccaacuaacccaaucccgccugaaacgcauagucaagcaauuugaagauaauaaacagcacguggaccaaucggucuacgaggaacucaaacagcuagacgauggaagccaugcaagcaucgacgaccggcuacuccuauacuuccuccaaaacggcaaagauauguacacugggcaaccgaucgacaucagccagcucagcaccucccaauaccacaucgaccacauccuuccacaagcuaaagucauggacaacgcccuggauaaccgcguccuuguaucgaguaaggcaaacaccgaaaaaucagaccgcuuccuauccgaaaucccgcaauuucaacaacgcucacuaugggccgagcucgaaagaaugggcuuccucaccaaagccaagaaagaacgccucuuaaugaccuccgacgaguucaaacaaaacuccguaagauucauagcaagacaacucgucgaaaccaggcaaauaauaaaacucgucaaccagcucaucauccaggaacaccccgaggucaagcucguaaacaucaaagccgaucucacaaacgcauuccgcaaaaaguucaacuucguuaaaaacagaaaugcuaacgacuaccaucacgcuuuugaugccuaccucacgucacucauagggagccaucugcucaaaagccacccaaagugggaaccccuauucguguauucugacuacgacaaaauaaaguucgauaacgcuccacaaggcgucaacaucaugaaagaauuugaacaaucaaaauuagcagacgagaauggcgagaucaucuggaacaaggaugagaugauggcauaccuagagcgccuauacaacucccgccagauacuaauaacaaagaaagucuacgcccgacacggaaaccucuuuaaacagacaaucuucaaggcaggcgaguccgacaaccucauacccgucaagaacaaccgguccgacaucgcaauauauggaggcuauaaaucaaaacagguaaguuacuacgcacugaucagccuccacaacaagaaacgacagaagcgccuaguggccgucuaccucauagacauacaaaagcuacaaaaccucaacgaaucagacuauuucaaaacacuccacacaaucaucaaagagaggcacaacauaaaacccgaguucgacaucuuggccgacaaaauauaccaaaaccaacuaaucauagacaacaaaaacggcagcaaccgccccuuccgcaucgaaggcgacuucaagaaugacagacaacucuaccucccccuccaauaccagcgcugguuagcauccaaagagccuacggacgaaaaacuuaaucggaucuuugaccacaucugcgaacagcuagccgacuauuucccccuauucgccggcaacgcuugcgacaaacuccuagacaaccgcgacaaauucuaccagcucuccaucaagucagaguucaacgacaaaggaaaacugaucgcugaaggcaagcucuccguuaucgacaaacugcuaguagcaaugcacgccgacucgcguaacucaaaccucgcgguaauaggcuuaagcuccuccuggggacgcuucaaacuucacgggggaaaugaagccaucgggacgagcgugcaacuaauacaccagagcccgacuggacuauucaaacggauccaaagauucaauuga

SEQ ID NO: 6487 - RNA, 4041 nt, Artificial Sequence
  Cas9 variant
augcuaagcgcaggcgucaugcugggagacguaagcgcccucaaguccaguaggaauagccuauuccaaaagagcaagaaacuaauagagaacuccucauccgaccucaccaaaguagacuacucaaaaaugcgcgagauucuccucaguauacgaaacaucgcaauccgcuuuuucaacaacgaggacuucaaagaauccgacuacuacaaggaguucccaaccauauggcacuugcggaagaaccucauggaaagcgacaaaaaggccgacauacgucuagucuaucuggcccuacacaauauagucaaauaucgaggaaacuuccugcaggaaaacaacaaggaccuacgagccgcgaacgcgaaugccggagcagccgcgauugaccucucaaacgcgcucgaagaauacuucucgcuacaugaagacgaaucugcgcuaaccugcgucccgaacgucgccgaucugcagaugacccuugaacaacccggucuacgaaacggcgaacgacuagacaggaucguggcggcacuaaauaugcccgaccgcgcccgcgcaaaacucuucgcaaaggcgugcaucggccaaaaagucgaauuuuccaaacucgcccucggaauggaaaaacaagaaggcaccaacgccuacaucugggacgacgacaaauacgacgagcuagucgcccuaugcccagaagauuucuuccccguccucgaaacccugaaaaacgcauacucugccuauguacuauccgaccuccucgcagggaaacuuagcauaucagccucacucauagacagcuacgaacaacaccaaaaugauuuaaagaucgugaaggaguugguccgagaauaccuaggccagaaagaauacggucgccucuucagaggcccgaaauucgcgaacggagacuacaacuucaacaaagucgcaaaacccagcuauacaucauacauacugggcgaaucacuauguaacaagcaaggaaccacgcgggaggagcuaguuaaagaacuaaaacgaguauucgacgacuguuccgcaauacaagccgauaaaagauaccagaaaaucaagcaacgccucgaagacgacccuaaauuccucauaaagcagaaaacacgugccaacggagccauccccuaccaacuccaccucgaagaaaugcaucaaauaauugaaaagcaagggaaauacuacccauuccuagucgaacaacaagaccuuaucgaaaaacuggucuccagccggauccccuacuaugucgggccacucaacggcgggcacgacccaaaccaccccuaccccacuaaccccaucgacccgaagcgcaaauucgcuugguccguccgaaaacccggcauggaacacgaaaaagccuaccccuggaacguagacgaaguaauagacuccgaagaaacagccgagcgguucaucaggcgaaugaccggaacaugcaccuaccucuacggggaacccgucguaccacggugcagccuccuuuaugaagaguucuguguauugaacgaacucaacggcgccagauggggagaaggcaacggggacacccaccgauucgacuccagcgacagaaccgaaauccucgaacaacuauucaagaaacguaaacggguaacacacaaggcaauagcaacaugguuggaaauaaaccacggggucacaaacgucaagauauccgggacgcaagccgaaaaugccuucgaauccaagcuauccucauacaacgacuucugcaaccugcuaggcguagacggccuagaggacguuugcccacuaacaaaagacgacaucgaacaaaucauacucuggguaacaguauucgaagacaagaaacuccuccuccagaaacuccagagggcguucggcgacaaacuaucggaaaaacagaucgccucgauaaugcguaaaccauacgcuggauggggccgacuaaguuccaaacugcuaacaggaaucaaacgugaaacacccuucggacgcauauccauccucgacgucaugcgagacggggacccccggcccggccaccaccucgacgcaaugaacuucauggaaauccuacgcgagaaagacuucggguuccaagaccgcaucgacgagauaaacaaagaacggacaaaagaaagcggauuacuacuuagcguggaagaccuuccaggcagccccgcgcuacgccgcuccguaaaucaagcgaugcauauccucaaagaaaucguaucgauagccggcaaagaacccucccgcauuguaauugaggugacgagagacccggacgaagaaaagagaggccacagaacagacacgcgguacaaacaacuuagcgaagcacuggccgccauaaaaacagacaucguccaauucgacucaagccuccuggcagaauuaaaggaacgcaaagacucccucgauagcgaaagacuaaugcucuacuuucagcaaugcgggaagucccuguacucggguaaaccacucgacauaaaccggcuauccgaauaucaagucgaccauauaaucccacaaugcuacauaaaggacgauuccuuggacaacaaagcccucgucuucgccucugagaaucaaaucaaacuugacucgcuacuacuagacaagagcauaaucaggagccagaaaggucgcuggcaagaacuacaccgggcgggacugauauccaacaagaaauuccggaaccucacaugcacggaaaucucggaccgaaugaugaaaggcuucaucaaccgacaacuuguagaaacaucccaaaucguaaaauucguccgucagaugugcgaacagcgauacgaaucgagugaagucaucagccuacgagccucccucagucacaaucuucgagaccgaugcggcuucaucaaaugucgcgaacugaacgacuaccaccacgcccacgacgcguaccuggcgugccaaauagcacgcuucauuggaauccgcuacccgagauggcaggacggcaucucgcgggaguucauaaauaaauauaucaaacagcuaguaaagaaagggaaaucaagcggcaaguucuucgccggcaagucaggcuucauaauagacagcuucaugcacgacggauucgaccgggaaacuggcgaaauauuccgcgauggcugggacgcaacguucgagauuacaagaaugagacgcguccucggcuacaaagacugcuucauaacccgcaugccugaggaacaaacaggggcauacugggaagaaaccauauacucgccccuagacgccaagaacgggaagaaccuacaaaucccccuaaaacaaagcggaaaggaaggauaccuugaccccaaaaaguauggcggcacaaacacggccuucaacgccuacuucuucgcuuucguagcaaaggacgcccggggccgagacaaauacuuuuucgagggggucccaguauaucuagccaagcaacucaacgaacaaccacaaauccucguugacuucgcaaacagcauagcagcuacaaagaaaugcuccacggccaaaauacuccgaagcaagguuccccucaggcaaaaauuccuucuugauggcacaaguuucuaccuagggggcaggacaggcaacaagaacguaauccucuccggcguagaguuugccugcggaauugacauggccaaaaugaucgauacggcaaucaaacaccccgaggaacucucacagaaagaacucaucucgauaauccaaaugcuagcugauacaauagagcgcaacagugaccgacaggcaucccuaauaaacuucagacguuucgacgauaaacuuagaaacaucgacgcgaucgcggcaucacgcaucauuaaaaacuugcugaacagcaugaacggaguaaaacagaguugcgaccucagcgaccucggcggcagcaaacaaagcggguucaugcaaagcaacauagcaacccuauuugaacgcaucacuuggugcuacuccagcaucaccggcauguucgaacaaagggugucuuucgaagaccuuaaaaacgggaucuga

SEQ ID NO: 6488 - RNA, 4041 nt, Artificial Sequence
  Cas9 variant
augaagaagagaaaucgagaggaauauuacgucggucuagacauaggcacguccucagucgggugggccguagccacacccgacuaccggauccccaaauuccgcggccacaaaaugugggguagcaggcuguuugccgaaggcaaaagggcagcagagcgccgacaauucagaacaaaccgacgcagacuagcacgacgccgagaccgcuuacagaucuuagaggagcuuuucgcagaagaaauggcaaaagucgauaacaccuuuuucaugcgccugaaggaaucuaaguucuuccucgaagacaaaacgguaaaggaaaagcacauccuguucagcacggacaaauucgacgccgaccgcuucuacaaggacaacccgacaauauaccacguacggaaaagacucauggaagaagaaccccaggacauacgagagcuguuccuagccguccaucacauccugaaauaccgcgggcacuuccucuucgccggcagucuagaacaaaauggugacucaaucgaggaacucguacgaacucuauucggcaagcaaggacuagccauccucgacgacacaaucgacucaaacgaaauggugaacauacucaaaaacaacgagaaaacaaagagcgaccggaagaaagcaguccaggaacuauggaacccccucaaagauaaagugaagaaagcccaggccgcugaaauggccggcgugguucuaggacuaaacucagacaucucgaaacucuucgacaacucugauuacaaagaccucaaaauuaacuucagcucaggggacuacgaugaaaagcgcgacgacuacgccaacagcaucggcgaugacaucguccuacuagacacaaugaaagccuuauaugauacccucauccuaucacagauccuucaaggcaagcaaagcauaucggaggcgaaaguugaagacuauaacacccacaaggagcaacuccgugcgcuaaaagcuauccuaaaaccgcauaagcgacucuauaacgaaauguuccgcgaaaacaacaagaaagaccucucaaacuacguagccuacauauccagcuacuccgaaggcaagcgggucaaccgcgaaggcuucuacaaguacguacaagccguccuaaaacaaguagacgacagcgacagcaaacaagcuauccuggaagcaauccgacucgaaacauuccucccacuacuacgcguaaaagacaacgcagugaucccccaccagauccaccaggcggagcuugaggcuauucucgagacggcccgcaaaaaguacaaguuccucaacgacgugagcgaaggaguaagcguuaaagacaaaauaauacaacuauucacauuccgaauaccuuacuacgucggcccccuuaauccccacucaggagaaaccguggcagaccgcaagcaaggcacaggcugggucguccgcaaacaacggggcaaaguauacccguggaacuucgccgacaugguagacgucaaggccagugcagaagccuucaucaccaacuuaacaaacaagugcacauaccucaucggggaagacguacugcccaagcgcucccuacucuacucagaguucaugcuccuaaacgaacucaacaugaucaaauacgauggacaugaacugccugucgaaauaaaaagacuauacaucgagcaaguauucaaacaggaacacaagaagcagaccaaaggacgcguacuagauuuccuuaagcgcaacggccucaucacaggcuccgcuacagcugucauuacggggauggacgacucgauaaagggagaucugcaauccuaccgagacauggucagaaucuucggcaccggcuucgaccauucuauggcggaacguaucauccgauggguuacacuauuuggagaagcaaaggacauccuugagaacaaaauccgagagguauacggcaauaguauuucagacagucagaugagagccaucaaaaagcucaaauacgccgacuggggacgccugagccaagcguucuucauuaagaucaucggaugcgacaaaagcggcgucgagcgaaauaucauaacgugccuacgcgaaucaagccagaaucugauggagauccucagugaccaagguaccuacauuaagcaaaucaaagccuggaaccaucaacauaccacaaacaugauggacacccucgacuaccagcuaguggacgaccuguacgucgcgcccagcgugaaacgcagcaucuggcagucacuaugcauagucgaggagcucgucaaaaucaugggccaagcaccgaagaaaauuuucguagaagucacccggaccaaccaggcggagaaaacaaagaaagacucccgcaagaaacggcuagucgaacuauacaccgccauaggaaaagaaggcgccgcauggaaaaaggaaauagaaaagcaucaggccggcgacuuccgacgaaagaaacuauaccucuacuacacgcaaauggguagaugcauguacucgcacgaacccauugcgauggacgcucuguucacauccgaauacgacaucgaccacaucuacccccagagccugaccaaagaugacagcugggauaaccucguccuaguaaagucgcagcuaaacaaggaaaagagcgaccaauacccgcuacgccccgcaauacgugagaaaaacaaggcauacuggcaguaccucugcagagcagguuucaucagcgaaaagaaauacgaacggcuuaugaggacgaccgaacucacggcagaagaacucagcggguucauagcgaggcagcucguagaaacgagccaagcaacaaaagcgguaauaggccucuuggaaagaaucuacaaacacacagacaucugcuucgucaaagcagaaacgguuagccaauucagacaccagcauaacuuuauaaaaauccgggaacuaaacaacuaccaccacgcaaaagaugcauacuugaacaucguagucgggaacgucuaccacgagaaguucaccaagaacccaagagaguucauugcccgcucaaccgaacgcaggcccuauaacuugaaccguauguacgacuuugacuuacucaaacagggacgaguaauauggcaagugccaaaaucacucgaaacgguccaggcgaugaugaaaucaaacgacguccggaucaccaaaaagcuccucgugcaaaagggagaacucuacgaugccacaaucacaaaggcccacaaaacaaaagagggaauguacuucccacucaaaggcgccgacgcaagacuccgcgacguccaccgcuaugggggauacgagaaaauaaagaucgccuacuacagcguauucagcugcugcgaaaaagcaagcgacaccauccacacgcucauaaucccgaucccagucuacgcagcgggacugcuacagacagaagcggaucuaaccgccuacgcuuggcagacaaagcaaaagacuaaaccaauaaaagacauauacagcaugauaacgcccauuuacaagaaacuaugcaucaacacagucgucaaaaucgacggauucaaguacuuccugggaggccgcacagaagacuacaucugcuuguaccccgcgauaccggugguccucgacgaacaggcagcagcguaccucaaggcaguaaguaaaguaggacgcgcagacgauguggaaaacacggcacaagccaucgaccuaaucaccgccgaggcgaacgaagccuucuacgauguccuacuaaagaaaauggaagccaaaaucuucguuaaggccuaccaagaacggguagaaaaacuggccucagagacagcacgcgaacguuucaggaaacucagcaucggggcccaaugcucgugccuacuagaaauccuaaaucuacucgccaacaacaaaacgacaagcaaccugaaaaaguggcuaggagucaccaugagcagacgaaaacaaccaauggaccugacgaagcuggaagaauguaucgucuacgagacaucgaucaccggacucuacgaaaaagccguaucgcuccuauga

SEQ ID NO: 6489 - RNA, 4041 nt, Artificial Sequence
  Cas9 variant
augguggagcacuacgccauuggguucgacauaggcaccggaucaacgggcuuugcggggguggaccccaaugggaagcuaguacgaaugcgcgggaaaaaugucuacggaguguaucguuuuaaaggcggcgaagcugcagccgaccgccggggauuucgcacaacacgucggagaauaaaacgaagaaaauggcgccuacguuuccuuaaaucauuuuucgagcccuacauagccccuauagaccccgaguucuuccuacgacaaaaauacucggccgacuccccgcuagaucccaaaggcauuagagcagacaaaggacuucugucagacaugagcgaccaagaguuccacgccaaauacccgaccaucuaccaucuacgcuaccagcuaaugcacgaaaaacggcaguucgacguccgugaaaucuaccuagccaugcaccacauaauuaaauaucgcgggcacuucuugauagaagacggcgccgauaacuuugacgcaaagcaaauagacuucuucgaccaguuccaacgcauggcugccgucacagccggccucccagaacucgaaacccuagucguaccugacgaaacacaaucagacgcauucaagcgugugcuauucgaugaaagccagaccaagucagaccgacaaaaaguccucgcuucucaacuacuagacauccaggauaaucaaucuaaagcgaucaaagacuucaucgcagcacugacuaaagcaguggucgguaugaaagccaaucuugcgacccucaccucaaccgcaaucgaauccacugacaaaaacgauuggaccaaaccgcuaggccaacucgacgacuuccuacuaaaacacgaagaagaccuagacgaagacggcuacgcccucauagaugcagcgaaucaaauguacucagcagccguacucgcggcacucgucccggaagguaugggguucuccgaagccaugauggcucgcuacgcacaacacaagaaacagcucgcacuauacaaacaagugaucgcgucacuacccgauaaaacccaaaggcacgaacugaaagacgccuaugccgacuacaucgagcacgccgcccaaaacccccgagacgcuuucuacaaacgagucaccaagguccucgaaggggucgacucggccgacgcgcgaacggucaugaccgcaauaucgcacgacgaguuccugcucaaacaacgaacgcugucaaacggaaaaauaccauaucaaaugcagcaacacgaguucgacgccauaauagaaaaccaaaaagccuacuaucccuggcuugcaacgcccaaccccgucgaagcagaugcaaaacgucuccccuacuauuuagacgaacucaucggcuuuagagucccguacuacguaggcccgauggugaccgaaaaacagagccaauucgccuggaugauacgcaaagccgacggcgaacugacccccuggaacuucuucgauguaguggaccgagaaaagacagccaaccgguucauucaacgaaugcaaacaaccgacaaauauauccucggcgaagacguacuaccgaagcauagcauccucuaccaacaauucgagguccucaacgaacugaacaacauccgaguggaaaaacacccccuuaccacagaacaaaagcaauucauauaccaacgccuuuucgucgaccaacaacgaaaaaccaucacaaagaaaaaucugcaggacacccucgucgccaugggcgaguucgacaaagcgcccgacauaggcggccucgccaaagaagacgucaugaugagcucauuggccacauuugcggacuauucaaaaauccucccggaagcaauauccgacccaacgcgucaaaacgauauagaagacauaaucgccuggagcaccaucuucgaagacacucagauauucuuugacaaacucaaaacaguagacuggcuuacgacacagcagcgaaaacgacucgcaagcaucagauauaccggcuggggcaaacugagcaagcgccuccugcagcaaaucccaacauccaaacacacaaauguaauggcggcccucugggcaaccucugauaacuucaugcaaauacuacaagaugaacaauuccaagaaggccucuacgaugcaaaucgccuaccagaggaaacacucacgccugacgaacagguagaaaagauccuggacgaggcuuacuuaucuccggccgacaagaaaggggcacgcaaaguuauaaaaguaaugaacgacauaguccgcgcuaaucacggaguccugcccgaacaaguauuccuggaaucagcugaugacccacagaaaaacaaaagacgaaguguaucucgaaguaaacaacucgaagaaaaauaccggcaagccgcccagucguucauagacgaagccguaaaagaagaacuaaacgcgcagauagucaacucagcggaguucaacgaccgacugguacuauacuuuacccagaacggaagagacauguauacagguaaaagacuagacaucgaaaaccuuggaagcuaccaaaucgaccacauccuaccccaaagucuagucaaagacgacagucucgacaaccgcgcacucaccgccagggacaucaaugccgaaauguccaaccaguucguauccgaacgguucggauuagggccacgcgcauucuggcaacaacucaaaaacaacggccuaaucagcggucgcaaguucagaaaccucguaaugcagcgagacgaaauagacaaauacgcgcccggauucaucaacagacaacucguagaaacacgccagauaaucaaaacaguggaacaaaucauccacagacuauggcccgacauacaaauaguaacaaucaaagccaaccuaacucaccaaguccgcagcgaacugggguuccccaaaguccgggaacuaaaugacuaccaccacgccuuugacgcccuucuagccgcccggauaggccaguaccuacuggaacacuacgccggccugaaaccauuuuucaccuacggcgaguucaaacgcggugacacaaagaaauacggaaccaccaacuuccuucgacgacuaaccaaggacaacaaagacaagaaaggagagcuccugcccgaagucucagacuggauagacuccauugacagcauauacaacuacaagaaaaucccggucgucugggagaacacaaccaacaugucagcccuauucgaccaaaccauauauccccggccagaccgcgauaccacaaaacggaaacugauccccacgaaacuagauaaacccaccgauauauacggcggcuacucgucagccaaaaccgccuacauggccgucaugcguguccagacgaagaaaggcacagaguacccagucuucaacauccccgucuccauagcaagccagcucaaccgaauaaccgaccaaaccauguuaaaacaacaaguuaaacaauucaucaucaaugcggaacagucagccucaaagaagaaacucuacgaaagcggggacgugauacucagccgaguagcccugggacaacgauucacagauaaaaacuacggcgagguauuucucaucuccaacauggaaguccaaaauccccaaucgcuuuggcucggacgugcgagccaacaacgcuuaacucgcgaacccgagggaaacgaaaaacccgaaaccucguuggccgacauuuaccaacaaauacucaaacaagucgaccgguacuuccuagccuucaacauccgacaacaacgacaaaaacuacucgguacacuugaccaguucacgucacuccccguuggacgcgucaacgaacagacccgcaccgaccagaaucaaagaucaaucaucgcccgggucaugaucgucuugggaaaaggcuccagagaagaaaaauuccccgaguucggccugagcgcccucggccggcugguccgaaccggaggaaucacauuaucagaagacgcacaaauaaucuaccaaagcccaaccggccuguucgaaagacgcgucgcacucaaagacuuguga

SEQ ID NO: 6490 - RNA, 4041 nt, Artificial Sequence
  Cas9 variant
auggcgaaaauccucggacuugaccuaggaacaaacuccaucggcugggccgucguagacauagagaacaacaacgaguucacacugaucgagaaaggggugcgaauauuccaagaagguguaaagaucgagaaaggcaucgaggggucgaaggccgcugaacgcaccacuuaccgauccgcccgcagaaucaaguacaggagaaagcugaggaagauacaacugcucggagugcucagcgagaacggauacugucccuuccucagcaaagacgagcucgauagcuggcgcuacaagaaaguguaucccacgaacaaauccuuccugaauuggcagaaaacgaacgagauccaacuagagaacccuuacuucuaccgagcgcugcuaguagagaagaaacuuaaccucaacaucgaagaggacagguucaaaaucggaagggcuuucuaccaucucgcacagagacgcggcuuccugucgaacaggauggaggggaccaaagaaaacgacggaaccgugauuaaauccauaacggaaaucagcaccgccaaaggagacaaaacccugggccaauacuucuacgaacgcuacaagaaaggcgagaaaauacgcgacaccuacacccaccgcgaagaacacuaccucgaggaguucguccggaucugugaguuucaacaacuggacaacaaauucgccgaaaaaguaagaaaagcuauauucuaccaaagaccccucaagagccagaaaggccucauaggcaaaugcguauucgagccgaagaaaagccgaugcagcgugagccgaccagaguucgaggaguauagaaugcugugcuuccuaaacaacaucaaaaucaagaccccaagugacgagaaucuccgauuccucacggacaacgaaaaagagaaacucaaaccacaguucuuccggaaaucgaaggaccacuuugacuuugaggaccuugucaaacaacuggcucccaaaaaucaguucaaauucuacaagagucgcgacauccuaccaggaaauuggcuauuuaacuacuccaugaacaccacugucuccggcugcccaauaucagcaagacucaaggaccucuucggcgagaacuucauggacaucaaauucgacuacauccgagaaaaagaugggaaaaagucugugaucgacauccacgacaucuggcacguacuguucaccuacgacagcgaagagaaacucaaggaguucgcccggaaccgauuaaaccuagacgacaucaaaauaaaagaguuccaacgaauacagcugaagaaagaauacgccgcccuuagcuuaaaagccaucagaaaaauccugcccuuccucagggaaggauuaaucuacucucaugcgguuuucauagcaaacauggaaacagccauacccagcgaaauauggaacaacuacaccaaccgaaacauaaucaaaaaugagauauacaacauaaucucgaaccagaccgaggacaaacagguggucgacaucguaaacggcauaaucaaaaguucccggaucgaaaauuccguuugguccaacgaagcaguggaguucuuuaagaaagaccucaacagcaaaaucaaaaacuauuacggcauaaaaacguacaacgacuuccccgaagagaagaaaaucagaauagagaccuaugcauucaaccuguucaaacagcagaugaugaaaaacuucggaagaggagaguucgcugcaguacaaagaauagacgaacgccucaaacucuuucuuaccgauaacuuuaacauagacccgauucugcucaagaagaucuaccacccgucagccauagaagucuaccagccgccgguacggaaaaacgauggcaaacucuaccuuggcucacccauggucucaaguauccgcaacccaauggccaugcgcgcccuccaucaguuacggaaacuaaucaacgaacucauacggaaagaacuaaucgauagcaacacaaagguaaacauagaaauggcgagggagcuuaugaacgcaaacgaacggaaagcauaccagaacuggcaaaacgaucgagaaaagauccgcaaagaauacgcgcucaagaucaaacaacaccuagacguagacaaagaaccaucggacguagacauccuaaaguaccaacugugggaggaacagaaccacaaaugcauuuacacgggcaaagaaauuaacaucucugacuuuuuagguagcaaccccaaauucgacaucgagcacacaaucccacgcagcaucuccuucgacaacucucaauccaacaaaacccucugugaaaacuacuucaaccguagcgucaaaaagaaucgcauacccgccgcacucccuaaccauggcgagauaauagaacgacucgagaacuggaaacugaaauacgaggaacucgaaaaacaaauccaauacgccguacgccaagcgaaaggcgccggagacaaagacucaaaggaccgagccauacagaaaagacacaaacuaaaguucgaauacgacuacuggaaaaacaaguacgacagguucguaauggaggauguccccgaaggauucaaaaacagccaacucgucgacacugggaucaucaccaaauacucaagaauguaucugaacaccuuauucgacaaaguguacacaguaaaaggcaacacggucgccgacuuccgcaaacuaugggggauacaagaugaauacgaaaagaaagcacgagugaaccacagucaccacugcgucgacgcgaucaccaucgccugcauaaccaaaagcaacuacgaaaaccucgcgaaauuuuaccacgacugggaggaacuacacgucaaaggcaucgaccaacucccgcccaugaauaaacccuggaaaacauucaccgaagacauaaaggccauacaauacgagaucuuagugucacacuacaccccagacaaccuacccaaacagagcaagaaaauacuccgcaagaaaggacgcauccagaaaaacgaaaacggcaaccccaucuaucugaaaggagacacaguccgaggcucccuucaucaacagacuuucuacggugccaucgagaaaacagaagugaacaaaaagggagaacccgaaaaaguaaucaaauacgucguccgaaagagccuagauguucucgacgacaguucggucaaaaacaucguagacgacaucgucaaagaaauuguccagaacgcccgcaucaaagaaaaggauuucaucaaagagcuagaaauacaaaagagaaaacucgccaaggccgaggaaaacaaggucguccaaauccaagcagaaaucgacaaauugaacaagcagguagccgaccucuacacaaugcccaacaaaaacgguaaucccaucccgaucaagaaagugcgcauuuuccaaacaucagugacgaacccaauccaucuaaaacaacagagagacaaaagccagaaaaccucaaagccacacaaggaguucuacuacgcggcuaacgacucaaacuacaugauggcgaucuacgagggcaaagacgaaaagggcaaaguaaagagagacuucaagcuccuuaacaaccuagaagccggagaguucuuuaaauacagugugcacaaagaccucaaagaaaagaaccuagaaaacauccgcaacgucauaccagauaaagucucggccgguaaaaucgaaaucccacucaaggccaucauuaagacgggaaccauggucauccuuugggaaaacagcccggacgaggucugggaccugacaaucucggaagucgacaaacgucuuuacaaagucgucggcaugucggugaaccgcaucaaauccgacguaaaaacguucgaguucgggaauaucguccuccgacacaacaaagaagcguccccggcaacgcuccugaaaauacaagacggcgaguucaagagcgacgaaaacuacauagcccaacgcaagcucucgcauaaccaauucaacgccuuagucgaaggagucgauuucucgcucagcgugcuuggcgagaucaaacggcucaaguga

SEQ ID NO: 6491 - RNA, 4044 nt, Artificial Sequence
  Cas9 variant
augggggaagacgggaaaccaguacgcguaaagggcaaaaccgcaauaggcgcacgucucuuccaggaaggucacgucgccgccgaccggcgcauguuccgcaccacccgucguagacugaaccggcgaaaauggcgacuaaaacuacucgacgagauauucgaccccuacaucaccccggucgacagcaccuuuuucgcacggcucaaacaaagcaaccuuagucccaaagacucccggaaggaguucaaaggcucaaugcuauucccggaucugaccgacaagcaguaccacgaagacuacccgacaauauaccaccuccgacgcgcccucaugacggaagacaaaaaguucgacauacgaaugguauaccucgccauacaucacaucgugaaauaccgaggcaacuuccugaacuccgccacaguugauaccuucaaagcauccaaagucgacuuuaagaaaucuuucaaccaacuaaacgaacuauacagcgcaaucaacccggaagaugccuuccaagucgacaugaacaaaagcgacgagacaggacgcuuauuccucgacagcucgauacgcaaauucgacaagcaaaaacaaauuuccaaauugaucccagugguggucgaagacaaggaagcgaagaaacuaaacgggaagauagcccucgaaauuacaaaagccauacucggauacaagucaaaacucaacgugguaacacaaacagaaccagaggacccaaagaaaugggcagucaaguuugacgacgaagacaucgacucgaaacuuaacgacauacugccugagauggacgaaaaccagcagagcaucgucgaaauaauacaagaccuauauucccaagucacccuuaaccaaaucgugccgaauggcaugagucuuuccgacucaaugaucaagaaauacaacgaccaccacgaacaucucaaguuguauaagaaacucaucgacaacauaagcgacacaaagaaacgcucugcccuaaaaacagcauacgacaaauacgucggcgacgacggcaaaacuauagaacaggacgaguucuacucuaacgucaagaaaaaccucgacgacagcgaccuaucaaaacagauugcagaccuuaucgaagcagaaaaauucaugccgaaacaacgcacuucacagaauggagucaucccccaccagcugcaccaacgcgaacuagacgaaauaauagagcaccagucaaaguacuauccaugguuugcggaggcaaacccaaacaaacacgaccuucaucuagccaaauacaaaaucgaggagcuaguagcuuuccgaauccccuacuauguaggcccgaugaucaccccggaagaccaggaaaagucaucccaaaccaucuuugcguggaugaaacgcaaagaacccggacaaaucacaccauggaacuucgacgaaaaggucgaccgaauggaauccgccaaccguuucaucaaaagaaugaccaccaaggacaccuaccucaucggcgaggacguccuccccgaccaaucacuccuauacgaaaaauucaaagugcucaacgaauuaaacaugguacgcgucaacgaccacccacuaaaggugagcgaaaagcaagcgaucuacagggaucucuucgaaaaucaaaagcggauaagcgucaagaacuuacaaaauuacgugaaguccaagaguggccucccuaccggaccuaaaauauccgggcucagcgacccagaccacuucaacagcagccuuggcaccuacaacgacuucaagaagauguucggcgauaaaguggacgacccugaccuccaagaugacuucgagaaaaugaucgaaugguccacaauauucgaagacaaaaagauucuccgagcaaaacuggacgaagucgcgugguugucugacacccagaaaaacgaauuuaaagaaauccgcuaccaaggcuggggccgccuaagcaagaaacugcucaccggcaucgucgauggcaacggccaaagaauaauagaugaacucuggaauacgaacaagaacuucaugcaaauucaaucagacgacagcuucgccaaacgaauccacgaagcaaacgcuaaccaaaugaaagcaaccgacgucgaagacguucuggcagacgccuacacaucaccccagaacaaaaaggcgauacgccaaguggucaaagugguagacgauauucagaaagcuaugggcggaguugccccgaaguucauauccaucgaauuuacaaggucugaagaucgaaacccgcgucggacgauauccaggcaacgccaacucgaaaacacccuaaaagacaccgcacaagcccuugucaaaagcauaaacccggacauccucuccgaacuggacaacgcauccaaaucgaagaagggccugacagacaggcucuacuuguacuucacgcagcucggaaaagacauguacacgggaaaaccaauaaacaucgaugaaaucagcaacuacgacaucgaccauaucuucccccaagccuucaucaaagacgauucccucaacaacagggugcuaguaucgaaggccggaaacaacggcaagagcgcgaauguaccccuaaagcuauucggagcaaaaaugggaggcuacuggaaacaacucgcagacgcaggacucauagggcagcgcaagcucaagaaucuacaaacaaacccagacacgaucuccaaauucgccaugcacggauucauacgacgccagcuagucgaaaccagccaaguaauaaagcucguugcgaacauucuaggugacaaauaucgcaacgacgacacaaagauaaucgaaauuacggcacgcaugaaccaccaaaugagggacgaguucggcuucauaaagaacagggaaaucaacgacuaccaccacgcauucgacgccuaccuaacagccuucuugggccacuaccucuaccaccgauacauuaaacuucgcccauauuucguauacggcgacuucaaaaaguucagagaagacaaaguaacuaugcgcaacuuuaacuuccuccacgaccugacagaugacaagcaagaaaggauagcagacaccgaaacgggggagguaauaugggaccgcaaacgaucgauccaacaacucagagacgucuaccacuacaaguuuaugcugaucagccaagaagucuuuagucuaaauaaggagauguucaaacagaaacucuuccccgccacccuggccaaaaagagcaaacucauccaaauaaagaaagacaaaccagucgacauauacggugguuacuccaacaacaccgacgcauaucucaccgucguaaaacuaaaaggcaguaaggaggacaaauauaaaaucguuggcguccccaugagggcgcuagacaaccuaaaacacgccgagaaagagagcccccaauccuacacagccgagcuucgcaaggcgcucgaaccacaauucaccaagaucaaaaagaaccggaagacaggcgaggucuccaaagugguaacgaacuucgacaucguccuaggccggcucuuuuacaggcaaaugguuaucgacgguuccgaaaagucgcucaucgcgagcuccgucuaccaguacaacgcgaaacaacuuguccuaucagaccaggcaaucaggacaauaagugaucaagaggggaucgacgaguucgaacucagcucgcaauacgauaagguauacgacgaaaucguccaaaagguagaaaaauuacucccgauauuccaacaccgacacuuccaagagcgucuaaacaauggcaaaucccucuucgucaaccuuccaguacacgacguuuacgagggaaacaaacucgagcaggucggcaagaaacacaucaucaacuccauacucgguggcauucacgcaaacgcggaccgccccgauauagaccucuuugggauuaagaacuuaggccaauucuccagcaccagcggcaucaaccucagcuccgacgcgaucaucugcuaccaguccccaaccggccuauucgaacgccgagucguccucaaggaccuauga

SEQ ID NO: 6492 - RNA, 4044 nt, Artificial Sequence
  Cas9 variant
augacuaaacgcgaagaacccuacaacgucggacucgacaucggaucgucaucagucggcugggccguggucgauaacaacuaccaccuauuaaacauaaagaaaaacaaccucuggggcgcacgccucuucaaagaagcagagacagcacaagucacccgcggacacaggucaaugcgccggagauaccggcgcaggcgcaauagacucaacuggcucgacgagcucuuugccgaugaacuagcgaaaaucgaccccucuuuccuacuccguaugaagaacuccugggucucaaagaaagaaucaacucgcaaacgagacccguacaaucucuuuaucgaugagaaauacaacgacguagacuacuucaaccaguaccccaccauauuccaccuacggaaagaacuaauuacagaggacaagaaaguugacauccgacuaaucuaucuggccauccacaacaucauaaaauaccgaggcaacuuuacccucgaaaaucaaaauuucgauaucucgcagcuaagcaguaacuucagccaacagaucuccgacuucuucgcacuguucuccgacuucggcgucaucaugcccgaagacuucgaccccgacaaaaucagcgacauccuccucaaccccaacuuauccccguccggcaaagucuccgaggccauagccacgaucucacccaaaacaaacgucaaagccaaaaucaaaauuauccuacuccuccugguaggcaacaacggggaccucaagaaacuuuucgaccuagagacaaccgagaaaauugcuguaaaacucagcagcagacacauagacuccgaacuuccuaucauccuguccgaacuaaacgaacagcaggaaaacauaaucaccauagccaacuccaucuucggguccaucauacugaaagacuuccuaggagacgaaacgucaauaagcgcagccaaaguaaucucguucgaggaccacaaacaggacuugcaaaaacucaagacgauguggagagaaacuagcaacaaggaagcuguaaaagcagggaagaaagcauaugaagacuacaucggccacgaagacuccgaaacuuuuuacaagaaaaucaagaaauuccucgagaaagcccaaccuguggaccucgccaacaaagcacuggccgaaaucgaacuggaaaauuaccuccccaaacagcgaaacaggaauaacacugucaucccguaccaacuuaacgaaaacgaacucaucgcaauccuagaucaccaagagaaguacuaccccuuucucaaagaaaaccgcgauaaaauacuaucccuccuaacuuucagaauacccuacuacgucggaccacuccaagacuccaacaauaacagauuuuccuggaugaccaggaaagccuccggcgccauaaggcccuggaacuucagcgagaaggugaacguugaacaauccucgaacgacuucauaaaaagaaugcguuccacagacacuuaccuuauaggcgaaccugugcuaccgaaaaagucccuaauauaccaaugcuacgaagucuuaucagaacuaaacaacacccggguaaaagacggcuccucaaaccccaagagguuagacgucaccaucaagcaaagaaucuacaacgagaucuucaaaaaccagaagucaguuucaguaaaaguccuccagaacuggcucaucaaagagucauacuucaagucccccgagaucuccgggcucgccgacaaaaagaaauaccucucaucacucuccaccuacauagacuucaaaaagaucuucggccaacgcuucguagaugaccccguaaacagcccccagcuagaggaacucgcugaauggcugacacucuucgaagauaagaaaauccuccuuaucaaacuccaaaacuccaaauacagcuaugaccaagccacaaucaacaaacucuccacaaugcgcuaccaaggcacaggcaaacuuucgaagaaacuccuuguugaccugaaaaccaccaaaaagucgaucggcaaaucaggagccgagucacuaagcauccuagaucucauguggucgacaaaggacaacuucaugcaaauaauccacgacgcugacuacacauucgaacaacagauuaaagaguucaacuacgacaccgaagaugaauuaacgccccucgaaaaaguugccaaccuacacggcuccccagccuuaaaacgcggccuaaaccaaucaauaaagguuguggccgacaucgucaaguucaugggccacgacccagagaaaauauuuaucgaguucacccgcagugacgacuucuccaaauuaaccaucucacgauaccgacgcauaaagaagcaguaccuagagaucgccaaagcaaucaagaagaucccagccgaguucaaagacaucaaggaauaccaaacucaacuugaagaaaacaaggggaaacuugcaucggaaagacuaaugcucuacuuccuccagugcggacacucacucuacucuaacaagcccauugaccucaacaugaucaacuccucgaaguaccacguggaccauauccucccgcaaagcuacaucaaggacgacucacucgaaaauaaagcgcucguauuggccuccgagaacgaaaauaaaauagacaacaugcucauaucacacgacaucauagccacaaaccucccccgcuggcaagcacuaaaggaccaaaaccuaaugggaagcaagaaguucgccgaucugacgcggacaacugucacagaaaaccaaaagaagggauucauccaacgccaacucgugcaaaccagucaaaucgucaaaaacauaacccuaauccugaaugaccuauacaaaaacaccuccugcauugaaacccgcgcgacccugagcagugaguuccgcaaagccuuuuccaacuucgacgagacaacguaucacuaucaguuccccgaguucguuaaaaaucgugacguaaacgacuuccaccaugcccaagacgcauuucuagcuugcgugaucggcgaauaucaacucaaaaaguaccccaaagacaaccuacgucugguguaugaccaauacucaaaguucuuggacucccucaaaaaggacacccgcaagaaaaacggacggaugccacgauacacacaaaauggauucauaaucggcuccauguucaauggcaaaacauaugucgacgacaacggcgaaauaaucugggaucaaaagauaaaggaaagcauccgcaaaacauucaacuaccaccaauucaacguaguccggcaaacgaucgaacagcacggcaaacucuucaacgacacgauacagccccacagcgacagauacaaacucauuccccuuaaaacgaaccgagaccccgccaucuacgguggauauaacaacgacaacaacgccuacagcgucguccucgacgucgacggcaagaagaaaaucaacggcauaccaauacgaauagcgaaccaacucaaauccgacgagcuagaccuauccuccuggcuagaaaacaauaucaaacacaagaagccgaugaccauucucaucgacaaaguccccaaauaccaacgcaucaucaacgaagaaaccggagacuuacucauaacgagcgccaacgagguaauuaacaauguccaacucuuccucccguccauguauaccgcccuuaucagccuccuagacagcaccaaaacugaaauguacuccaagcuccucuccaacuacgaagccaacauucucauagacaucuacgauuaccuccugaccaaacucaaaaacaacuauccccuguacagaaaagaaugggcaaaauuagccgaacaccgugacgauuucaucgaauccgaccuagucacucaggcguccacucuacaacaacucaucaaguuuaugcacgcagacccgagcaacgugaaccugaaauucggcaacuuuaagggaaaccgauucggucgcaaaaauggcaauaucaagcucuccaagaccgacuucaucuaugaaucucccaccggccucuucaagucaauaaaacauaucgacuga

SEQ ID NO: 6493 - RNA, 4044 nt, Artificial Sequence
  Cas9 variant
augaaaagcgaaaagaaauauuauauaggacuagacgucggcacgaacagcgucggcugggccgucacugacgaguucuauaauauccuacgagcaaaaggcaaagaccucuggggagugaggcuauucgagaaagccaaaaccgcggcagacacacgaacauucagaagcggccgccgccggaacgaccggaaaggcaugcgacuccaaauccuacgggaaauauucgaagacgagaucaagaaagucgacaaagacuucuacgaccggcucgacgaaagcaaauucugggccgaagacaaaaaggugucaggaaaauacucacuuuuuaacgacaaaaacuucagugacaagcaauauuucgagaaauucccgaccaucuuucaccuccgcaaauaccucauggaagaacacgggaaagucgacauccgauacuacuuccuagccaucaaccagaugaugaagcgccgcgggcauuuccuaauagacgggcagauuagccacguaacggacgacaaaccccuaaaggaacaacugauacuccucauaaacgaccuccuaaaaauagaacucgaggaggaacugauggacucuauauucgaaauacucgccgacgugaacgaaaaacgcaccgacaagaagaacaaccucaaagagcucaucaaaggacaggacuucaauaaacaggaggggaacauccuaaacucaauauuugaauccaucgucaccgggaaagcaaaaaucaagaacauaauaucagacgaagauauccuagagaaaaucaaggaagacaacaaagaggacuuugugcucacgggagacuccuacgaagagaaccugcaauacuuugaagaggugcugcaagagaauaucacccuauuuaacacccuaaagaguaccuacgacuucgucauacuacaaagcaucuuaaaaggcaagucaacgcuguccgacgcccaaguggagagguacgacgagcacaagaaagaccucgaaauacugaagaaaguaauaaagaaauacgacgaggacggcaaacuguucaagcaagucuucaaggaggacaacgggaauggcuauguaucauacaucggauacuaccuaaacaaaaauaaaaagauaaccgccaagaagaaaaucagcaacauugaguucacaaaauauguaaaagggauccuggaaaaacaaugcgacugcgaagacgaagcgguuaaguaccuacucggaaaaauagaacaagagaacuuccuucuuaagcaaauaucaucaaucaacuccguaauaccgcaccaaauccaucuguucgagcucgacaaaauacuagagaaccuagcgaagaacuaccccagcuucaacaacaagaaagaggaauuuacaaaaauagagaaaauccggaaaacauucaccuucagaauaccauacuacgucggcccgcucaacgacuaccacaaaaacaacggcggcaacgccuggauuuuuagaaauaagggagagaaaaucagaccuuggaacuucgaaaagauagucgaccuucacaagagcgaagaagaauuuauaaaacguaugcucaaccagugcacauaccuccccgaagaaaccguccuccccaaaaguagcaucuuauacucagaguauaugguacugaaugaacugaacaaccuacgaauaaaggggaagccccucgacaccgacgucaaacucaaacugauagaggaacuauucaaaaagaaaacaaaagugacccuaaaaucaauccgcgacuacaugauacgaaacaauuucgcggacaaggaggacuucgacaacucugagaaaaaccuagaaaucgucucaaacaugaaguccuacaucgacuucaauaacauacugggcgacaaguucgaacuagaaaugguagaagaccuaaucgaaaagauaaccauccauaccggaaacaagacucugcucaaaaaguacaucgaagaaacauacccagaccuaagcagcucgcagauccagaaaaucaucaaccucaaauacaaagacuggggccgacucagccgcaaacuccucgauggaauuaagggacgcaacaagacugacgaugugaacacugucauaaacuucaugcggaacagcagcgacaaccucaugcaaauuauagaggggaagaauuauuccuuuaaugaguacauugacaacuuacgcaagaaauacaucccgcaagaaauaagcuacgaagucguugaaaaccucuacguaucaccaucgguaaagaaaaugaucuggcaggucauacgcgugaccgaagaaaucacgaaggucaugggauacgauccagacaaaauauucauugaaauggcgaaguccgaggaggaaaagaaaacgaccaucagccgcaaaaacaagcuccuggaccuauacaaggcaaucaagaaagacgaacgagacucccaauacgagaaacugcucacuggacucaacaagcuggacgagucggaacuacgguccaaaaagcucuacuuauauuacacacagaugggaagggacauguacacgggcgagaaaaucgaccuagacaagcuauucgacucgacacauuacgacaaggaccacauaaucccgcaaagcaugaagaaagaugacagcaucauaaacaaucucguucuaguaaacaagaacgcaaaucagaccacaaagggaaacauauaccccguaccgagcagcauccggaauaacccugacaucuacaacuauuggaaauaccugauggaaaaggaauuuaucaguaaagaaaaguacaaccgccucaucagaaacacgccauuaaccaaugaagaacucggaguguucaucaaccgccagcucguagaaacgcggcaaucuacaaaggcaaucaaggaacuguuugaaaaauucuaccaaaaguccaaaauaaucccggucaaagcgucucuagcgucagaccuuagaaaggacaugaacacccugaaaagccgggaggucaacgaccuucaucacgcccaugacgcauuccucaacaucguagcaggagacguuuggaacagagaauuuacuucaaacccaaucaacuaugucaaugaaaaucgcgagggggacaaagugaaauacucgcugagcaaauauuucacacgaccgcgcaagagcaagggcaaaguaaucuggacaccggagaagggacgaaaacuuaucguggacaccuugaacaagcccagcgugcucaucucgaacgaaucgcacgucaagaaaggcgaacucuucaacgcaaccauaucuggcaaaaaggauuacaagaagggcaaaaucuaccuaccccucaaaaaggaugacagacuaaaagacgucuccaaauauggcgguuacaaggcaaucaacggggccuucuucuuccucgucgagcacaccaaaagcaagaaacgaauccgcagcaucgaacucuuuccucuccaccucuugagcaaguucuacgaagacaaaaacacagugcuagacuacgcgaucaacgugcuacaacuccaagaucccaaaauaaucaucgacaagaucaacuaccgcacggagaucauaaucgacaacuucagcuaccuaauaaguaccaagaguaacgacggaucgaucacggucaagcccaacgaacaaauguacuggagagucgacgaaauaagcaaccuaaagaaaauagaaaacaaauauaagaaggacgccauacuaacugaagaagacaggaaaaucauggaaucguacaucgacaaaauuuaccaacaauucaaggcaggcaaguacaagaacagaaggacaaccgacacaauuauugagaaauacgaaauaaucgaccucgacacccucgacaacaaacagcucuaccagcuacucgucgccuucaucagccucagcuacaaaacaucaaacaacgccguagacuucacggucauugggcucgggaccgagugcgggaaaccccggaucacuaaccugccggacaacacuuaccucgucuacaaguccauuaccgggauauacgagaaacgcauaaggaucaaauga

SEQ ID NO: 6494 - RNA, 4047 nt, Artificial Sequence
  Cas9 variant
augaagaaaccuuacacgaucgcccuagacaucgggacuaacuccguagguuggguaguagucacagacgacuaccguguccccacaaagaaaaugaaaguccuggggaacacagaaaggaaaaccauaaagaaaaaccuaauuggcgcacuccuauucgacuccggcgacacagcagaagguacccggcucaaacgcacagcgcggcgacgauacaccagacgcaaaaaccgccuccgcuaccucaaagaaaucuucacugaggagauggccaaagucgacgacggauucuuccagcgauuagaagacucauucuacgucuuagaggacaaggagggaaacaagcaucccaucuucgccaaccuagccgacgagguagccuaccauaagaaauaccccacuaucuaccaucuacgcaaagaacucguagacaacccacaaaaagccgaccuccguuuaauauaucucgcaguagcgcauaucaucaaauuccgcggccacuuucucauagaagggacacugucgagcaaaaacaacaaccuccagaagucauucgaccaccucgucgacaccuacaacuuacuauucgaagaacagcgacuacucacggaagggauuaacgcaaaagagcuccuaucagccgcguuaucaaaauccaaacgccucgaaaaccuuaucucccuuaucccaggacaaaagaaaaccggcaucuucggcaacauuaucgcacuaucccugggccuaacccccaauuucaaagccaacuucggacuuucaaaggacgucaaacuacagcuagcaaaggacaccuaugccgacgaccucgacucccuacuggcccaaauuggcgaccaauacgcugaucucuuccucgcggcaaagaaccugucugacgccauacuccuuuccgacauacugaccgaauccgacgaaaucaccagggcaccccugucagcgucaauggucaaaagauacagggagcaccacaaagauuuagucacccugaagacccuuaucaaggaccagcuacccgaaaaauaccaagagauauuccucgacaagacaaagaacggauacgccggcuacaucgagggacaggugagccaggaagaauuuuacaaguaucucaaaccaauccucgcccggcuagacggaucggagccacugcuccugaaaaucgaccgcgaagauuuccuacgcaaacaaaggacguucgacaacgguuccaucccccaccagauacaccucgaggagcugcacgcaauccuacgucgacaagaggucuuuuacccauuccucaaggacaaccgcaagaaaauagagucccuccucaccuuucgaauaccuuacuacgugggucccuuggcacgaggccacagccgcuucgcaugggugaaaagaaaguucgacggcgcaauacgacccuggaacuucgaagagaucguagaugaggaggcaucugcacaaaucuucaucgagaaaaugaccaaaaaugaccuguaccuccccaacgaaaaaguccucccaaaacacucccugcuauacgaaacauuuaccgucuacaacgagcucacuaaaguuaaguacgccaccgaagggaugacccguccacaauuccuguccgcugaccaaaaacaggccauuguagaccuacucuucaaaaccaaccgcaaaguuacaguaaagcagcucaaagaaaacuacuuuaagaaaauagaguguugggacucagucgaaauuaccgguguugaagacucauucaacgcuagccuagguacauaccacgaccuccucaaaaucauccaagacaaagacuuccucgacaacccagacaaucagaaaauaauagaagauaucauccugacgcucacccuauucgaagauaaaaagaugaucagcaaacgacucgaccaauacgcccaccuauucgacaaggugguacuaaacaagcuagaacgacaccacuacacuggauggggccggcuaucgggcaagcucaucaacggcauacgagauaaacaaagcggcaaaaccauccucgauuuccugaaagcugacgguuucgcaaaucgcaacuucaugcaacucauccacgacucggaacuuagcuucaucgacgagaucgcaaaggcccaagugauaggaaaaacggaauacucgaaggacuuggucggcaaccuugccggaucgcccgccauaaagaagggcaucucacaaaccaucaaaaucgucgacgaauugguaaaaaucaugggguacuugccgcaacaaaucgucaucgagauggcccgcgaaaaccaaacaaccgcacaagggaucaaaaacgcacgucaacggaugcgaaaacuggaagaaaccgcaaagaaacuaggcuccaauauacucaaagagcacccagucgacaacucucagcuucaaaacgacaaacgauacuuauacuaccuucaaaacggaaaagacauguacacaggggacgaccuagacaucgacuaccuaagcuccuacgacaucgaccacauaauuccccaaucguucauuaagaauaacucuauagacaauaaggugcuuacuucccaaggggcaaaccguggcaagcucgacaacguucccucggaagccauaguccgcaaaaugaagggauacuggcagucucuucugagagcaggcgcgaucagcaaacagaaauucgacaaccuaaccaaagccgaacgaggaggccuuacccaaguggacaaggccggguucauccagcgccaacuggucgaaacccgccaaaucaccaagcacguugcccagauccuugacucccgcuucaacaccgaguucgacgaucauaacaagcgaauccgcaagguucauauaauaacgcuaaagagcaagcuaguaucagacuuccggaaagaguucgguuuauacaaaaucagagacauuaaccacuaccaccacgcccacgacgccuaccuaaacgcaguagucgcaaaggcaauacucggcaaauacccgcaacuagcccccgaguucguuuacggagacuacccgaaauacaacagcuucaaagaacgucagaaggcaacccagaaaaugcuauucuacuccaacauucugaaauuuuucaaagaccaagaaucacuccacguaaacucggacggcgaagaaauuuggaacgccaacaaacaccucccaauaaucaaaaacguccuauccaucccccaagucaacauaguaaagaaaaccgaaguccaaaccgggggcuucuacaaagaaagcauccugucaaaaggaaacucagacaaacucaucccccggaaaaauaacugggacacacgaaaauacggagguuucgacagcccaacagucgccuauucugugcuaguaauagcgaaaauggaaaaaggcaaggccaagguauuaaaacccgucaaggaaaugguagggauuacgaucauggaacgcacagcuuucgaagaaaaccccguaguauuuuuagaagcucgcggcuaccgcgaaauacaagaacaucugaucaucaaacuacccaaauacagccuauucgaauuagaaaacggccgacgccgguugcucgccagcgccagcgagcuccaaaaaggcaacgaacucuuucuacccguugacuauaugacguuccuauacuuagcggcgcauuaccaugaacuuaccggcagcagugaagacguccuacgaaagaaauacuuugucgaccgacaccuacauuauuuugacgacauuauccaaaugaucaacgacuucgccgaacgccacauacucgccaguuccaaccucgagaaaauuaaccacacauaccacaacaacucugaccuaccggucaacgaaagagcugaaaacaucaucaauguauuuaccuuuguggcccucggcgccccugccgccuucaaauuuuucgacgcaaccauagaccgcaaaagauacacguccaccaaggaaguccucaaugccacucuaauacaccaauccguaaccggucucuacgaaacaagaaucgaccuaagccagcuaggagaaaacuga

SEQ ID NO: 6495 - RNA, 4047 nt, Artificial Sequence
  Cas9 variant
augaaaucugagaagaaauacuacaucgggcucgacgucgggaccaacucagucggcugggcagugacggaugaauuuuauaauauacugcgcgcuaaagggaaggaucuguggggcguccgacucuucgagaaagccaaaacggccgcggauacacgcacguuccgcuccggccgacgaagaaacgaccgaaaaggagugcggcuccaaauccuccgcgagaucuucgaagacgagaucaaaaagguagacaaagacuucuacgaccgucucgacgaauccaaguucugggccgaggacaagaaaguauccggaaaauacucucucuucaaugacaaaaauuucagcgacaaacaguacuucgagaaauucccuacgauauuccaccuccguaaguaccuaauggaggagcacggcaaggucgauauccgauacuacuucuuagcgaucaaccagaugaugaagaggcggggacacuuccugaucgacggacaaaucagccacguaaccgaugacaagccgcugaaacaacagcugauacuacucaucaacgaccuccucaagauagaacuggaagaagaguucauggacuccaucuucgaaaucuuagccgacgugaacgaaaagaaaacagagaagaaaaacauccugaaagaacuuaucaacgcacaggacuucaauaaacaggaaggaaaaauacuuuacuccauauucgaguccauagucaccggcaaggcgaagaucaaaaacauaaucuccgacgaagacauacuggaaaagaucaaggaggacaacaaagaagacuucguacucaccggcgauuccuacgaagaaaaccuccaguacuuugaagaaguacuacaggaaaacauaacccuauucaacacacuaaagagcgcguacgacuucgucauacuacagagcauacucaagggcaaaagcacccucagcgacgcacaaguagaacgauacgacgaacacaagaaagaccuggaaauccuuaagaaagucaucaagaaauacgacgaggacgguaaacuguucaaacaagucuucaaagaagacaauggaaacgguuacgucucguauauaggcuacuaccuaaauaaaaacaagaaaaucaccgcaaagaagaaaauaucgaauaucgaguucacaaaauacgucaaaggaauccuagagaagcaaugcgacugcgaggacgaggacgucaaguaccugcuaggcaagaucgaacaagaaaacuuccuacucaaacaaaucuccaguauaaacucugucaucccccaucaaauucaccucuucgaacuagacaagauccucgaaaaccucgccaaguacuauccgagcuucaacaauaagaaagaagaguucacaaaaauugagaaaauccguaaaacauucaccuuccgaauaccauauuacgucggcccacucaacgacuaccacaagaacaacgggggaaacgccuggauuuuccggaacaagggcgaaaagaucagaccuuggaacuucgaaaagaucguagacuuacacaagucggaagaagaguucaucaagcgcaugcucaaccaauguacguaucuacccgaagaaacgguacugccgaaaagcucaauacucuacuccgaauacaugguacuaaacgaacucaacaaccuacgcaucaacggcaagccuauagacacagacguaaaauugaaacucaucgaagaacuauuuaaaaagaaaacaaaagugacucuaaagagcauacgcgacuacaugaucagaaauaacuuugcagacaaagaggacuuugauaacagcgagaaaaaccuggaaauaguaagcaacaugaaaucauauauagacuucaacaacauauuaggcgacaaguucgaacucgaaauggucgaagaccugauagagaaaauuaccauccacaccggcaacaagaaacuccugaagaaauacaucgaagaaacauaccccgaccuguccucgucgcagauacagaaaauaaucaaccucaaguacaaagacugggggcgacucagucgcaagcuccucgacgggaucaccgggaccaauauagaaaccggagaaauagacaccguaauaaacuuccuccgaaacagcagugacaaccugaugcaaaucaucggaucacaaaacuauuccuucaacaaugacauagacaaacuuaggaaaaaguacauaccgcaagaaauuagcuacgaaguagucgaaaaccucuacgucagcccauccgugaagaaaaugauuuggcaagugauccgaaucacugaagagauaaccaaagucaugggcuacgaccccgacaaaaucuucauagaaauggcaaaauccgaagagggcaaaaagacaaccaucagccgcaagaauaaacuccuggcccuguacaaagcuaucaagaaagacgaacgcgauagucaauaugagaaacugcucaccggacuaaauaaauuggacgauucagaccuccggucgagaaaacuuuaccucuacuacacgcaaauggggcgcgacauguacacaggggagaaaauagaccuugacaaacuauuugacucgacccacuacgacaaagaccacauuauaccccaaagcaugaagaaagacgacuccauuaucaacaaccucguguuagucaacaagaacgccaaccaaacaacaaagggcaacaucuaccccgugccaaguucaauacgaaacaaccccaaaaucuacaacuacuggaaguaccuuauggaaaaagaguucauaucgaaagagaaguacaaccgccucaucagaaacacgccccuaacgaacgaggaacugggcggguuuauaaaccgccagcuagucgaaaccaggcaaucaaccaaggcaaucaaagaauuauucgaaaaauucuauaagaaauccaaaaucauacccgucaaagcgauacuggccucugaccuacgcaaggacaugaacacgcuaaagucgcgggaaguaaacgaccuccaccacgcccacgacgcauuccuaaacauaguagccggcgacguguggaaccgugaguucaccagcaauccgaucaacuacgucaaggagaaccgggaaggagacaaaguaaaauacagcuugagcaaauauuucacuaggccccgcaaaagcaaagggaaagucaucuggacgccagagaagggccgaaaacucauaguugacaccuuaaacaaaccuagcguucucaucagcaacgagucucacgucaagaaaggagaacucuucaaugcgacaauagccggcaagaaagacuacaagaaaggcaaaaucuaccucccccugaagaaagacgaucggcuccaagacguaucaaaauacggaggcuacaaggccauuaacggcgcauucuuuuuccuuguggagcacaccaaaagcaaaaagagaaucagaucaaucgaguuauucccucuccaucugcucucaaaguucuaugaagacaaaaacacaguguuagauuaugccaucaacgugcuacagcuacaggaccccaagaucaucaucgacaaaaucaacuaccgcaccgaaaucaucaucgacaacuucagcuaucucaucagcacgaagaguaacgacggaagcaucacugucaaaccaaacgagcaaauguacuggagagucgaugagauuuccaaccucaaaaagaucgaaaauaaauacaagaaagacgcgauccucaccgaggaagaccgcaaaaucauggaaagcuacauagacaaaauuuaccaacaguuuaaagccggcaaauauaaaaaccgccgaacaaccgacaccauaauagaaaaguacgaaaucaucgaccuagacacguuagacaacaagcaacucuaccaacuacucgucgcauucauaucgcugucguacaaaaccucgaacaacgccguagauuucaccguaauuggccugggcaccgaaugcggcaaaccgcgcauaaccaauuugcccgacaauacauaccuaguauacaagucaaucaccggcauauaugagaaaaggauacgcauaaaauga

SEQ ID NO: 6496 - RNA, 4047 nt, Artificial Sequence
  Cas9 variant
augaaaagcgagaaaaaguacuacauagggcuagacguaggcaccaacagcgucggaugggccgucacagacgaguucuacaacauucuacgggccaaaggaaaagaccucuggggagugcgacucuucgaaaaggccgauacagccgccaacacgagaauauucagauccgggagaagacgaaacgaccgcaaaggcaugaggcugcagauauugcgagaaauauucgaagacgaaaucaagaaagucgacaaggacuucuaugacagacuagacgaaucaaaguucugggcggaagacaagaaaguauccggcaaauacagccucuucaacgacaaaaacuucuccgacaaacaauacuucgaaaaauuccccacaauauuccauuugcgaaaauaccucauggaggaacacggaaaagucgacauccgguacuauuuccuagccaucaaccaaaugaugaaacgaaggggacacuuucucaucgauggacagaucagucacguaacugacgacaagccccucaaggaacaacucauccuccugaucaacgaccucuuaaaaaucgagcuagaagaggaacucauggacuccaucuucgaaauacuggccgacgucaacgagaaaagaaccgacaaaaagaacaaccuaaaagaacuaauaaaaggccaggacuuuaacaaacaagaaggcaacauccugaacagcaucuucgaaagcaucgugaccggcaaggcaaaaaucaagaacauaauaagcgacgaagacauacucgagaaaauuaaggaagauaacaaggaagacuucguacugaccggagacagcuacgaagaaaaccuacaauacuucgaagaaguccuccaggaaaacauaacacuauucaacacccuaaaguccacauacgacuuccuaauccuucaaagcauacuuaaaggcaaaagcacacuuagugacgcacagguggagcgauaugaugaacacaagaaggaccuagaaauccugaagaaaguaauaaagaaauaugaugaagacggcaaacucuucaaacaaguauucaaagaggauaaugggaauggcuacgugagcuacauuggcuacuaccucaacaaaaacaaaaagaucaccgcgaaaaagaaaauaagcaacaucgaguucacgaaguacgugaaaggcauacucgaaaagcaaugcgacugcgaagacgaggacgucaaguaccuucugggaaaaaucgagcaggaaaacuuucuucuaaagcaaauaucgagcaucaacuccgugaucccccaucaaauacaccuguucgagcucgacaagauccuagaaaaccucgcgaaaaacuacccuuccuucaacaacaagaaagaagaguucaccaaaauagaaaagauacgaaaaacauuuacauuccgcauacccuacuacgucggaccccuuaacgacuaccacaagaacaacggcggcaacgccuggauauuccgaaacaaaggcgagaaaauacggcccuggaacuucgaaaagaucguagaccugcacaaguccgaggaggaguucauaaagcgcaugcucaaccaaugcacauaucuccccgaagagacgguacuucccaagagcucgauacuguacuccgaguacaugguccuaaaugaacucaacaaccuccgcauaaacggcaagccccuagacacugacgugaagcucaagcuaauugaggaacuauuuaagaagaaaacaaaagucacacuaaaaucaaucagggacuacaugguccgaaacaacuucgccgauaaagaagauuucgacaacucggagaaaaaccucgagaucgcuagcaacaugaaauccuacaucgacuucaauaacauccuagaagacaaguucgacgucgaaauggucgaagaccuaaucgagaaaaucacgauacacacgggcaacaagaaacuacucaaaaaguacauugaggaaacguaucccgaccuaagcucaagccaaauccagaagaucaucaaccuaaaauauaaagacuggggacgacugucccgcaaacugcuagacggcaucaaaggcacaaagaaagagacugagaaaaccgacaccgugaucaauuuccuaagaaacucguccgauaaucuuaugcaaaucauaggcucccagaacuacucuuucaacgaauacaucgacaaacuccgcaaaaaguacauaccacaagagauaagcuacgaggucgucgagaacuuguacgugucccccuccgugaagaaaaugaucuggcaagucauccguguuacagaggagaucacaaaagucaugggauacgaccccgacaaaaucuucauugagauggcaaaaagcgaggaagagaagaaaacaaccaucagcaggaaaaauaaacuacucgaucuauacaaagcaaucaagaaagacgaacgggauucccaguacgaaaaacuccugaccggccuaaacaaauuggacgauagcgaccuccggucccgcaaacuguaccucuacuacacacaaaugggccgagacauguacacgggugagaaaaucgaccucgacaaacucuucgauucaacacacuaugacaaagaccacauuaucccccaaucaaugaagaaagacgacuccauaaucaacaaccucgugcuagucaauaaaaacgcgaaucaaaccacaaagggcaacauuuacccagucccaagcagcauccgcaacaacccaaaaaucuacaauuacuggaaauaccucauggaaaaagaguucauauccaaggaaaaauauaacagacuuaucagaaacacaccacucacgaacgaagaacuagggggauuuaucaaucgccaacuugucgaaacccgccaaucgacaaaggcuauaaaggaacucuucgagaaauucuaccagaaaagcaagauaaucccagucaaagcaagccucgccucggaccugcgaaaagacaugaacacucucaaaagcagggaaguaaaugaucuccaucacgcacacgaugcguuccugaauauagucgccggagacguguggaacagggaauuuacaagcaauccgauaaacuauguaaaggaaaaccgcgagggcgacaaggucaaauacagucucagcaaggacuucacgcggccgcgaaaauccaaagguaaagucaucuggacacccgaaaagggucgcaaguuaaucguagacacucucaacaaaccgucaguccucaucucgaacgaaagccacgucaagaaaggcgagcuguuuaacgcgacgauagcaggcaagaaagacuacaagaaaggcaaaaucuaccucccacugaagaaagacgaccgccuccaagacgugucuaaauacggaggauacaaagccaucaacggagcauucuucuuccuuguagagcacaccaaauccaagaaacgcauccgcagcaucgagcuauucccgcuacauuuacucaguaaauucuaugaagacaaaaacacagugcuggacuacgcaauuaacguccuccaacuucaggaucccaaaaucaucaucgacaaaaucaacuaccggacugaaaucaucaucgacaacuucucauaccuuauauccacaaagucuaacgacggaagcaucaccgucaagcccaacgaacagauguacuggcgcguggacgaaauaucaaaccucaagaaaaucgagaacaaauacaagaaagacgccauacugaccgaagaggaccgcaaaauuauggaaagcuacaucgacaaaaucuaccaacaguucaaggcaggcaaauauaaaaaucgccgcacaaccgauacaauuauagaaaaauacgagauaaucgaccucgacacucuugacaacaaacagcuauaucagcucuugguagcguucauuucgcuauccuauaagaccaguaacaacgccguagacuucacugugauuggccugggcacagagugcgguaagccccgcaucaccaaccugccagacaauaccuaccucgucuacaaaucgauuacggguauuuacgaaaaacgcauccggaucaaguga

SEQ ID NO: 6497 - RNA, 4047 nt, Artificial Sequence
  Cas9 variant
auggaaaagaauuacuaucucggacuggaucuuggaucgaacuccgucggcugggcagcaacagaugaagauuacaacuuccuacgacucaagggcaagacagcauggggagcccgcaucuuuuccgaggcgaaagauugcaaagaaaggcgaaccuaccggucuaacaaaagaagacucgcacgucgcaaauacagacugguucuccugaaacagcuguucgcggaggaaaugacuaaggucgacaagaccuuuuuccuacgccucgccaacuccaccuacugggaggaggauaaaacgaaagacagcgacggcaaugaaaucgggaaaaaccucauauuuaaaacccacgaagaagagaaacaauacuacaccaaguaccccacgauauggcaucuccggaaagcccucauugaaaacgacgaggaagcucuaagcaaucugcgguacguauaccuugcaauccaccauaucguaaaauaccgcgguaacuuccucacagagggcgaaauggguaaugacaucccgccuaucacaaccaucgaagagaucaaccagacguugagcuugcucgaagucgacucguccgaagacgccacagauaaaacaacauauauaaaacccgaaagcuauaaugaacucuucacgauccuugaaaacaacaaccugaacaagguuaagaaacaacaagagaucgacaaacuguucaucagcuccaaagagcggucagaaaauaucaaaaacuacauaaaccuuuucaaaacaaucaucgucggcggguccuucucccugaagaaaauaaacgaagauacugaagacauauccgucgacuucaccaaagauuuugaaaacuccgaagcagacauaucaaaagcacucggggacagcuucaaccucguccuaaucgccaagaaauacuacgauuacaucauccucaaagaacuacuaggcaaaaacaaggaaauaucagaagccaugguacaaaucuacgaagaacacaaagacgaccucaagucccuaaaaacuauccuaaaggaccucgacaacaagcuaggaaacgaugguaaagaccgcaucuacuacagcguguucaaacaagagcccacggagaaauucaaggaaaccaauuaccuauccuucguccaaggcggcaaacuggaggaacucaacaaauacaucaagaaaauacucgagaacaacgagaaagauaucgaugacaaagagaccuacaacgcccucuacgaaaaagccugcaaaggcgaucuauucaagaaacaagcuaacgcgugcacgagcuuaauuccccaccaauuccaccuccgcgaguuaaagaaaauacucgaaaacgccggacggaaauacaguuuccuaaacgacauuuccgacaaaaucauaaaaaucuucaaauuucgagucccauacuacuacggaccccuaaacaacgaaaguaacgcccacuccuggguaguaaagaaagaagggcaagaaaaagcuaaaaucacaccauggaauaucaacgaaaucaucgacaccccaaaaacucgggacaacuucuuuaagaaacuaaccaacagcugcacguaccuagucggcgaaacaguacuccccaaaacuucccuauauuacgaaaaauaccuaguccuggaucggcuaaacaagaugcaggucaacggagacuaccuuuccgccagcgaaaagaaugauguacuaaaguuuauacuguccagaaagaccaccaccaucgagcaaauacgcacauaucuaaguaaaaacaaaagcaccaaggcuaacgacaucucuaucuccaacauaaaagccaccgauccauucaacgcagugagccacgcauucuacgggaagcacccagaucucaacauaaaccugugcgaagaacucaucaaauucgccacgaucuacgccgacgacaagaaagagcucaagaaauuuguauccucaaacuucaaccugacggacgaguucaucaaagaauacuuaaacacccccaccaacaaaugggggagacuuagucgcaaauuccucugcggcggagaccaacuggaaauguacuacguugacgacaacggcauacuacacuccauacuaaacauacuggaagagaccaacgaaaacuugcaagaaauccucaacaacgagaaauacggguucaaccagaaaaucgcagacuucaacaauacacucaccgccgacaagacuaccgaagaacaaaucgaagacauccuagacuccaccccagcucucaugcgacgaaguauaauccaaacacuggccgucguggacgauguaauaaaggcagccgguaaggcaccccagaaaaucaugauggagguuacccgcacagacggcaagaaagaagaaaccaaaucacgcuaugugcaacucaagaaacaaauaaccaaugacaaaguccucacgucagaugagaagaaagaacuccuaacaaaccuggagaauaagaaaauccaacuaaaaggcaaacacaucuaccuauauuucaugcaaaugggcauagacuucuacaccggcaagaucauggacauuaacgacgugauuaacggaaaguacgacaucgaccacauaaucccgcaaucuaugauaaaagacgacagccucgacaacaugguacuggucagcaaagacuacaaccaaaaagucaagaaagacaucuacccgauuugugacgagaucaggaacaacaugcuggacaaauggaaaggauauuacgcccgcaagaucauaucagaagaaaaauacaaccggcucaaacgaaccaaggagcugaacgccgaugaaaucaacgccuucauaaaucgacaaaucaacguagucaacuacagcaacauccagaucaaacgaauauucgaaaucaaauacccggagacuaagauaaucuucucgaaggccagcuuccccucccuccuccgcaaagaauacgagaucgcaaagaugcgagaccuaaacgacgcgcaccaugcuguggacgcguaucucaauaucgugugcgggaacauccuaaccacgcucuacacugacaucuucuacauguucaaagagaagaaggaagaccauaaaaacaucagcuucaacauggagaaaaggcucauaaacuauauugacaaaaacaaucuuaaagacaaaauaaaaaccuccugucuuaggcacgaugcccucauaaccuauaaaccugacuacgacagcggcaaauucuauaaggaaacuaucuucaagaaguccggcgauaaagaaaccggccucauuccacuccacacgaaagggcccauguccgauaccaaaaaguacggcgguuacagccaauuaucacaguccuacauaauugccgucgaauacaagcucaagaacaagaccgucaagaaacugugccgaguccccacauuauaccuuaaacaguacaaaaaugaccuuaacaccaucgccaaaauaaugaucgacgacgaaaaagccaccgacaucaaaguccuccgaaaaaucuauuuaaaccagaagauccgcuacaacggaugcuacuaccucauauacaccuccaaagaaaagcaaaacaaguauaaaauggcauaccagaacuaccuugacaacgacuaucucauauauuugaacaagugccugaagaaaauagacgagcucgaugacggcgaguugacaucacaagaguucauagugaacaaggacggcgacaaguucuuaaucgacaagaaccacaaccucgagaucuucaaauccaucaaagagcaauacaacaagaccaucuacgacuacacccccuacaucguacagucacgagagaugaaggaggaagauuucaacaaccucagccuuaagaaacagaucgacacccuccuaaacaugaucaaaauccuuaguagaucaaacgaacaagccaaauucgagacagcauucuucgagaacuucaccaaagucuuccucaaaacuaugaccaucaccaacgagaaagucuacaucgugaacgagagcccauccggccuauucaagggcaaagaggaacucaucuga

SEQ ID NO: 6498 - RNA, 4047 nt, Artificial Sequence
  Cas9 variant
augaaaaaguucgaagacuacuaccucgggcuagaccucgggaccucgucaaucgggugggcugucaccaacgagaaauacgacauccuacguuuuaacaagaaauucaugugggguacacaccucuucgacaugggaaacacggccagcgaacgcagaaucuucaggaccucaaggcggagacucaaacggaagaaaaacagaaucgaacuccuccaaacccucuucuccgccgaaaugagcaagaaagacuucggcuucuuccaacgacucaaagaaucccaauacuucauagaggacaagacauucaaaaacaagaacacacuguucauggacgagaacuacacagaccaagacuaucauauggaauaucccaccauauaucacuugcgcaaagcgcucauagacaacgaggaaucagccuucgaaauaagaaaacuguaccucgcaaucagccauauacucucccacagaggccacuuccuguucgagggcgagcuauccgacaacuuagauuucgacgacaucuucaacgaauuugugaaguaccucaacgaagaacugaacaucgacuuuaaaaucaaaucagauguaucucugcaagcgauaaaagagauccuaacagacaagaugcucaaccgcacaaagaagaaagagaaacuuucugaauugcucgaagaggagaagaacaaaaucuaccaggaaaucuggaaacugcuugucggcaaugaagccaagaugucaacaaucuucgacgacaaggaguacgaggaggccaagauagcguucucgaagggcaacuacgacgagaaggaagaggaauacgaaucaauucucggagaaaagauccuauucguccagaaagccaaggccaucuacgacuggaugcugcuccaaaacauacuaaaagaagacaaauaccucaguuacaguaaggugaagcucuacaacgagcauaagaaagaucucaagauccucaaagacguacuaaagaacuuagacaagaaaauauauaaagaaaucuuuucugaaaacggccuuuaugaagaauacuuacgaauagaaaagaagaaaaucggaucaaaagaagagaaaaccaaagacaucuuauacaaccgacugaagaaaauauucgaaaaccgagacaacauggcuauugaagacauacucaacaaaaucgagcuggacagcuuccucccaaaacagaagaucaaagauaacggaguaaucccgcgccaaguccaccagaaagaacuagaaauaauccugaagaaugccgaaaaauacuucaaguggcucaucgaaaaagacgaaacgggccucuccgucagcgagaaaaucaugaagauauucaaguucaagauaccguacuacguuggcccccuaaauuccaaaaguccauucgcuuggauagaacgaaaggaauacggaaaaauucugccguggaacuucgaaaauauggucgacaugaguaagacagcggaaaaguucaucaagaggaugacaaacaaaugcacguaccuccccgaaaaagacguuauccccaaaaacucacuacuauacaccaaguauauggugcugaacgaacucaacaaccucaagauccgcggcgagaagauaaaggucgagcuaaaacagaagauauacacggaacucuuccaaaagaauaagaagaucgggaugaaaacgcugaucgaguuccucaagagccaaaacaucguggucacaaaaguggagaucacuggcaucgacgggaccuuuaacacaagccucggcagcuauauagacaugaaaaagaucuucggagaagagaaaauaguaaaagacagcuacaaaaagaugaucgaggacaucauucuguggauaacccucuacggcgaggaaaagaaacugauaaaaucuaagauagaggagaaauacccagaaaaagugacaccggaagaaaugaaguuaauccugaaacuaaaguaccgggacuggagccgucucuccaaggaguuccugacggagauagaaacuauggaugaggaaacaggcgagcuuauaagcauaaucgagaugcuauggcggaaaaacgaaaacaucauggagcuucugucuuacaaauaugauuucaguaacaggauaaaggaauacaacggaaucaacgaaaaggagaaaaacauaacauacgaggaucuggucaaagaccugcagauaagccccucgguaaagaaaaugaucuggagggcacucgucaucgugaaagagaucaagaaaguuaccaacaaauccccaaagaaaguauucauagaaauggcucgcgacacgcaaaccgagaagaaacguaccgagaaaagaaaagacaaacuacuagaacuauacaaaaacaucaaaaacgacgacucgauuaaggaauuagaaaagaaccucaaagacaaaacgaaugacgaccucaaaucuaagaaacuauaccuauacuaccuccagcugggccgcugcauguacagcggggagguaauacgccuggaggaccuaaugaacgacaaucuguacgacaucgaccacauauauccgcagagcaaaaucaaagaugacagcuucgacaacacugucuuagucaagaaacagaucaacgcagacaaaaccaacgaauacccuaucgacaaauccauccaaaacaaaugcaaagccuuuuggacgagccucaaagaacggggacucaugucuaacacgaaauacgaacgccucaccagaaccgaagguuucagcgacgacgagcucgcaggguucaucagccgccaaauagucgagacccgacaagcaacaaaaguccucgccgaccuacuaaaggucauauuuggcagcgacaccaggauuguauacguaaaagccggucugacguccgacuucagacagaaguucggcaucuacaaauuccgagaacugaacgauuaccaccacgcacaugauggguaccugaacauagucacagggaacaucuacaacacgcuauucacagacaacccguacaacuucaucaaggacaggaaaaaggacaaccgaaccuacaaucuaaacaaaguguuugaacgcgaaaacgacgucuggaaccccgacguaaugcucuccaagaucgagcgcuacaucuacaagaucagaccccucuucacccgugcauccuacgagcaaaaaggcggauucucggaccagaauaucagcuccgaaaaggauaagcucaggccgcucaagagcucuggugugcuguccaacaucaaguacgguggauacgacaaaauaaagaacuccuacuucuuuauagucgaguacaccgagaaaaagaaacggguacgaucaaucgaaacccugccgaucuacaucaagaaaucaaucagcacgaaagaagaccucgaaaaauacugcaaagaagaacuaaaguugcaagagcccaaaguacuggucucaaaacuaaacuauaaauccuugaucuacucaaacggccacgaguacuacaucaacuccaagacggccgauucuaucacgauacagaauggcauccaaauaauacuaacgaaagaaaacuacgaaacuuaccgaaaaaucuacaaaaaccuggaauaccuaaagcuaaucuauaaagacgagaagauccgcgaggagaagauccuggaaaagauacccaaaauacugaagaauaacaagaacgaccgagaccuaagcgaagacgaaauauccgaaaaguucuggaaacuauacaaagagaucuuugaaaagaucaaaaucggcauuuucucaaaauucaagagcacacuccccauauacaucgaggacugcaagaaacucaaagacuucaccacccuaaacaacuaugcaaaaucccguuucauccaagaaauauugaaaugccucaacagccaacagggcgaauuugacacuaaguacacacacaacuacagcaagaaauacaacaccaaacugagcaaaucgaaaauacuagaaaacgacuucuacaucauaaaucagucuccgaccggacuauucgagaagaaaguguuccuugacaaauga

SEQ ID NO: 6499 - RNA, 4047 nt, Artificial Sequence
  Cas9 variant
augggugaggacgggaaaccccuucgagucaaaggaaaaaccgccauaggcgcccgccuauuucaggaagggaaccccgcggcugacagacgcauguuucgaaccacacgacgacgucucaaccgccguaaguggaggcuaaaacuacuggacgaaauauucgaucccuacaucacaccaguagacagcaccuucuucgcacgccucaaacaaucgaaucuaucgccaaaagacagccgaaaagaguucaaaggcucaaugcuguuccccgaccuaacugauaaacaguaccaccucgacuacccuaccaucuaccaccucagacacgcccugaugacacaagacaaacaauucgauauacgaaugguauaccucgcuauucaccacaucgucaaauaccgaggaaacuucuugaacucuaccccaguggacagcuucaaagcaucaaaagucaacuucgaugaccaguucaagaaacuuaaugaacucuacaccgccaucaacccagaggaauccuuccaaauuaacuuagccaauagcgagaaaauaggccaacaauuccucgaccccucaaucaggaaauucgacaaaaagaaacagaucccgaaaaucgucccugucacuauggacgacaaagccguagacaaacucaacggcaaaaucgccagcgagauaaucaacgccauccuaggcuacaaaucgaaacuggacguugccgugcaaugcgaccccgaggacagcaaccccugggcugucaaauucgaugacgaggauaucgaugccaaacuucagaaaauauuacccgagauggacgaaaaccagcaauccauuauaggaaucauucaggaccucuacucgcaaguaacauugaaucagauaguccccaacggcaugucccuguccgaaucaaugaucaaaaaguacaaugaccaccaugaccaccuaaaacucuacaagaaacucauugggcaaaucagcgacucuaaaaagaaaacugcauuaaagaaagcauacgaucaguacgucggcaacgauggcaaagugaucgaacaggacgacuucuacucauccgucaaaaagaacuuagacgacagugaacucagcaaacaaaucauggaccucauagacgccgacaaguucaugccuaaacaacguaccucccaaaauggcgugaucccccaccaacuccaccagcgcgagcuagaugaaauaauagagcaccaauccaaauacuaccccuggcucgccgaguccaaccccaacaaacacgacuuacaccucgcaaaauacaaaauagaagaacucguugcauuccgcauuccuuacuacgucgguccaaugaucaccccagaagaccagaaaaagucaggagccgccguguuuagcuggaugaaacgaaaagaaccgggacaaauaacccccuggaacuucgacgagaaaguagaccggauggaauccgcaaacaaauucauaaagcggaugacaaccaaagacaccuaucucauaggagaggacgugcuaccagacgaaagccuccuguacgaaaaauucaagguccugaaugagcucaacauggugcgagucaacggcgauuccuuaaaaguggcagauaagcaagccauauaccaagaccucuucgaaaacuauaaacacauaagcgucaaaaagcuccagaacuacauaaagggcaaaacgggacuaccuaacaacccggagauaagcggccucagcgaccccgaccaauucaacaacagccuaggcacguacaacgacuucaagaaacuauucggagauaaaguagacgaccccgaccugcaaaaugacuucgagaaaaucguggaaugguccacagucuucgaggacaagaaaauccucagggccaagcucaacgagaucaccuggcuaacggacaaacaaaaagacgaccuagaauccagccguuaccagggcuggggccgucucagcaagaaacugcuaaccggcaucguaaacgaccagggcgaaagaauaauagacgaacuauggaacaccaacaagaacuucaugcaaauccaaagcgaugaugacuucgcgaaacgaauacacgaagcuaacgcagaccaaaugaaaagcacaaacauggaagauguccucgccgacgcuuacacaucaccccaaaacaagaaagcaaucagacaaguggucaaagucgucgacgacauccaaaaagcaaugggugggguugcacccaaauucauauccaucgaguucacacgaucagaggacagaaacccccgacgcaccauaagccgacaacgacaacucgaaaacacacugaaggacacagccaagucucucgucaagagcaugaacccaaacaucuuaucagaacucgacaacgcgaguagguccaagaaaggccucaccgaccgccuauaccucuacuuuacacaacucggaaaagacauguauaccggggaaccgaucaacauagacgagauaagcaacuacgacauagaccacauacucccacaggccuucaucaaagacgauucacuauccaaccgaguccuaguaucgaaagcgguaaauaacggaaaaucagccaaugucccacucaaacucuucggggccaaaaugggacacuucuggaagcaacuggccgaagcaggacuaauuaacaaacacaagcucaagaaccugcaaacuaauccagacacaauaucaaaauuugcaaugcacggguucauucgccgccaauuaguugagacaucacaggugaucaaacuggucgcgaacaucuugggggacaaauaccgcaacgacgacacaaaaauuauagagaucacagcucggaugaaucaccaaaugcgagaugaauuuggauucaucaaaaaccgcgaaauuaacgauuaccaccacgcguucgacgcauacuuaacagccuuccucggacgauaccucuaccacagguacauaaaacuacgaccguacuuugucuacggagacuucaagaaauuccgagaagacaaaguuacaaugagaaauuucaacuuucuccacgaccucaccgacgacacacaggcgagaaucgccgacacggaaaccggggaagugaucugggaccgagagacaucaauaaaacaacuacgggacguauaccauuacaaauucaugcuaauaucccaagaggucuacacccugagaggugccauguucaaccaaaccauauacccagcgagccaggccggacgaaagaaacucauuccgaugaaagcggacaaaccggucgacgucuacggaggguauuccggcagcacagacgcuuacauggcaauaguccgcauccacgacaagaaaggagauaaauacaaggucgucggaguccccaugagagcgcugaaccgccuuaacacggcgaaaaacguaucagacgcaaaauacgaccaggagcuaaaggaaguacuuacgccccaguuuaccaaauccaaaaagaaccgaaaaacaggcgaaaucacccaaacgguagaagacuucgagguaguacugggcaaaguaauguauagacaacucguaaucgauggagacaagaaauucaugcuaggaagcuccacauaccaguauaacgcaaaacaacucgugcucucggacgaguccaucaagacccuggcauccgaaggcaaacuaaacgaagcacaagaaagcgcagccuacgauaaaguuuaugaugaaauccuagacaaagucaacaaauacuucgcacucuacgauacaaacaaauuccgucaaaaacucucccucggaaaagacaaauucgucggacuacccaaccacaacguguucgacggcucaaagaaaauaucuucugggaaacgggagauacugaacgaaauccugaauggacuccacgcaaacgccacccucggcacccuaagcgauaucggcuuuuccaccccauucggcaagaugcaacagccuagggguauuggacucagcagcaacaccagcauagaauacgagagcuucaccggccuauucaaaagaaccauauuccucaaagaccuuuga

SEQ ID NO: 6500 - RNA, 4047 nt, Artificial Sequence
  Cas9 variant
augaagaaacccuacaccaucgcccucgacauaggcaccaacagcgucggcugggugguggucaccgacgacuaccgaguacccacuaagaaaaugaaaguacucgggaacaccgaacggaaaaccaucaaaaagaaccugauaggagcccuacucuucgacucaggggauacagccgagggcacccgacuaaagcgcaccgcgcgcccucgcuacacccgcagaaagaacagacuuagguuucuaaaggagauuuuuacagaagagauggccaagguggacgacggcuucuuccagcggcuagaggacagcuucuacguacucgaagacaaagaaggcaauaaacaccccauauucgccaaccuggcggacgaagucgcguaccauaaaaaguacccaacgauuuaccaucugcguaaggagcuagucgacaacccccaaaaggcagaccuucgccucaucuaucucgcgguagcgcacauaauaaaauuucgaggccacuuccuuauugagggaacacucagcucgaagaacaauaaucuccaaaaaucauucgaccaccuaguggacacauacaaccuacucuuugaggaacaaagauuauuaacagaagggauaaacgcaaaagagcuccuuucagccgcuuugucgaaaagcaaacgccuagagaaccuaauaucccucauucccggacagaaaaagaccggaaucuuugguaacaucaucgcgcugagucuaggacuuaccccaaacuucaaggcaaacuuuggccucagcaaagaugucaaacugcagcucgcuaaggacaccuacgcugacgaucuugacucucuacuagcccaaaucggcgaccaauacgcagaccuauuucuagcagccaaaaaccucucagacgccauccuccucagugacauccucacggagucagacgaaauaacccgugccccgcuuuccgcuagcauggucaagcgcuaucgggaacaucacaaggaccucgucacgcucaagacacucaucaaagaccaacuuccagaaaaauaccaagaaaucuuccucgacaagacuaaaaacgguuacgcuggcuacaucgaagggcaaguaucacaggaagaguucuauaaauaccuaaagccaauccuggcgagacucgacgggagcgaaccacugcuacugaaaaucgauagagaggacuuccuccgaaaacagcgcaccuucgauaacgggucaaucccccaccagauccaccucgaagaacuacaugcgauccuuagaaggcaagaagucuucuauccauuucugaaagacaacagaaagaaaaucgaaucucugcuaacauuccgaauccccuacuauguaggcccccuagcacggggacacagccgauucgcaugggucaaacgcaaauucgacggagcuauccgcccuuggaacuucgaagaaaucgucgacgaagaggccucggcccaaaucuucaucgagaaaaugacaaagaacgaccuuuaccuccccaacgaaaagguccuuccgaaacacagccuacucuacgagacauucacugucuacaacgagcugaccaagguaaaauaugcaaccgagggaaugacgagaccgcaauuccuaucagccgaccagaaacaggccaucgucgaucugcuguuuaaaaccaacaggaaagucaccgucaaacagcuuaaggaaaauuacuucaagaaaauagagugcugggacucagucgaaauuaccggagucgaggacaguuucaacgcuucccuaggcacauaccaugacuuacucaaaaucauucaggacaaagacuucuuagacaacccugauaaccagaagaucaucgaagacaucauccucacacucacgcuuuucgaagacaagaaaaugaucagcaaaagacuggaccaauacgcgcaccucuucgacaaaguagugcuaaacaaacuagaacgccaccacuacaccggauggggccgacuaucaggcaaacugauaaacggaauccgagacaaacagagcgggaaaacuauccuggacuuucuaaaagccgacgguuuugcgaauagaaacuucaugcaacuaauacacgacucggaacuauccuucaucgacgagauagccaaagcucaaguaauaggcaagaccgaguacucaaaagaccucguuggcaaccuagcggggagcccugcgaucaaaaaggggauuucgcaaaccauaaaaauagucgacgaacuggucaaaaucaugggcuaccucccgcagcagauagucaucgaaauggcccgcgagaaccagacgaccgcccagggaaucaaaaacgcccgacaacggaugcguaagcuggaagaaaccgcuaagaaacuaggaucuaacauccucaaagaacaucccguagacaauucccagcuacagaacgacaaaagguaccuuuacuaccuucaaaacggaaaagacauguauaccggcgacgaccucgacauagacuacuuaucaucuuacgacauugaccacauaaucccccagagcuucaucaaaaacaacagcauagacaauaaggucuuaaccagccaaggagccaacagaggaaaacuagacaacgucccaagcgaagccauaguccgcaaaaugaaaggauacuggcaaucgcugcuacgcgccggagccauuuccaagcaaaaguucgacaaccugaccaaagcagaaagaggcggccuuacccaaguagauaaggcugguuuuauucagcuucagcuagucgaaacccgacaaauaaccaagcacgucgcacagauccucgauucacgcuucaacaccgaguucgacgaccacaacaagcggaucagaaaagugcacaucauuacucucaagagcaaacuuguaucagacuuccguaaagaauuugggcuguacaaaauccgcgacaucaaccacuaccaucacgcacacgacgccuaccucaacgcagucguagcaaaagccauccuuggaaaauacccccaacuagcgcccgaguucguauacggggauuacccuaaauacaacucuuucaaggagcggcagaaagcgacacaaaagacacucuucuacagcaauauccuaaaauucuucaaagaccaggagucccuccacgugaacucagacggcgaagaaaucuggaaugccaacaagcaccucccuaucaucaagaacguccucucgaucccccaaguaaacaucguaaagaagacggagguccagacgggcggcuucuacaaagagucgauccucucgaaaggcaacagugauaagcugaucccgagaaagaacaauugggacacacguaaauauggaggcuucgacucccccaccguagcguacuccguacugguaauagcaaaaauggaaaaaggaaaggcgaagguacuaaagccaguuaaggaaaugguaggaaucacaauuauggaacguauagccuucgaggaaaaccccgucguguuccucgaagcuaaaggcuaccgggagauacaagaacaccugauaauaaaacuccccaaauacagccuauucgagcuggaaaacggccgacgucgucuccuggcgagugccuccgaacuccaaaaaggcaacgaacucuuccugcccgucgacuacaugaccuuccuauaccucgcagcacacuaccacgaacuuacgggcagcucagaagacguccuccgcaaaaaguacuucguagaacgccaucuccacuacuucgacgacaucauacagaugaucaacgacuucgcagagcgccacauacucgcgaguucaaaccuggagaagaucaaccacaccuaccacaacaacagcgaccuucccgucaacgagcgcgccgaaaacauaauaaaugucuucaccuucgucgcacucggugcgcccgcggccuucaaauucuuugacgccaccaucgaucggaaacgguacaccuccacgaaggagguccuaaacgccacccugauccaccagagcgucacuggccucuacgaaacgcguaucgaccucagucagcugggcgagaauuga

SEQ ID NO: 6501 - RNA, 4050 nt, Artificial Sequence
  Cas9 variant
augaaacaaaaauucuacguaggauuggacaugggcaccgcgagugugggcugggccguaacagacgacaaguacaauauaaucaaacgacacggcaaagcucuuugggguguccgacucuucaagaccgccaacaccgcagaggaaaggcguaucuuuagagccgcacgccgcaggacgcaaagacgcaaacagaggauggaacugcuacaggagauauuuggcgacgaaauaagcaaaacggauaucggauucuaucaacgaaugaaagaaagcaaauacugguuugaggacaaaagggacauaaacggaaaacaaccggagcuccccuacgcgcuuuucgucgacgacggauucacggacaaggacuaccacgaacaauuuccaacaaucuuccaccucagaaacguccucgucaacgaauggacucaaaaguaugacaucagacugguguaccuagcuauccaccauauaauaaagcaccgaggccacuuccuguuugaggggaaaaagaugagcgagguaacggacuucggcagcgccuucgaggcuuucuguaaggucgcaucagacaacgacaucgaaauaaccgucgacgaagaaaaacuaaaagacauagaagaccuacucaagucacgacaaaagagcaaaaccgcaaagaagcaagaacugggcaaaauaaucgcgggggcagacaagcagaaaaaggcccuagcagcccuaguuacgggaugcauggucaaacugagcgaaauauucgcggacaagagccuagacgauggcgagcgaaacaaaauuagcuucgcggacagcaacuacgacgaguacauagcaaacguugaagaaacccuggccgagcgauuccuccuaauagcggcaggcaaagcgcuguacgacugggcaguccucagcgacauccuagaaggguccacauacauaagcgaggccaaagugaagauauacaaaaagcauggcgacgaccuccgaaaacuuaaggggcuacugaagacaagacccgacgaauacaagcucaucuucggccuccccgaaaagcaagcaaacuacagcgcauacaucggcaugguaaagaaaaacggaaagaaaguccccauagacaagaaaugcacaaaagcugacuucuacagcuuccugaaaaagacuuuaaacaaaauuaauuucgaagaugaaaaagagcgcgagaucgcggaauccauuauaaacgagaucgaaaacgagacauuccucccgaagcagguaauaagcgacaacggugugauaccguaucagcugcacgaagcggagcucgaccgaauacucaagaacgccgcauuauacuacccguuccuaagcgaaaaggacgacgagggguacaccaacauggacaagauaaaggcaauauucaaguuccggauacccuacuacgucggcccgcuuaacaccuaccacucagacaagggugggaacagcugggcaguacgaaagcaggacggaaaaauauaccccuggaacuucgagagcaaaauagacgcaggagaauccgccaggaaauucauagggcgaaugacaaacaaaugcacuuaucucaucgggaaggacguccucccgaaagagagccuucuguacucgaaguucaugguccucaacgaacugaauaaccucaggauagauggggaaaaagugaguguugagauuaagcaggcagucuacgagaacgucuucaagaaauaucagcgggucacagggaaaaagguaaaagacuuccugauuagaagcggaaucaucggccgcgagcaggaacucagcggauuugaccagaacuucaaaagcagccucaaggccuaccacgacaucaaacagaucgcuggagauaucaaccugagccagaaccagaaggaggacaucaucaaagaaauaacgguauuugcagacucacagaaaauguuaaagaagcgccuaaaaauaaaauacccagaacuaucggacaagcaaguaacaaaguuggccgccaagaaauauaccggauggggacggcucagcagggaguuccuagaagaagucgagagcgugaacaaggaaacaggggaggugcucaacaucauaagcgcccugugggaaacaaacgagaaccugaugcaacuucuuuccaacaaauacgacuaccucuccgagaucaaacgacucaacgacgaagcugaggacaagagcgaggucguuacauacgacgacguccagaagcuauacgugagcccggcggugaagaggccugucuggcaaacccucaagaucgucgaagagaucaguaaaauaaugggcucgaagccagaaaggaucuucguagaaauggcccgggagccggggcaaaagggcgacguaaaggucucgagaaagagccgacugcuggaaaaauacaaguacugcaagaaagaagcgccagaaaucuacgaaaaccuggucaaagaagacgacaacaaacuacgaagugacaaguuauuccucuacuacacucaaaugggccgcugcauguacucuaaugaagugaucgacaucgaagaccucuucaccaaccgcuacgacauagaccacauauacccccaaaguaaggucauggacgacucacuagacaaccgggugcuggucaaacgcgagcucaauagcaacaagaccgacgucuuccccgugcccaaggaauacauggacaaagcgaaaacacuaugggacaugcuaaagaagaaagaccugaucuccaaagaaaaauaucacagacucacaaggagagacggauuuagcgaaaaugaacuaagcggcuucauagccagacaacugguugaaacccgccagaguacaaaggccgucacgcagcuccucacgaaggccuacccggaaucagaaaucgucuaugccaaagcuaacgccgugagcgaguuuagacacaaguucggcuucacgaaggugcgcuccaucaacgauuaccaucacgcaaaggacgccuacuuaaacauaguugugggcaacacguacuacgucaaauucacaaaagacgccgcaugguucauccgaaacaaccccggacgcaccuacaaccuaaagaagauguucgagcaaggcacagugagccgagggggcgagaccgccuggguaagcggcgaagacgggacaauauucaccguaaaaaggguuauggggaaaaauaacauccucuucacaagaaaagccuacgaagugcgagggggacucuucgaccagcagauuaugaaaaagggaaagggucagauacccguaaagaacaacagcgaagacgaccgauuaugcgcaaccgaaaaauacggagcauacaacaaggcaucgggcgccuacuucaugcuggucgaaucggaagacaaaaagggcaacaaaauacgaacucuagaguuuguacccguauaccuugcgaaagaacuagaaaagagcgaggacgcggcgauccgcuacugcguggaaaaauuagaacucaaaaaucccgacgugagagugcgaaaaaucaaaauggacucacuauucaacgucgacggauucagaaugcaccuaagcggacgaacgggcaagcaacucaucuucaagugcgccgagcagcuaguucucgacgaagaaagccaaaagauucugaagaaaacggcaaaagucuuugcagacuacaaggaaaauaaaaauauaaagauaagcgacaagaucgaacucaccgacgaaaugcugauaaagcuguacgagcuguucuacaagaagcuaaaagacaccguauauaacauaagacuaagcacacaggugaaaacacuggaguccggcaaagaaaaauucgagaaacuaucgcuacuagauaagugccucguaaucgaggagauucuacaccucuuccaaugucaaagcguggccgcaaaccugucguccaucggcggagccgcaaccgcggguauacugguccuuaacaacgagaucagccgaugcggcaaaguggaaaucaucaaccaauccaucacaggauucuacgaacaagucaucgaccucaagaacaucuga

SEQ ID NO: 6502 - RNA, 4050 nt, Artificial Sequence
  Cas9 variant
augcagaaguacuaucuggggcucgacaucggcacaaauucagucggaugggcagucacugacgagaacuacaaccucuguaaguucggcgggaaacgcauguggggcauaaggcuuuucgacggcgcucagacagccgaggaacggagaaugaaccggaguaaccgccgccgacuauccagacaaaaacagcgaauagaccugcuccaagaacucuuugcuaaagaaauagcaaaaguggauccuaccuuuuucauucggcugaaugaaagccggcuauacauggaggacaagucaaccgggaccaaauucccacucuucgcagacccgggcuauacggacaaagaauacuacaaggaguacccgaccaucuaccaccuuagacaagaacuaaucaaaaaccccgagucucacgacauacggcuggucuaccuagcaugccaccacauccugaaaaaccgcggccacuuccugaucaacggcuccuucagcgaccucaaaaaccugucauucgucugccgcgaaaugcuagacgcauucaacgagcuuucaaaauaccagcucaugauaucggacauagacgcccucgagaaaauccucagcgaccgcaaacagcagaaaagcgccaaggugaaagaacucguacaaauauuugaaugcgugccccgggaagacaaauccgacgcaaaaaucugcaaagagauccugucaaaccuaugcaaguuccuagucggggcgaaagggaacauaacgagacucuucgacaccgacuucgacgaaauggaaacgagcucauucucauucggcgacagcaaguacgaagacagccuucuaccgagccucgaggagaacuauccagacuacgccaacgucauacagaaaaucaaagcuauguacgacugguccguccuggucgaaaucauggcaggcgaaaacuaccucucauucgccaaggugaacgcguacaagaaacauaaagaaaaccucuccauccucaaaucccucaugaagaaauauugcacgcccgaugucuaccaacgcuucuuuuacgaaacagacgagaaaagcucauacggaaacuacaucggagccauacacaacaauggccacucgcacacgaugaagaaaugcgacgaagaaacauucuauaaaucccuaucaaaaauccucgacaaauuagucgugcagaaaacagaccaagacacccuggagauacucaagaaagaagccaaaaaccaaacgcuccuaccccuagcaagaaccaaagcaaacggcgucauccccaaccaaauccacauucaagaacuacgcgcaauccucgacaaugcgaaaacguaccucagcuuccuaaacgaagcagacgaauacggaacaaucgcagagaaaauaauuagaaucgccaaauuuaaaaucccauacuacgccggcccgcuuaguacccgccacaaagagcaaggggccaacaccuggaucguacgaaaacaagaaggaagaaucuacccauggaacuuugaagaaauggucgaccuagagcggaguaauaacgaguucauacgccgcaugacgaacaagugcacauaccucauaggagaagacguacuaccgaaaaacagccuccucuacuccaaguuuauggugcugaacgaacugaacaaccuaaaaauaaggggacacaagaucagcguugaacucaagcaagaacuauacaaagagcuauucugcaagaaggccaaaguaaccgggaaagcccuacucguauaccucaagaagaaagaugccgagcuuacacuagaagacauaaguggguuugacgcggacuucaaaagcagccuaucuaucuacauagacuuuaaaaaccacauacuacgcgaacagauagaugacggcaaauaccaaucaaucguagaaaacauaaucaaguggaagacuaucuucgacgucgacagcaagaugauagaaaagcucauugcgcgcgaauaccccaacauguucucauccgaacaaaucaagaaaaucugucgccucaaaugucggggauggggaaacuucagcucccguuuccuaaacgggauccaaggagaaaacaccgagaccaaagagugcuucacaauuaucgaggcacucuggaaaaccaacuauaaccucaugcagcuucucuccaaacaauucacauucaaagacgccauagacuguauaaacgccgacaaaguaggcaaaaucgauaaagugaccuacgaaaacacggucaaagaccuaguaguaucgcccgcgaacaagcgagcgauauggcagacagugcaaaucacugaagagaucaagaaagucaugaaaugcgagccagagaaaauauuugucgaaauggcaagaggcggggaaaaggagaagaaacgcacuaucucacggaaagagcguuuacucaaguuguacauggacuauaaagacgaaaaccgggacuggaucaaggaaaucgagucccgagacgagcaagacuucacaaacagaaagcucuaccuauacuacacacaaauaggacgaugcauguacaguggcgaggagauuagccuggaagaguuaaugcaaaagaacagcaaaugggacaaagaccacauauacccccaaagcaaaaucaaggacgacagucuagacaaccucgugcuagcaagaaaagacaucaacaacaauaaauccaauaagcuccugccuacgggcauccaggacaagaugaagaaauacuggaagaugcuccucaaguauggcuucaucagcaaaaagaaauacgaccgccuuaugcgaacggaagacuucagcgaugaggaacucagcgguuucaucgcaagacagauuguagaaacgcgucaaagcaguaaagccgucgccgaacucuuagagcaccuaaacgagcauacggagaucguauacgucaaagccgagcuggucagcgacuucagacaugacaacaacaugcucaaaagccgaagaauaaaugacuaccaccacgccaaagaugccuuccucaacaucgucguuggcaacgucuacaacgcaaaguucaccgcgaacccccgcaacuggaucaaaaagaaccgaaacacuaacuacagcauccgccgggucuucgacuauacagucaagcguggcagcaccaucgucuggcagggaguaaaagacggagggcacagcaucgacggcaucaaaaagaccauggcccgaaacgacauacucuacaccgaacgaaccuacugcgaacaaggagaacucuucaacgcgacacuaauaaagaaagggaaccccaacgcgauaggacuaaagaaagggcuagacccgaugaaauacgggggauacuccucaccgaaaacauccgcguucgcauucaucgaguuugacggaaagaaaggcagacaaaaccaccugguagaaaucccagucuacaucgccaacauagcagcacgacaacccgaauacaucaaaaaccaucucgaggagaagaaaggcuaucaaaacguaaucgucaagaaauauccgauacagaaaaacgcccucaucaaacucgacggauauccagcccggcuccgaggagcaaacgagaaaucaaucacgcucaaaaacgccguccaacucguccugaaaccggaauaucacgagacgauccggaauguagaaaaauaccucgaguacaucgauaaagacgaaucagucagcaaagcggccagauucucccacaccgagcucgacaagcucuacgacgagcuaugcuucaaagcggagaacaguauuuacaagaaacgaccggccaaccagagcgccaccuuaaagaacggccaaaagacauuccuugccaucacaaaccugaaagaaaaggcacaggucauuaacaacauaaucacaauguucagaugcgacgcgacgaccacaacaaaccucaagacaaucggaggcucagcaaacgcaggcggaaugcaaguaaacaagaacacccuaacaucacagaaggucguucucguccaccaaagcauuacuggacuauucggcaccgaggaggaauuacuauga

SEQ ID NO: 6503 - RNA, 4053 nt, Artificial Sequence
  Cas9 variant
augaagaagccauacuccauaggguuagauauagguacaaacucggucggaugggcagucguaaccgacgacuacaagguucccgcgaagaaaaugaccguucugggcaacacagacaagucgcauaucaagaaaaaccugcuaggcgcgcuccuguucgacaguggcaacaccgcagcagaccgacgccugaaacgcacagcccgccgccgguacacccgcagacgaaaccguauccucuaccuccaagagaucuucgcagaggagauguccaagguagacgacagcuucuuucaccggcucgaagacagcuuucucgucaccgaggacaagcgaggcgaaagacacccgauuuuuggcaaccuagaagaagaagucaaauaccaugagaacuuccccacaaucuaccaccuccgccaauaccuugccgacaaucccgaaaaggucgaccuccgccucguauaccucgcacuagcccauauaauaaaguuccgcgggcacuuccucaucgaaggcaaauucgauacacgcaacaacgacgugcagcgacucuuccaagaguucuuagcaguauacgacaacaccuucgaaaauuccagccuacaagagcagaacgugcaaguagaagaaauacugacagacaaaaucuccaaauccgccaagaaagaucggguacuaaaacuauuccccaacgaaaaaucaaacggcagauucgcugaguuccucaaacugauuguaggaaaccaggccgacuucaagaaacauuucgaacuugaagagaaaacgcccuuacaauuuagcaaagacaccuacgaagaagaacucgaaguccuccucgcgcaaauuggggacaacuacgccgaacucuuccuauccgcaaagaaauuauacgacucgauccugcucucggggauccucacggucacugacgucucaacuaaagccccgcucagcgccagcaugauccaaagauacaacgagcaccagauggaccucgcucaacucaaacaauucauccgccaaaagcucagcgauaaauacaacgaggucuucuccgacgucucaaaagacggcuaugccggcuacaucgacggcaagacaaaccaagaggcuuuuuauaaauacuuaaagggcuugcuuaacaagaucgaagggucagguuacuuccuugacaaaaucgaaagggaagacuuccugcggaaacagcgaacuuuugacaacggcagcaucccgcaccaaauacaucuucaagaaaugcgagcuaucauaagacgacaagccgaguucuacccauuccucgccgacaaccaagaccgcaucgaaaagauccucacguuuagaauccccuauuaugucggcccccucgcccgaggcaaaagcgauuuugcuuggcucagccgaaaauccgccgacaaaauaacgcccuggaacuucgacgaaauaguagauaaagagucaagcgccgaagccuucauaaaccgaaugaccaacuaugaccucuaucuaccuaaccaaaaaguccucccaaaacauucgcuccucuacgaaaaguucaccguguacaacgaacuuacaaaaguuaaauacaaaaccgagcaagggaaaacagcuuucuucgacgccaauaugaagcaagaaauauucgacggugucuuuaaaguuuaccggaaagucaccaaagacaaacucauggauuuccucgaaaaagaguucgacgaguuccgaaucgucgaucuaacagggcuggauaaagaaaacaaggcuuucaaugcguccuauggcaccuaccacgaccuccgcaaaauacucgauaaggacuuucuggauaacagcaaaaacgaaaagauccuagaagauaucgugcuuacccuuacgcucuuugaagaccgagaaaugauucgcaaaagacucgaaaacuacucagaccucuugaccaaagaacaagucaaaaagcuggaacgacgccacuacaccggauggggacgacuuagcgcagagcuaauacacgguauacguaacaaagagagcagaaaaaccauccuagacuaccucauagacgacggcaacucgaaucgcaacuucaugcaauugauuaacgacgacgcucuuucguucaaagaggaaauagccaaagcccaggucaucggcgaaaccgacaaucucaaccaagucguguccgacaucgcggggucgcccgccaucaaaaagggcauccuccagucccucaaaaucgucgacgagcuagucaagaucaugggacaccagccggaaaacaucgucguagaaauggcccgcgaaaaccaauucacaaaccaaggucgacgcaacucccagcagcgucucaagggccuuaccgacucuauaaaagaguucggcagccaaauccuaaaggaacaccccgucgaaaacucccaacuccagaaugaccggcuuuuccuauacuaucuacaaaacggcagagauauguacaccggugaagaauuagacauagacuaucucucccaguacgacaucgaccacaucaucccccaggccuucauaaaagacaacagcauagacaaccgagugcucaccucaucaaaagagaaccgcggcaaaagcgaugauguacccagcgaggacguagucaacaggaugagacccuucuggaacaagcuccuaagcuccggacuuaucagccaacgaaaauacaacaaccucacaaagaaagaacuuacccccgaugacaaagccggauucauaaaaagacaacucgucgaaacgcgacaaaucaccaagcacgucgcacgaauguuagacgagcgauucaacaaagaguucgacgacaacaacaaaaggauccgcagaguaaaaaucguaacccugaaaucaaaccucgugagcucauuccgaaaagaguucgaacuguacaagguccgcgaaauaaacgauuaccaccaugcgcacgacgccuaccucaacgcaguaguagucaaagcccugcucguaaaguaccccaagcuagaacccgaguucguuuacggcgaauauccgaaguauaacucauaccgcgaacgcaagaccgccacccagaaaauguucuucuacucaaauauaaugaacauguucaaaucaaaagucaaauuagccgaugaccaaaucgucgaacgacccaugauagaagucaacgaugaaacaggggaaaucgcaugggacaaaaccaaacacaucacaacuguaaagaaagugcucucauacccccaagucaacauaguaaagaaaguagaagaacaaacgaucggccaaaacggcggccuguucgacgauaaucccaaaagcccacucgaggucaucccguccaaacuugugccacuaaagaaagcacugaaccccgagaaauacgguggguaccaaaaaccgaccacagcguacccgauacuccuaaucguagauacgaaacaacuuauccccaucagcguaauggacaagaaacguuucgagcaaaauccagugaaauuccuaaaagauaagggauaccaacaaaucgagaaaaacaacuuugucaaacuuccgaaauacacgcucgucgacauaggaaacggaauaaaacggcugugggcaaguucgaaagaaguacacaagggcaaucagcugguugucucuaagaaaagccaagaccuacuauaccacgcccaccaccuagacaacgacuacuccaacgaauacgucaaaaaucacuaccaacaauucgacauacucuucaacgaaauuacgagcuucagcaagaaguguaagcuaggcaaagaacauauccagaaaauugaagaagccuacucaaaggagagagacagcgcauccauagaggaacuagccgacggauucaucaaacuccucggauucacacaacucggugcaacauccccuuucagcuuccucgggaucaaacucaaccaaaaacaguacacaggcaaaaaggauuaucuauugcccugcauggaggccaccuuaauacaccaaagcauaaccggccuauacgaaacucgaauagacuugagcaagcuaggaggagacuga

SEQ ID NO: 6504 - RNA, 4053 nt, Artificial Sequence
  Cas9 variant
augggcaagaacuacuaucucggacuggacaugggcaccucgucugugggcugggccgucacagaugagaaguaccgcauccuccgggccaagggaaaggaccucuggggcguucgacuuuucagcgaagccaagacugcagcggaacgccgcacgcaucgaacuagcagacggcgccucgauagggaaaaagcaagaaucgcgugccucaaggaaauguucgcagaggagauaaacaagauugaccccggauucuaccaacgacugaacgacuccaaauacuuccuggaagacaaaaaagagcaccagcccuaugccauuuucgccgacacgggcuacaccgacaaggaauacuaugacgaauaccccacgaucuuccaccuccgaaaagcgcugcugaauauagagaaugacaaaaaaaaauacgauguacgccuggucuaccucgccauucuaaacauguucaaacacaggggccacuucuugaacgcaaacuuggacgacaaaaguggcggcaaccucaaggaguauauagagaugcuccaccagucaauggugaacauccugaacauaaaccuaaaaaacgucgaaaucgagaaaauagagaagauccucaaaagcacccaauacuccaacucagagcggcucgaaaaccuccuagaacuguacgaacuauccaaaaacaaaaacaaaaucgaaacagagauuuucaaguucaucugcggccucaagggaacaaucagcaaaauauacgucgaagacaaguucgaggacgaauucgccaagaugacgcucaguuucagggacuccaacuucgacgaaaaaaucaucgaaauugaggacaaccucgacgaugacaaauacgacauguuccugcuaauaaaacaaauacacgauuggaguguccuugcgaauauaaugaauggggaagaguaccuauccguagcgcgcgugaagcuauacgacaaacacaaaaaagaccuagaaguccucaaaaaguacuacaaacaaaacagcauggaagaauacaacaaaauguuccgccaaaugaacgacgggaauuacucagcguacgucggauccgucaucuacaaagacaacagcguucggcgugggugcaaauccaaaaaagaggacuucuacaaaaacauccuuaauaccauaaagaguugggaggacugcgaggccaaagaguacaucacaagcgaaauagacaaaggaaauuuccuucccaagcagauaaccgcuagcaacggcgugauccccaaccagguccacaagaaagaacuaaagaaaauccucaaaaacgccagcgaguaccucaacuuccucaacgagaaggaugaaaguggcuacacaaucuccgaaaaaaucgugaaauuauucgaauuucagauccccuauuaugucgggcccauagccuacaacaucggaaacgacgaaucaaaacaccggcacaacaugugguccguccgcaaagagaaaggcccaaucuacccauggaacuuugaacagaagaucgacaucaagaaaagcucggagaaauuuaucaggaaccuaauuaaccauugcacauaccugaacgacgaggaaguccugcccaaaaacagccuccuguacgaaaaauucauggugcucaaugagcuaaacaagcucaaaaucaauggagaaaagaucucaguagagcugaagcaaaacaucuucaacgaccuguucaagaaaggaaaaaaggucacgaaaaagggccugaucaaauaccucaaggaacagggcgaaaucgacaauugcgaagaaguggagaucagcgggauagauggcgacuuuacaaacaagcuaagcaacuauaaaaaauuugcagacaucuuuggcguccagucccucacuuacgaacaaaccgacaucgcagaaaacauaauccgauauagcaccaucuacggggacucuagaaaauuucuugaggaaagaauacgagaagaguacagcaacgugcuggacgaaaaacaaauaaaacgaauacucggaaugaaguuuaaagacuggggcagacuaucaaaagagcugcuagagcuauccggaguggacaaagagacgggcgaaaucgcaucgguaaucucgcgcauguggaacgauaacuacaauuugauggagcucauugcaaccgagcgauucagcuacgcauaugagauagagcaaagaucgaaaaaguuagagaaaacgaucagcacaauugaguacgaagaucuagacgaguuauacaugagcaccccgguaaagagaaugguauggcaaaccauccuagugcucaaagaacuggaggaggugcucggaugccccccaaaacgcaucuucgucgaaauggcacgagacgucaaugcgccaaaggacagaaaagauaguagaaaaaagaaacuacuggagcucuacaaaaacugcaaaaaggaggaaggugacuggagcaaggaguugaacgcucgagaggaaucggaauucaagucgaagaaacucuaccuauacuauaugcagaaaggccgguguauguauucggggaaaccgaucgaccucaaaaaccuacuaaacgacaaccuguacgacauagaccacaucuaccccaggcacuucgucaaagacgacuccauagagaacaaccuaguacuagucgagaagaacuucaacgcucacaaguccgacaacuacccaaucgaaaacgagauccgucaaaaaaugcacagcauguggaaaaugcuacgagacggcaacuucauaacagaagagaaauacucgcgccucauaagaaaagaagaguuuacggacgacgaaaaagcgaaauucaucagccggcagaucguagaaacgcgccaggggacaaagguaaucaccgaucucuucgaacagaccuuccccgagucagacauaguguacgucaaagccggcaacguaagcgaauuccgacacaaauucaaacuaauaaagugccggaacgucaaugacuuccaccacgccaacgacgcuuacuuaaacaucguggucggaaacguuuacuacaccaaauucacaaagagcgcacuaaacuucauaaaagacuacaaaaagaacccugaaaagaacaaguaccacauggaccauauguuccaauacccaguuucccggggcgggguggacgcauggauaacaaaaggggccgaaucaaucucuaugguccgcaaaaugauggcgaagaacaccccuauggugacaaggaugaauuacgagaagcacucaggccaaaagggaggaaucagcgaccagaacauauguagcgcgaagaucgcgaaaaagaaugucuaccuccccaucaaaaugggggacgaaaaacugaaaaacgucgaaaaauacggaggguacggguccuuaacugccaaguauuucuuccuggucgaacacacaaucaaaaaaaaaagaauucgcaccaucgaagcauacccaauguaccuggacgcacugaacaaagagaacaaacuauugaacuauugcguucaaguccucgaguaugaugaacccaaaaucauaauggaaaagauuaagguaaaaucgcuauucaaaaucaacggauacuacuacuaccuaaacgcaaaguccgucaaccgcauaauauggggaaacgccacccagcuauuccuggaaaacgacauuaacgaauacguccgcaagauauccaaaaauaucgaaugcaucgacauaaacucggaaaacaacaucaaaguguacgauauauucaucgaaaaauacaguaacaaacuauucagcaaccggcugggcaaccucaaagaagccauuauacaaaaccgcaacaaauucaucgaauuaaagaucaacgaacagauuaacgucauccucgaacucgugcgguacucccaagacggcguuuacucgaucaaccucucacaacuaggacugagcucaacguacgccauaaaccgaacgaguaaggaaauaucaaagaugaaagagugcaaacugaucaaccaaagcgucaccgggcuuuaugagaacgaaauagaucuccuaaccgucuga

SEQ ID NO: 6505 - RNA, 4053 nt, Artificial Sequence
  Cas9 variant
augcaacaauacuaccucgguguagacaugggaucagcaucaguuggcugggccgucacggacgaaaaauaccagcucgugagaaagaaaggcaaagaucuuuggggcguacgcaccuucgacauagcacaaaccgcggaaguucggcgagucagccgaaccaaccgccgcagacaaaaucgccgcaagcaaagaauacaaauccuccaagagcuccucggugaagaaguccugaagaucgacgccgguuucuuccaccguaugaaagaaucccgcuacgucgcggaagacaaacgcacucucgauggaaaacaagucgaacuuccguacgcucuuuucgucgaccagggcuuuacagauaaggacuuuuacaagcaauucccaacuauaaaccaccuaaucgucuaccugaugacaaccucggauacccccgacauacgacuggucuaccuggcccugcacuauuacaugaagaaccgcgggaacuuccuccacagcggcgacaucaacgacguaaaagacauccaaucuaucuuagagcaacuggaaaacguacucaaggaauacguugacgacugggaauugucacugaaggacaaaguagacgcaauaaaagaaauauacaacaaggauuuaggccgcggcgaacgaaagaaagcauucaucaacacccugggcguaaaaaccaaguccgccaaagcauucugcagccuaaucucaggaggcucaacaaacuuagcagaacuauucgacgacuccggacuuaaagaauccgaguaugcaaaaaucgaguucgccaacgcaaacuucgaagacucaguugaaggcauccaggcacucuuagaggaucguuucgccgucaucgaagccgccaagagacucuacgacuggaaaauccugacggauauacucggcgauaacgcuucccuagccgaagcccgagucaaguccuacgaaacccaucacgaacagcuggucgaacucaaaucauucaucaagaaauaccucgaccgcaagauauaccaggacaucuucauaaacccaaacauugcgaauaacuacccagccuaugucggccauacgaagauaaacggaaagaaacaggagcuagaagucaaacgagccaaacguaacgacuucuacgcauacaucaagaaacaagucauugacccaaucaaaaagaaaguguccgacaaagccguguuagcgcgccuggccgaaaucgagucccuaaucgaaguaaacaaauaccuaccccugcagguuaacucagacaacggcgucaucccguaccaaaucaaacuaaacgagcugcggaggauauucaauaaccucgagaaccgacuaccaguccuaaaagaaaaccgcgacaaaauaaucaaaaccuucagcuaucgaaucccauacuacgucggcccgcuaaacggcguaaaccguaacgggaagucgaccaacuggaugguacggaaagagggcgaagagggcaagaucuaucccuggaacuuugaagaaaaaguagaucucgaggccucggcagaaaaauucauaaggcgcaugaccaacaaaugcaccuaucucgucaacgaagacguccucccaaaguauucgcuccucuacucuaaauaucuaguccuaucugagcugaacaaccuccgccuggacggucggccgcuggaagucucagugaaacaggaaaucuacgaaaacgucuucaagcgcaaccggaaaguuacccucaaaaagaucaaaaacuaccuacuaaaagaaggggucauaucagaaaaagacgaacugaguggucuugccgacgacgucaaaucaucacucacagcuuaucaugauuucaaagagaaacugggucaccucacacucaccgaggaccaaauggaaaagaucauccucaaugucacacucuucggagacgacaagaaacuccugaagaaacgucuagccgcacuguacccaaacauagacgagaaaagucuuagccguauggccacauucaacuaccgugauugggggcgccugucgaagaaauuccucuccgaaaucacaucagucgaccaagagaccggagaacuacgcaccauaauccaaugcauguacgagacccaaaacaaccucaugcaacuucucuccgaacccuaccauuucguagaagcgaucgaaaaagagaaccccaaggucgaccucgaaucaaucucauaccgaaucguaaacgaccuguacgucucgcccgcggucaagcgccagauauggcagacccuacugguaauaaaggacaucaaacaagucaugaaacacgaccccaagcgaauuuuuauugagauggcaagggagaaacaagagucaaaaacuaccaaaucgcgaaagcaaguacucucagaagucuacaaaaacgcugaaaaguauaaaaaccuguuugaaaaacucaacagccucaccgaagaacaacuucgcaguaagaagguguaccuauacuuuacccaacuaggcaagugcauguacaccaacgacgccaucgacuucgagaaucucgucagcgccaacuccaacuacgacaucgaccacauauacccucaguccaaaacaaucgacgacucauucaacaaccuaguccuagugaagaaaggaaucaacaacgacaaaucggacagauaccccauagacaaaaacauucgcgacgacgagaaaguaaaaacccuauggaacacccuccuauccaaaggccuaaucacgaaggaaaaauuugaacgucuaauacgauccaccccuuucucagacgaggaacuagcuggcuucaucgcaagacagcuaguagaaacgcgacaauccaccaaagccguagccgaaauccucuccaacugguuccccgaauccgagauaguauauaguaaagccaagcacaucaccaacuuccgacaggacuucgaaauccucaaaguccgugaacucaacgacugucaccacgcucacgacgcauaccucaacaucgucgucggcaacgccuaccacaccaaauucaccaacucccccuacagguuuauacaaaauaaagcaaaucaggaauacaaccuacgcaaacuccuacaaaaggccaagaagaucgaaagcaacggagucaucgccuggauagggcaaucagaaaacaaccccggcacgaucgccaccgugaaaaaggucaucucgagaaacaccguccucauaagccgaaugguaaaagaagucgacggacaacucuucgaccaacagcucaugaagaaagggaaaggccaaguccccaucaaaagcuccgacgacagacuuauagacaucagcaaguacggcggcuacaacaaagccaagggugcauacuucguuuucauuaagagcguaagacggggcaagaccauaaaaucguucgaguacauacccguccacuuggccaagaaauucgacugcaaccuugagcugcuaaaggaauaccucgaaucagaaaaggauuugaacaacgucgaaauccugaugccaaaaguaaugaucaacucacucuucaacuacaacggcagucuaauacgcauccccggccgcuacgauaagaaaucccugcugaucaaugucgacguaccgcucuugcuagaaucgcaacacaucaaacaguuaaaagugaucgaaaaauauauguacaagaaaaggguauccaaaaauuccaacauucuccuaacaaaauucgcgucugaccaacucaaagaccuugaugcguuguucgacguccuuuccuacaagcucaaugaaaacauuuacaacgucaucaacgacaaauacgacaagcucgucaucugcagagacaaguucaucucccucgacacggagguaaaaugcgaaaugaucuucgaacuacuacaccucuuccaaugcaacucccaguuagccaacauaaccaaaauaggggccacaucgaaguuuggaucaauuucaauguccaaaaaccuaaaagaaaacgacaagaugagcaucauccaccagucucccagcggcauauucgaacacgagaucgaacucaccgcccucuga

SEQ ID NO: 6506 - RNA, 4053 nt, Artificial Sequence
  Cas9 variant
augaaacggauacuaggccuagaccugggaacagccuccauuggcugggcacucgucaacgagagcgagaacgaaaaagaaaagagugaaaucaucaagcuaggaguccggguaaacccacucaccacggaugaacagacagacuucgaaaaaggccgucccuuaucaguaaacgccgaccggacgcuaaaaagaggagcccgacgcaaccuccagcgguucaaacaacgccguaagaaccugaucgaaauccuaaucaagaaaggguucaucacuaacauuuccuuacugacggaaauaggaagcaacacaacguaccagacucuggagcuccgagcaaaaucagugaaggagaaaauagagaaagaagaguucgcccgcgugcuacuaaccaucaacaagaaacgcggguacaaauccucacgaaaagcgaaaaacgacgaggaaggcagccuuauugacgggaugucggucgccaaagaacuauacgacaacaaucucaccgucggacaguacguauaccaauuacucgagaaaggcgguaaauacauccccgauuuuuaccgaagcgaccuacaaaacgaguucgacgucauauggaauuuccaaaaagaguucuacccuaacauccuaacaggagaacuguacaagaaacuccagggucaaggccaacaaaacagccgcaaacucuuccucgcgauucaccaaauauacaccgccgaaaacaaaggcaagcgcgacacagucaaaaagcaacacuacaaguggcgaaacgacgccaucaacacgcaacuucucaucgaagagguagcguacguacucgucgagauaaacaacaaccucaacaaaagcucaggguaccucggggccaucagugaccgcuccaaagagcuauacuucaacaaagaaaccguaggcgaaaaucucuacaaacaaauacaagaaaacccacagacaagccuaaagaaccaagucuucuaccgccaggauuaccucgaugaauuugaacagaucugggagacacaagccaaauucuacagcgaacuaaccaaagaacucaaagaggaagugcgcgacgucgugaucuucuaccaacgcaagcugaagucgcagaagcaccucaucagcgagugcgaauuugaaaaacaccacaaagcaauaccgaagucgucgccacuauuccaagaguucaaaauauggcaaauacucaauaacaucgaguucaagcacaagaaaaccaaggaacuuaagauccugucagaagaacucaaagaaacgcuguucgaagaacucaauauacggggaaacuucaccuccgacgcaguccuaaaguucguaaagcuggacaagaaagaaugggaacuaaacuacaaaaagggaauagaaggcaaccgcacuaacgagguccuguacaacgucuaccagaagauagccgaauacgagggcuacgguuucgacuggaguaaaaagucagccguggaaauuaaagaggaacuaaacaccaucuucagcgagauaggcaucaauagcaaaauccucgacuucaacccugagauuagcggaaacgacuuugacaaacaggaaagcuaccaacuauggcacuuacucuacuccgccgaagaagacggcuuccucaaacagaaacuacaagauaaauacgguuucaaguccgaauacgcaaacaugcucgcaaacguauccuuccaaagugacuacgggucacuaagcgcgcgggccaucaaaaagauacuaccgaaccucaucgccggacacgaguuuuccgaggccugcagccuaaguggauacaaccacagcaacagccugaccaaagaggaacucgccaaccggccucuaaagggaaaacucgagcuccugaaaaagaacagucugcguaaccccguggucgagaaaauccuaaaccaaaugguuaaccuagucaaccaaguaaucgagucguacggcgagaucgacgaagugaggauugagcuggccagggagcuaaagaaaucggcccaggaacgugcacucaugacaacaaacaucaacgccagcaaaacaaaauacgaguccuuucgaaaacuacuacaaaaagacuucggcaucaagaaccccacgcgaaacgauaucauaaaauaccggcuauacgaggaacuaaaagccaacaaauaccacaccauuuacaccaauaaguacauaccgcgcgacaaacucuucucgaaggaaauagacaucgaacacaucauccccaaggcgaaacuuuucgaugacucauuuuccaauaagacacuugccuuccgcaaaccaaaccaagacaaagggaacaugacugcaaucgacuacauccucucguaucagagcaaggacauagacaacuauaagagccgcauagaaaaccuuuucaagaacgggaagggagauauaucuaaggcaaaaaggaauaaacuacucauggaagaaaaggacaucccggacggcuucauagaccgcgaccugcggaacucgcaguacaucgccaagaaagccaaacagcugcuggaagaagugauacguacagucaacacgacaaccggcagcgucaccaacaaacuccgagacgacuggggacugauaaacgucaugcaggaacuaaauaugccgaaauuuaaagcgaucgacgaaucccugauagaacaaaucgaaaagaaagacgggacauucaaaacacgcauaaaggauuggucgaagcgaaacgaccacagacaccacgccauggacgcccucaccguagcguucacuagguauaaccacauacaguaccuaaacaaccuaaacgccaagagcgacaagaagggggcgaucuacggaauccaagaacuagaaaccuacguaaacagcaaaggcaaaagaaaguucaucaaaccuaugcacaacuuucgcgaagaagcaaagaaacacaucgaggauaucuuaauuagcuuuaaggcaaagaacaaggucgugaccaaaaacaucaacaagaucaaaucaaaagacgguuucauaaagaaaguacaacuaacgccccgaggacaacugcacaaagaaacagucuacgggaaaaucaacgagguggucguaaaagaagagaaaauaaacgcgaaauuugaccuggaaaagaucaacaaagucaccaagccaauauacaggaacgcacuccuaaagcgccugcaagaguucaauggagagccgaagaaagcauucacagggaaaaauagccucagcaaaaacccaauauaccuggacgucgcgcaaacgaaaacucugccugaguccgucaaggugcaauuuuucgaggaaaauuauacaauccggaaagaaaucagcccagaccugaaaauugacaaaauaauugacaagggaauccaacgaauccugcuaaaacgcuuagacgaguucaacggaaaacccaaagaagcauucucgaaccuagagaaaaacccgauauggcuaaacaaggaaaaaggcauagcaaucaaaagggucaaaauaaaaggcgucaaaaacguagaaucccuacacaacaaaagggaccaccugggaaacgagauacuccagaaagguaaauccgcacccaaugacuacgucagcacgggcaacaaccaccacguugccauauaucaagacaaaaacgggaagcugcaggaaaaagugguguccuucuacgaggccgucgcccgcgucaacaacaagcugcccaucaucgaccaagauuucaauaaggauuuagguuggaaguuccuguucaccaugaagcaaaacgaaauguucgucuuccccucggaagacuucaagccgcucgaaaccgaccuuauggacaagaaaaacaacucaaaaaucuccaaaaaccucuuccgaguacaaaagcuggggaauaaagacuauacauucaggcaccaccuggaaacuaaaaucgaagacauaaagaagcuccgcgacuucacguauauccgcaagcggaauccugaaucgaucaaaaacaucauuaaggugcggaucaaccaccugggcaacauaguccacgucggggaauacuga

SEQ ID NO: 6507 - RNA, 4056 nt, Artificial Sequence
  Cas9 variant
augagcaagaaguacuaccucggccuagauauaggcaccaauuccguagggugggccguaaccgaugaaaacuacaaucucugcaaauacgccggaaaaaggauguggggaauacggcuauuugaagggggagaaacagccgaacaacgcagaauaagucgaagcaaccggcgacgccuaucccgaaagaaacaaagaaucgacuuguuacaagaacucuuugcagaagaaaucgccaaaauggaccccacauuuuucauccgccuaaacgaaucacgacuacaccucgaagacaaaagcacaggugaaaaauucccccuuuuucgcgauaaagacuacacagauauccaauacuacaaagaauauccgacuauguaccaccuccgcaaggaacuaauagaaaacagcaaaguccacgauauacgguugguguaccuagccugccaccauauccugaaaaaccgcgggcacuuccucauaaacgggagcuucagugacguaaagaaacucucaucagucugcgaaagcaugcuaaauucauuuaacggaaucucgaaauaccaaaucgaaaucaacgauaucgaacgauuagaggaaauccuauccgacaggaagaaacagaaaagcgugaaagcaaaagaacucauccaaauauuugaaugcgggccaugcgaagacaaaaccgacgagaaaaccugcaaagccaucgucucaaaccuauguaaauggcucaccggccuaaaaggaaacauaaacagcauauucgacaugcaauucgaagagauugacacaagcagcuucagcuucacagaaccaaaguacgaagacaccaucagcgcggcccuagaggagaaguacccggacuacgcugacguaauccagaaaaucaaggcagucuacgacugguccgugcuagucgagaucauggcgggagaggacuaccucucguucgccaaagucaacgcguacaacaaacacaaggagaaccuguguauucuaaaagaggugauacgcaaauacugugacagcgagauauaccacaaauucuucaauggcuucgacgagaaaaacggguacgggaacuauauaggcucgauauacaaaaacggccauagcuacgccaugaagaaaugcucgaccgaagacuucuacaaaacccuaggaaaaauucucgacaagauucaacccgaaaaagaggacgaaaacguacuggaagaacuaaaaguagaagugaaaaaccaaacgcuccuuccucuagccaggacaaccgcuaacggcaccauaccaaaccaaguacacauccaagaguugcgcgccauccucgacaacgcaaagaaguaccuacccuuccugaaugaagaggacgaauacggcacgguagcagagaaaauuauuucuaucgccaaauucagaauacccuacuacgucgggccacugucaacccgacacaaagaacagggcgccaauagcuggaucguaaggaagcaagaagggagaauauaccccuggaauuucgaagaaauggucgaccucgaacaaagcaacaaggaguucauccaaagaaugacuaacaagugcacguaccucaucggcgaagacguacugccgaaaaacagucuccucuacagccguuacaugguacugaacgagcugaauaaccuccggauccgcgggaacaaaaucucagucaagcuaaagcaagagcuauacaaggaacucuuuugcacuaaggccaaggucacggggaaaggccuauucaacuaccugaaaaaggaggaugaagaacuggcccucgaggacaucagcggauucgacaucgacuucaaaagcucauuaaccucauaccucgacuucaaaaagcaaauccucggcgaggaaaucgagaaagacaaauauaaaggcaucgucgaaaacauaaucaaguggaaaacaauauacgacgacgauucaaagaugaugaagaaaaugauagaacgggaauacccaaacgucuucucaaaagacaagaucaaaaagauaugcagauucaaauacucggggugggguaacuucucgcucuccuuucuuaacggcauacgaggagcugauagggagacaggagagagcuucacgauaaucgaggcacuauggaaaacgaacuacaaccucaugcaacuccuaagcaaacaauucacauuuagagaagagauagaccugaucaacgccgaaaaagucggaaagaucaacaaaguaagcuacgauaacaccgucaaagaccucaucgugucgccagcaaacaaacgagccaucuggcaaacaguccagaucacagaagaaaucaagaaagucaugaaaugcgagcccgagcgcauauucauagaaauggcucgcgguggagaaaaagagaagaaacgcacgguaagccgcaaagcaaggcuucuggaacucuacgccgcgugcaaggaugacguacgugacuggaccaaagagaucgaagaccgugaggaaagagaguucaacucgaagaaacuguaccuauacuacacacagaugggacgcugcauguacuccggggaagaaaucaauauagacgaacuaaugcaaaagaacagcaaaugggacauugaccauauauacccccaaagcaaaaucaaggacgacagucuggacaauauggugcuagcgaaaaagguaaucaacaacucuaaacagaacaaacuucuaucguccgauauccguauaaaaaugaagaaauacuggaacgcacuauacaaaggaaacuucauaucaaagaagaaauacgacaggcuaacgcguaccgaagacuucacaaacgaggaacucagcggcuucaucgagcggcaaauagucgaaacccggcagaguagcaaagcuguggcggagcuccuaaaucgccuauacgaacauuccgaaauaguauacgucaaagcaggacugguaagcgauuucaggcacgacaauaaacuauuaaaaucgcgcaggaucaacgacuaccaccacgccaaagaugccuuccuaaacauaguggugggcaacguuuacaacgcuaaauucaccucaaacccgagaaaauggauaaaagagaaccgaggaacaaacuacagcauaagacgaguauucgacuacaacgucaaacgcggcaacacaguagucuggcaaggagucgaggacggaggacauagcauagaugagauccggaaaacuauggcgcgaaacgauauccucuacacugaguacaccuacugcgacaaaggcgagcuauucaacgcgacccugaucaaaaagggaaacgacaaggcaaucaaccucaagaaagcccuggacuccgugaaauacggaggauacaacagcccgaaaacaagugcauucgcauucaucgaguucgaugggaaaaagaaagaacgcaaaaaccacaucguugaaauccccguauauaucguuaacaucgcgaaacggcaacccgauacgauaaaagaauaccuagaacagaagaaaggcuacaaaaacguaguaguaaagaaauaccccauaaagaaaaacgcccuuauuaaaauagauggcuaccuggcacgccucaggggagcaaacgagacggacauccuccuuaaaaacgcaguacagcuaauccugaacgauaaguauuacgagauaauaaggcgcguggagaaauaucuggaauacaacguaagauacgaggcggaguccauguucgagggcuucgaccacgccgaccugaacagccuauacgacgaacuuaccucaaagcuggaaaccaguaucuacaagaaaagaccugcaaaccaacuuaacgccuuagaaaaaggaaaagagaaguucaagaacauccaaacgcuacgggaaaaagcacaaauuauaaaggagaugcucaucauguacaggugcgacgcggcgaccguagccaaccuaaaagcaaucggcggaagcgccaacgcgggcagcaugaaaaucaagaagaacacacuaacgucgcgaucccugguacucguaaaccagagcaucaccggacucuucgaaaccgaggaagaauuggucuga

SEQ ID NO: 6508 - RNA, 4056 nt, Artificial Sequence
  Cas9 variant
auguacaaaaaguacggcaucggacuagacauaggcacaagcucuaucggcuggagcguaguagacgaauacggccauauaauacgcguaaaaggucaaacuggccucggaguccgccuuuuucgagaaggccagcccgccgccgaccgacgcaccuuccgaacaacucgaagacgacuagggcgucgucgcuggaggcuacgucugcuacgugaaauauucgacccguacaucgcagcccaagaucccaacuuuuucgcgcgccaaaaggccucugcaaucgccccaggagacagcagauucaaagcgguguaccgucuauucaacgaccagaccgaccgacaauucuacgacaaauaccccacaguguaucaccuccgccaaaaacuaaugaccgaaaaacgccaauucgacauacgagaaaucuaccucgcaguccaucacaucguaaaauacagaggccacuuccuaaccggcggcgcggcuaaaaacuucaaaccaggaaaacucgaccucaacaccuacuuugccacaauaaacgcgcaacuagcagcaaucuuuauggauagccaagucgaacuaccacaacucgacugggacgccguaguaucauugcuaaccaaugaccaagagucacccuccgauagacagaaagcacuaaccaaaaugcuuguggcccaaggcgacgcaacccagaagcgcuucuacacggaguucagcaaagcccuccucggacucaaggccaaacucuacguccugacaggcuucgaaggcgacaaaaccgaccagaaggcccucacauuaucccuggaaacccuagacgaucaccaagacgacguaacccaacuucucggagacgaacaacgccaauuaguagaacuucuggcccgagugcaguccgcaauccagcucgcgaucauaauaccaaacggcaaaacuuucuccggccaaaugguacagcaauaccaaacccacuacgaccaacuacgccuacugaaagacuaccgugaacaacucaccgaccaaaaacaccgucgugcccuuaagcaagccuacgccgacuaccuagccaacgaccaagaccaagacgcccuaguuaaggcgguagaaaaaguccucaaacaaaaccaaccccuaagcaccguagggguacgacuccaaaccgccaucgacgccggggacuuucucccaaaacaacgaaccaaagcaaacagcguaauaccucaccagauccaccaacaagaguuggaucgaaucaucgaagcgcaauccgucuacuacccauggcucgcagaggagaaucccguagccgcgcaucggucuuacgcgccguacaaacuagacgaacucgucgauuuccgggucccauacuacguaggcccccugguccagccacaagccgacaaagccgcaaaagaaacaaaguucgcuuggaugacccgcaaagaagcacagaguaccacacccaucacaccauggaacuucgaacaagagguggaccgaaacgccucagccaacgccuucauccagcgcaugaaaacgaccgacaccuaucuacucggggaagacguccuccccaaaaacucacucuuauaccagcgguucgaaguccucaaugagcucaacaaugucagagucgacggaaaacuccuaacaauagccgaaaaacaacggcuauuccaagaccucuucguggacaggagccaggcuagcguuacaaucgcccaacuacaagcgaaccucauagcgcacggcgccgcaaaggacagaguggaaauaaaaggacuagcagacccaaaacgauuccucucgucgcuuaccacauaccacgacuaugcgcaaaucauccccgaggcgcucgaacaacccgacaagcgugcggacaucgaaaagaucauuaacuggagcacaauuuucgaagacaccucaauuuuuaaagaaaaacuucaagaaaucgcuuggcucacacccgaccaacgcaggcagcugucccagaagcgcuaucggggcuggggccagcuaagugacaaacuccucacacaacuaagagacgccaccggacagucgguaauggacuugcucuggacagaaccaaacaacuucaugcaaauaauaagacgaaccgaguuccaacaggcuauagcccgcguuaaccaaaccgaccucaaacaacaagacuuggcaaccacaaucaacgaccucuacacaagcccacaaaacaagaaagcgauacgucagguccugcuagucgucgccgacauacagacggcgaugcacgagguugcgccaucaugguuauucauagaggcagcccgagggccugaacaaaaccccaaacgaaaacucgcaaggcagcaacaacuauuagaggcguacaaaacguccgccaaagagaucgucaacgaggccguaaaggagaagcuccuaagugccauagacgaccaucaaaaauuugaggaccaagucguucuauacuuccaacaaaacggucucgacauguacacaggaaaaccccuagacuuugaaaggcuguccaaauaccacauagaucacaucauaccgcaaagcgugguaaaagaugacagccucgauaaccgugucuuaacaacgccggaagaaaacgagcgaaagggugcccgcguccccgggccucuuuacgccagccaacagggacgcuggcgacuccuacagagagccggcuuaauaucccaacgaaagcuagaccaccuccuccuucgacccgaggagcuagaccagcaggcaaccggcuucguugcccgccagcuagucgagacacgccaagucaucaagcuaaucacgaacauacucagccaacaauacgacccugaacaaacuaagcuaguauccguuaaggccggacuaagccaccaauuccggaccagacucaaccuacccaagcuccgggaacucaacgauuaccaccaugcgcaugacgccuaccuagccgcaaggaucggaacuuaccucuuacaacgauaccccaaccuggaaagguucuucguguacggccaauaccagaaaacacgcuucgaucucaaacgacacuucaacuucaucggagaaaugcuuaaaggcaaaccagaagacgcgguuaucgucaaagcaccccacucugagaccgucaucugggacaagcaagacgaaguaaaacaacuuaagaaaauaauggaauaucgccaucuccucgugacccacgaaguauacgauaaucacggagcacucuuuaaccaaacaauacauccagcgaaaaaccccaaaaaccgaaaacuuauaccacgcaaaaccacgcaauccacagagcuauacgggggcuacagcggagagacgacaggauaccucgccaucgcaagaacagucaccaaaaacaaaauaagcuaucagguccuucguguaccaacacgacucgugggccgucuccaacguucuagcgaguccgcacaacgacaaauacucaccgacugguucgcgcccagcuucgugucccggggaaagcaacaaccauucgaaaucguucuccgccauguauucaaaaaccagacagucaucgacgauauacacgagcaaagucacagauucggacugcgauccgauaccuacuacugcaaccagcaacagcuaguucuaucacucgaacaacaacgcaugaucaucgaccagaaacucaacaacaccaacaaauuaauggucguauacgaagcggugugcgaccaagucgcuaaauauuucccgcuauacagaaugaaccacuucaaggaaucccuacucgaagccggcccaaaacucgcagaacucccaaucaacaccguccaaagcaagaacggcaaacugaaacuaggccaaaggucgguucuccuucagacaaugcaaggacuucaugcaaaccccgaaacaaaagaccucaguaucauuggaugcccuaaauacuucggcaagcuccaaguguccucugguaucaagcucacagaaaacgcaguucuuauccacgaaucaccuacgggccuauuccaacgccgaguccgacuguccgaccuauga

SEQ ID NO: 6509 - RNA, 4056 nt, Artificial Sequence
  Cas9 variant
augaaaauccuaggacuugaccuaggcacgaacucaauaggcugggcaguaguaaacgaagccgaaaacgaacgcgaaagcagcagcaucauucgacuuggggucagagugaacccgcuaacagucgacgagcagaauaauuucgaaaaagggaagcccaucacaaccaaugcagacagaacccucaaacgauccaugcgaagaaaucuccaacgauacaaacucagacgagcgaaccucgucucacuccugaaaacucaaggcuggauaacagacgagacccuccugagcgaacaaggcaacaacagcaccuucgaaacauaccgccuacgagcagaggcagcuacaaaggaaauaacccucgaacaguucgcgcguguccuacucaugcuuaacaaaaagcgaggauacaaauccucacgcaaaaugaagcacgacgaagacggaucauucgucaauaaccuagacauugcccgcgaacuauacgacagcggcuuaacaccagggcaauacgccuacaaccuacuaaaagacggcaaaaaguauauuccugacuucuacaggucugaucuacaagaggaacuagacaaaauaugggcuuaccaguacgaguaucaugagaacauauuaacgcacagucuccguucagccauuaucgaucaaucaaaaacgggcaccaccaaaauauuuuuaaaaacacacggaauauucacagcagacaucaagggcaacagaaacgaacgaaauaaacaacucuucgaacuccgcugcggcgcgcucgagcgagcccuaacagcggaggaacuggccacgguaauugcagaaguaaacggccagauaaacuccucaucaggguacuugggggccaucagugaccgcuccaaagcacuuuucauaaaccaccagaccgucggacaauaccuuaugcagcaacuggaccgggacccgaacaagagccucaaaaaccaacccuucuaccgccaagacuaccuagacgaguucgaacagcucugggaaacacaggcccacuaccacccggaacugaccgccgcccuuaagcacgaaauccgggacauaaucauuuucuaccaacgaagacugaaaucacaaaaauggcucguggcgaacugccccuucgaacaccgaaaagucugcccgaaaucguccccgcuauuccagcacuuccgaaucuggcaagugcuaaacaacguuacaguuacagucgacaauaaaacauacgugcuaaacgaagaacaaaaauccauccuuaguaaagagcucuuguauaaagagaagauaucgaaacgugaugcguuaaagaugcuauucguuaaagcuaaagguguagacaugaacuucgccucacucgagggagaccgaaccauguccaaccuucucaaggcagcccaagagaucgucuccaucuccggacauggagacuacgacuucggaaagaugcccgccgacgacauucacaauauuauccgcucaguguucggaggccucggauucgcuacagacuggcuaaaccuagacacagacgcggacgauuuagaacaagaaucacagaugcgauuguggcaccucauauacucauucgaaggcgauaacagcaccacaggagauaccaaacucgucgagcgccucaugucccuccucaaucuuccgcaagaauacgccagacuguucgcaaaugugcacuuggaagacgacuauugcgggauaucaaguaaagcccucaagcgcauccuaccguucaugaaggcaggccacaucuacucagaggcuugcgcccucgcaggcuacaaacauagcgaacagagcuugacacgugaagaaaacaaaaaucgcccccucaaagaccaccuugaacaacuacccaagaacucacuucgaaacccggugguugaaaagauccuuaaccaaauggucaacgugguuaacagcaucaucgauaccuacggacggcccgacgaaauccgaauagaacucgcccgggaacucaaaaacaacgcacugggacgacaagcuaucuucgaagccauaaaccgaaacacaaaagagagcgaaaggauccagcaaauccucaagaaagaguucggccuaacccaugugagcaggaacgacauuauccgcuaccgccucuaccaagaacugucgggcaacggcuacaaaacgcuauacagcaacaucuacaucccacaagagaaacucuucuccaaggaaauagauauagaacacauaauaccccaagcccgccuauuugacgacuccuucucaaacaagacccuggaguaccgagauguaaacauaaagaaaagcaauacaaccgccaucgacuuugugcgaaacgaguacggcgagaacgaagucgaacaauacaagaagcgagucaacgaccuccucaagagcggugccaucucacaagcgaaagccaaaaagcucaagaugacagaggccgagaucccaaaugacuucaucgaacgagaccugcgcaacacacaauacaucuccaggaaggcacaggaaauguuacgcgacgucgcacgcguaguuacagcaacgaccggauccguuacggaucgacuacgacaagacuggcaacucguggacgucaugcaagagcuaaacugggacaaguacgagcgccaggggcuaaccaccgucauaaacggccgcgacggacaacagauccgucgcauaacagauuggaccaagcgcaacgaccaccgacaccacgcuauggaugcccucaccauagcauucacaaaaccggcuuacaucuccuaucucaaucaccuaaacgcccgcagcgaagacgacauccgaucgaucgaacgacgguuccuggaaagagacgcgaacggccaucugcgcuucaucagcccuauagcccacaauuuccggucagaagccaaacgccaccucgagaugauccugguuuccaucaaggccaaaaauaaagucgucacccggaacaacaacacaacaaaaacaaagggaggccgacgaaaccgcauacaacucacaccccgugggcagcuccacgacgcuaccguauauggguccaucuugcucccacacacgaaaacaaucgccgucgacggcaagaugacagcugaaauaaucggccaaguccaaaacccaguauuccgacaagcacuuucacaacgacuagaagcaugcggcaacgauccgaagaaagcguucacgggcaaaaacucgcuugaaaaagcgccaguuuggaucgaccaagcccacaccgaacacgugccagccgaggucacgauccaacgacuugaaccacagcauaccauccgacgagccgucaacaaagaccuuaacauuaacaaaguacuggacaaggguauccagcauauucugcaagcccgccuagacgcguacggcggcgacgccgcaaaagcguucgcgaaccucgacaacaauccaauauggcuaaaucaggaaaaaggaauagccauaaaacgagucaccacagccgagaacaucucuggagaaccccuccaccacaagcaugacaaagagggacgcccgauacuagacaccaacggcaaaccuaugccguccgacuuuguaagacucaugaacaaccaccacgucgccauauuccaagacgcugacggcaaucuccaagaacauaucguuagcuucuacgaagcagucgcacguguaacagaacuaggcuuaccaguaaucgacaaggaguauaacaaagacaaaggauggcaauuccuauucacgcuuaaacaaaaugaauacuucguauuccccaacccggcacaaggcuucaaccccgacgaaauagaucuaacggaugaacgaaacuacucacgcauuucgccgaaccucuaucgcguccagaaaauguccucaaaauauuacgucuuccgccaccaccucgaaaccacggucgaggacaagaaggaauuacagggaauaaccuggaaacgaauccagagccuaaacaaccucaaaggaaucgucaaaguucgcaucgaccacaucggaagaauaguccaaauaggcgaauacuga

SEQ ID NO: 6510 - RNA, 4056 nt, Artificial Sequence
  Cas9 variant
auguucagccaacagaacaaccuguacugcgagagcuuguccaaacuuuauuacaacauuaccaaaaacuuccucucuaaaaacgaggugugccgaaucuacgagaucuucuucugcuccauccugacguacuuccuaaagaaauauaaucacgacaucuucaaaaagagcagcacgaugaagaccauccuugggcuggaccuaggcgucaccuccauaggcugggccgucaucguaacggacgacgacaacacaccgaucaaaauacuaggcaugggaucccgcauaauuccacuaucaacagccgacaaagaagaguuccaaaaaggacaagcaauaagcaaaaaccagucacgaacgauagcacgcacacagcgaaagggauacaaccgcaaacaacuucggaaagaggagcucaagaaaauccuaggcgaauuaggaaucacgcccucaaaagaacuucucaaccuccccaguauagagcuauggaaacuacgagccgacgcagcauccggcaacgcgccacucagcgcggaacaguuaggucgcaucuucuacaugcugaaccaaaagcgcggauacaagagcgcccgaucagaagcgaaccaggacaagaaagacacagauuacguagccgccgucaaaggacggcaccaacagcucaaagaaaaaggccagaccaucggucaacacuucuacacggaaaugcucacccuagaggaaaacuccggacacuuucagguuaaaaacaacguauacccccgcgaagcauaccuagaagaguucaacgcuaucaucgcugcccaaaagccccagcacgccuuccugaccgacgacgugguggaucgccucagagacgaagucaucuuuuaccaaagaaaacuaaagagccagaaaggauuaguguccaucugcgaguucgaaggcuucgaacguaccuuuuucgacaacgucaagcagaaagacaaaaccaucuucacaggccccaagguggcgcccaaaucauccccgcuuuuccagcuguguaaaaucugggagaccgucaacaacauaaaccucaaagugaagaacaccgacggaagcaaaaauaaaugggcagauuacguacccacccucgagcaaaagcaagaaaucauagaacaccucuucaaaaaugccggcauuagccucgaugcacugagaaaaauccucggauucaauaaggacgaaaucuucguaaacaagcaaaucgagaaaggacuucaaggaaacaccaccuacgcagaaauucauaaaauacugggcgacagcaaaccugaacuacugggauucaacauaaacauagagcccagcaaacacagcgcgcuucucguagacaagcguacaggcgaaauccuagccgaaaaagaaggacagcaagucuccgcagagaucgaaaaggagaauuucuaccagcucuggcacacaauauacuccauuaaggaccuagacgaaugcgccgcggcgcucaucaaacgcuucaacaucgacccaaacguagcggcucagcuagccaaaaucgacuucuccaagggcgcauucgggaacaaaucgaacaaagccaugcgaaaaauccugccauaccucaugcaaggcuacaacuacgccgacgccugcucccucgccggcuacaaucacagcgacucccaaaccaagaaagaaaaagaagaaaacguagucgaugacaagcuaaaauuacucgagaaaaacucccuacgccaaccgguuguagagaaaaucauaaaccaaaugauccacguagucaaugccaucaucgacaaauacggaaaacccgacgaaauccgcgucgagcucgcaagagaucucaaaaaguccaaagacgaacgaaacgaggccgaacugcaaaacgccagcaacaagaaacuuaacgaagaagucgcaaaccgacuaaaagaacuuggccucccgguaaccaaacgauucgugcaaaaauacaaguucauuuucccaguccgagaccgcaaaaucaaagaagcccagcuaguuaaccagugcaucuacugcggggaaacauuuaacgucaccgaagcccucuccggggacaauuucgacguggaccauaucaucccaaaaagcauguuauucgacgacagccagaccaacaagguacucguccaccgcaaaugcaaugccaaagacaaaucaaacaaaacggccuacgacuuuauagccgcgaagggagaaaacgaacucgcaauauaccuagacaggguagacgacugguucaaacgcgggguacucagcuacggcaagaugcaacgccugaaggucagcuacgaacaauaugccgaacgaaagcaacucaagaaagaaacagaggcggacaucaaacugugggaaaacuucauagagagagaucuccgccaaacacaauacaucgcgaagaaauccaaagaccuacucaagaaaaucugcaacaacgucaccgugacggaaggaaaaaucacugcgcaacugcgcaaccucuggggcugggacgacguccucaugaaccuccagcuuccaaaauacaaagcucuaggccagacagaaaucaaagaauggaccagcgaacacggacgaaggcuccacaagaaagaagaaaucacuaacuggaccaaacgcgacgaccaccgccaccaugcaaucgacgcccucgugguagccugcacaaaacagggauucauacaaagaauaaacacacuaaacucaucggacacgaaagaugcaauggaccgcgaaaucaaagcggcgaaagagaaauacaacgaacucuacgacaagaaacuccucacagagacaaacgaacaagugaagaaccacacggaacgguucaacaagcuagaaacauaccucaagucccaacagccuccacucuucaccacacguuacguggaacaggaggcggacaaaaucuuugucagcuucaaagcggggaaaaaggcagccacguacggcaucagaaaaaucaagaaagacggaaagaagguaguaguacaggagaaaaucguaguccccaggggcgcacuacaugaacaguccguuuacggaaagaucaagacccaagagaaagacaaaccacugaaguaccuauucgaaaaccccgaaaccauaguagacaacagaauaaaaauucuagucaaagaacgacuagacaaguucgaaggugacgucaagaaagcgcucaccucccugaagaaagaaccucucuucauugacaacgagaaaaacacucuccucgaaaaagccgccugcuacaccgaugccacaguacucaaauacaaacuucaagcacucaaagcgaaucagguuaacgauauuguagacgaaggagucaaacgcaucgucaaagcccgccucgcccagcauaagaacgaaaaggaagccuucaaagacaccgugugguucaaccaggagaagcgaaucccgauaguuagcguccgggucuucgcgcgaccggacgcaucgaagcuagcaauaauuaaaaccgacgagaauaauaaaccgaucgguuucgcgcucaccggaaacaaccaccacauagcuauauacaaggacaacacagggaagcuaguacaacacauuugcaccuucuggagcgcuguagagcggaagaaauucggcgugcccaccgucguuaaaaacacggggacacucuggagcgaacuccugcacaaggaccuaccggguacauuccucgacaaacuuccgcaagacggacucgaacuagaauacucacuacagcaaaacgaaauguucguccuaggauuaccgaaggaguccuucgaggacgcaauuaagaacaaugaccugccccuucugagcaaacacuuauaccucguauggaguaucagugauaacgacuacugguuccgccaccaccucgaaaccaaaaacucugagcucaagucgacaacaggcgccaaagaaagcaagcgauacuauagauuucaaucagucggcacuuucacaaaagaaaacccaauaaaaguccaguuaaaccaccuaggagaaauuacgaagauaggugagccauga

SEQ ID NO: 6511 - RNA, 4059 nt, Artificial Sequence
  Cas9 variant
augaagaaacgaaaccgagaagaguacuacgucggacucgacaucggcacaagcuccguaggaugggcgguagccacgcccgacuaccgcauaccaaaauuccgcggucacaaaauguggggaagccgccucuucgccgaaggaaagcgugccgccgaacgccgccaauuucgaacaaaccgacgacgacuagcucgcagaagagaccgacuccagauacuugaagaacucuucgccgaagaaauggccaaaguagacaacacguucuucaugcgcuuaaaagaaagcaaauucuuucuggaagacaaaacggucaaagagaaacacauucucuuuuccaccgacaaauucgacgccgacagauuuuacaaggacaacccgacgauauaccacguacgcaagcgccuuauggaagaggaaccccaagacauacgcgaacucuuccucgccgugcaccacauacuuaaauacagaggccauuuccuguucgcggggagccucgaacagaacggugcaagcaucgaagaacucguacguaccuuacuaggcaaacaaggacuagcuauucucgaugacaccauagacuccaacgaaaugguaaacauacugaaaaacaccggcgaaaccaaaagcgaccgaaagaaagacguccaagaguuauggaacccacugaaagacaagguaaagaaagcgcaagcagcugaaauggcaggacucgugcuaggacugaaaagcgauauaucgaaacucuucgccaacucugacuauaaggaccucgacaguagcauaaagaacaucaacuucagcucuggagacuacgaggagaaaagggacgacuacgcgaacaguaucggagacgacauuguccugcuagacacaaugaaagcacucuaugauacccucauacucucgcaaauccuccaaggcaaacguuccaucagcgcugccaaaguugaggacuacaacacacacaaagagcagcuacgcgcacuaaaagccauucuaaagccucacaaaaggcucuacaacgagauguuccgcgaaaauaacaagaaagaccucucaaacuacguugcguauaucagcuccuauucggaaggcaaacgagucaaccgagaaggauuuuacaaauacguccaggcaguacucaaacaggucgacgauucagacucuaagcaagcgauccuggaagcgauccgccuagaaacguuucucccccugcugcgagucaaagauaacgccgugauuccgcaccaaauccaccaggccgaacuggaggcaauccuugaaacagcucgcaagaaauacaacuuuuuaaaugacguauccgauggcguaaguguaaaagacaaaaucauucaacuguucacuuuccgaauccccuacuacguuggaccgcucaacccccacagcggcgagaccguagcagaucgcaaacagggaaccgguugggucguccgaaaacaaagaggaaaaguguaucccuggaacuucgcagacaugguagauguuaaagcauccgcggaagcauuuaucacaaaccuaaccaacaaauguacuuaccuaauaggagaagacguacugcccaaacggucucuccucuacucagaguucaugcuccucaacgaacuaaauaugauaaaauacgacggccacgaacugccuguggccaucaaacaacucuacauagagcaagucuuuaagcaagaacacaagaaacaaaccaaagggcggguucucgacuuccuaaaacgaaacggauugauaaccggcucggcaacugcaguaauaacaggcauggaugaugcaaucaaaggagaccuccaauccuauagagacauggugcguauauucggagccggauucgaccacagcauggccgagcgaaucaucagauggguaacacucuucggagaggccaaagacauccucgaaaacaaaauacgcgaggucuacggcaacagcaucagcgauagccaaaugcgcgccauaaagaaacucaaguacgcugacuggggacgcuuaagucaagcauuccuaauagcagucaaagggugcgacaaaagcgguguagaacgcaacaucaucacaugccuacgcgcauccucccaaaaccuaauggaaauccuaagcgaccaaggcaccuacaucaagcaaaucaaagccuggaaccaccaacacacaaccaacaugauggacacccuggacuaccaacucguagacgaccuguaugucgcacccucugucaaacgcagcaucuggcaaucgcuaugcauaguggaggaacucgucaaaaucaugggccaagcaccaaagaaaaucuucgucgaagucacacguacuaaacaagcggaaaagaccaagaaagacagccgaaagaaacgguuggucgaacuauacacggccaucggcaaagaaggagcugcguggaagaaagaaaucgaagcccaccaggccggcgacuuccggcgaaagaaacucuaccucuauuacacgcaaaugggacgcugcauguacucaaaugaaccaauugcuauggaugcccucuucaccagcgcauacgacauugaccauaucuacccucaaucacucacaaaagacgguagcugggacaaccucgugcucgucaaaucccaacugaacaaagaaaaaucagaccaauacccacuccgaccagcgauccgcgagaaaaacaaagcccacuggcaguaccucugcagagcgggcuucaucuccgaaaagaaauacgagcgacucaugagaacaacggaacucaccgcagaggaacucucaggcuucaucgcuagacagcuagucgaaaccucgcaagccaccaaagcagucaccggccuauuagaaaggauuuacaccaauacagaaauauguuucgugaaagcugagacgguaagccaauuccgacaccaacacaacuucaucaaaauccgggaacuuaacaacuaccaccacgcaaaagaugccuaccugaacauagucgucggaaacgucuaccacgaaaaauucaccaaaaaccccugggaguucaucgccagaagcacagaacgucgacccuacaaccuaaaccgcauguaugauuucgaccuacucaagcaagggagaguuauauggcaagugccgaagagucucgaaacgguacaagccaugaugaaauccaacgacgugcgcauaaccaagaaacuucuaguccaaaagggagaacucuacgaugcgacgaucaccaaagcacacaaagcgaaagaggggacauacuucccacuuaaaggcgccgacgcgcgucuaagagacgugcaccgauacggaggcuacgagaaaaucaaaauagcauacuacagcguauucagcugucgcgaaaaggcaagcaacacgauccacaccuuaauaauaccuaucccaguauacaaggcugggcuccuccaaacagaagccgaccugaccgccuacgcauggcaaacaaagcagaaaacaaaaccgaucaaggacauauauagcgccaucacacccauauacaaaaagcugugcaucaacacggugguaaaaauagauggguucaaauacuuucuugggggcaagacaggggacuacauguggcuagacccagccaucccagucgugcucgaugaacaggcggccgcauaccuaaaagccaucagcaaagucggccgagcugacgaugucgaaaacacagcccaggccauagauuuaauuacagcagaggccaacgaagcguucuacgacguucuacugaaaaagauggaggcgaaaaucuuugccaaagccuaccagacuauaguagaaaagcuagcguccgaaaccgcacgggagcgguuccgcgaacucuccaucggggcacagugcagcugccugcuagaaauccucaacuugcucgccaacaacaaaaccacauuuacauucuuuaaagacaaaaugggcgugaccaugagccgaaggaaacaaccgauggaccuuaccaaacuagaggagugcaucgucuacgaaacuagcaucacaggacuuuacgaaaaagccgucucccuacuguga

SEQ ID NO: 6512 - RNA, 4059 nt, Artificial Sequence
  Cas9 variant
augggcaagagguaccacaucggacucgacauagggacgucaagcaucggaugggccguaauggacgacgacuucaagauaaugcgcgucaaaggcaagaagggcauaggcguccgccucuucgaggaagggaagaccgcugccgagcgccgaggacacaggacaacccgacgacgguacagccgacgcaaguggcgacucaaucuccuagaagaaauuuucgaccccgagaucgccaaggucgaccccaccuucuucgcccgacucaaagagucaaaccuaucccccaaagacgaccgcaagcaauacucgggaaaucucaucuucccggaaaaagcgaaggaagaaauccgcgaguggaccgagaaguaccccaccaucuaccaccuucgaaacgcgcuaaugacagaaaaccgccaguucgacauucgcgaggucuuccucgcccuccaccacaucgucaaauaccguggcaacuucuuguuuaacgguaacuuccagaccggugaggucaacuuguccgaccgguucgacgacauaaacagugcuuucaucagcgccugcggagaggaagaggcaccccagaucccauccgagcuguacaacgauauccaggaacuccuauucgacaaaaacacgagaaagcuagauaaccaaaaacaacucgccaccaaacuaucccaagacaaugacaaggauuggucaacccaauucuccaaagcacuguucggguacaagaccaaguucaaaguaguccuccaaagcaacgaggaccuagacgacuuucaauuagacuccgacgacgccgacgacaaaaucgcaagcaucagcgagcagauagacgacgaccgaggaagcauccuggacaacauuaagauacuuuacagccgaauaacgcucaaugaaaucgucccagacgggaaaacacuuucucaauccaugaucgaaaaauacaaccuucaccgggaccaccucaaagaaaucaaagaccaacuaaaacacacugacaacugggucaaauucgacgaucuguacagccaauacgugaaugggaaacuagagucagaccgacacaagaaacucucaucagacgacuucuacaagaaaguccuuacccucuucgacggggaacuaaaaacucgcgucaaagaguggcaagagaaaggagaauuucuccccaagcaacgcacaggaagcaacggagucauaccccaccaacuccaccagaacgagcuggaccaaaucauagaaaaccaguccaaauacuaccccuggcuagccacacucaaccccaacgaaaagaggcaacggguagccaaauacaagcuaagcgaguuggucgcuuuccguaucccauacuaugucggaccgauggucacuaaggaccaaucggacuucgcauggaugguccgcaaaagcgacgagaaagaaaucacaccauggaacuuugaccaagucguagaccgagacaaauccgccgaagaauuuaucaaccgaaugacaaccaaagacacguaccucauaggggaagacgucuugccagcgaaaucccuacucuaugagaaauucacuguccuaaaugaacuaaacaacauucguaucaauggcaaaccacucacgacagaugaaaaacaccagguauaccgcgaccucuuccaaaacgccaaaagcaucucaacgaagaaauuccacaacuaccucguguguaaacucaacaaacccaaucaccugaacaucaccggcuucagugaccucacgaaguucaacuccucacucgacuccuacaucgaccuuaaaaagauauucgcagaccaaaucgacgaccagucguuacaggacgacuuugaaaagaugaucagauggucgacgguuuucgaagacaaacaaauauuugagcggaaacuaucagagaucaacuggcucaccgaccaggagcgauccgaagucgccaagcucagauaccgcggguggggccggcuauccaaacgacuacucgcaggcauccacgacgagaacggacagcgaaucaucgacgcccucuggaacucgcccaagaacuuuaugcaaauccaagcagaagucgcuuuuaauaaacaaaucaacgaccucaacaccaaagaacucuccgacaacaacgucgaagauguccucgccgacgcauauaccagcccacaaaacaagaaagccaucagacagguccuucucguuguagaggacauacagaaagcaaugcauggcgacgcgcccacgucaaucagccuggaguucgcccgcgaggaacaagaaagcagcaggacgcgcuccagacgcgcagcacuuucggcaaccuaccgacagauaucagacgaaaucguaucagccaccgucaaaggagaacucggaaaagcaacuuccaucuccgacagacucuaccuuuauuuuacacaagguggacgcgacauguauacaggugaaccgaucaacaucgacgaaauaagcaggggcuacgaaaucgaccacauacuaccccaaucauucaucaaagacgacucacucgacaaucgcguucuuguaaaaggagcaauaaacaacggcaaaucggccaacuacgucauggaccagagcugggccccagaucgccucgcuugguggaagaagcuacucgauaacaggcuuaucucucgaaagaaauaccaaagccucacucuaaccccaggcaaaauaaacaaauacucccaaaacggcuucaucaacagacaguuggucgagacuaggcaagucaucaagcuagucgccaacauccucaacgaccaauacuccaacgacgacacaaaaauaauaguggucaaggcagcgcucaacucccagcuacguggguuucuagagcuauucaagaaccggaacaucaaugacuaccaucacggaauggacgccuaccucuccaccuucaucggaaacuaccuauacaaaaaguauccaaagcuacgguccuacuucguauacggcgaguucaagaaauucucaggcaaacaaaaccucaaaucguucaacuuccuucaugaccucgaagacgacucaauuaauauuauauccaacgaugacggcgaaaucgucggaaaccaucacgaaaugauagaagaacuggagaaagccuaccaguauaaauacaugcucgucagccgggaagucuuugagaagacaggugaccucuucaaugugacaguauacucccgaaaagcgaaaaagacccucauccccaucaaacaggacaagcccauaaacauauacggcggcuacagcggaaacaacgacgcauacauggcuaucgucaagcuaccagggaaaaagggaaaacccgacaccuacaaaaucgugggcauaccccugagguucgccggugaacucgaacgugccaaacaauuaggagagucagcauaccgcgagaaacucagcgcugucaucaccccacaguucacgaaagaaaagaaagaucgcaaaacaggugagaucacgaaaguagucgacgacuucgagguuguucuagaccguguucccuauaggcaacuauucaaagacagcgacaaaugguuuaugcuaggcucugcagcguaccaauacaacgcaaaacagcucguucuuaacaacgaugacgucaaacuccuaaacgaacaaggcagaaagaaacuagaacuucccaacgaaaaacuguccuccgcccuaaaugacguuuucgaccacauaauacagaucaugaauagcaaauucggcuuauacgacaaaaacggcuucaggacgaaacugaccgaggcagcuuccaucuucuacgaccucccacuacgcgcggaauacaauggcaacaagaaagucaccgacggaaaacuagagguacucgacaacauacuuauaggucuccacgccgauccauccuucggaaacuuaaaacagcuaaacauguccacgccguucggccaaaugcagacaaagggaggagucguccucaacgguaacagcacacugaucuaccagagccccaccggacuauucgaacgacgcgugaagcugaaggaccuauccaaauga

SEQ ID NO: 6513 - RNA, 4059 nt, Artificial Sequence
  Cas9 variant
augaaaaagauccucggccuggaccucggcaccacgucgaucggcugggcuuucaucaacgaaggugaaaacgacaacgaaacauccucgaucauaaacgcaggcguacgaaucgucccgcugaccacagacgaagaagcggacuucaagaagggcaacacuaucagcaucaacgcagaccgaaccuugaagcgcggcgcucgccgcggacuccagcgcuucaaacaaagaagagacgcacuccuacaguccuucagaggcauuaacuuuauaucgagcaacuacguauacgcggaaaccggcaaacaaaccaccuucuccucauacaaacuacgcgcuaaguccgcgaccgaacucgucaccaaggaggaauuaguacaaguccuccucaugcugaacaaaaagcgaggcuacaagucuucccgaaaagcuaaaaccgcagaagaaggcgacgccaucgauggaaugaagauagcaaaggaaaucuuugagaacaaucuaacuccgggccaauggguauacaacagccugagcaucgggggaaaauucauuccggacuuuuaccgcucagaccugcagaaagaaguugaaaagaucguccgguuccaaaaccaauuccacccagaacagaugaacgaaaaacuccuagaaaacauccaaggcaaagcccgcacugucacgucccaauacuucucaaggauucuuaacaucccacuggccgaaaacaaagggacccgagaagaaacaaaacuccaacacuacaaauggcgaaaugaagcccuaacagaggagcucgaccuaaaaguacucgccuucaucaucaccgaaauuaacaaccaaauaaaccaaucuaacggcuaccugggagcaaucuccgaccgcucgaaggaacuauacuucaaccaggaaacagucggacaauuccaauacaaucaacucaaagaaaacgcccacaccaaacucaagaaccaggucuucuaucgacaagacuaccuggaugaguucgagaaaaucugggaaacacaaagcaaauucuaccccgaacugaacgacgaacucaaaagcgaaguccgagacaucacaaucuucuaccaacggaaacugaaaucccagaagcaccuagucagcuucugcgaguucgaaaagggccacaaggcgaucccaaaaaguucgccuuuguuccaggaauuucgcauauggcagaacaucaauaacauaguggucaaaaacgaaacgacaaaggaacccuuccuccuaggggaagaccucaaaaaggucaucgcacaggaacucuccuucaaagaauccaugaccgacucacaacuacuuacguucugcgaucucaaaaagggaacucacacggucaauuucaagaaaauagaaggcaaccgcacgaacaccucacuauucaaagccuucgaaaagauccucguccucgaaggcuacgacgaauuggaucuguccaaacucgacgcguccgacaucaaaagcaucaucaaaucagcauucucugaccucgaaaucagcaccgccauucucgacuucgaccccacgauccaaggcaaugauuacgacaaacaguccuacuaccaacucuggcaccuacuauacucuagcgaagaagacgauuuccuuaagaagucccucauggacaaguucggauucaaagaaagccaucugcccuuccuacugaacauuaauuuacaagccgacuaugggucccucucagccaaggcgaucaagaaaguucuaccccaccuaauggacggucacaucuaugauaaagccugcacgcuggucgguuauaaccacuccagcucacucaccacugaccaaaacaaugaacgaguccugaaagacacacucgaacugcucaagaaaaauucccugagaaaucccgugguagagaaaauccuaaaucagaugauaaacguaauaaacgccaucauaaaagaccccgccaugggaaaaccagacgaaaucagaguggagcuggcccgcgagcuuaaaaacaauaacgaacagcgguccgagaugaccaaagcaaucaacaaaucaaccaccgaacacgaacaaauccgcaaauuauuacauaccgaguucggaauacaccgaguuacacgcaacgacaucauccgcuacaagcuauggaaggaaugcgacggcauuucccuauacacaggcaagccuaucgagccaucaaaacucuucaccaaagacuacgacauagagcacauaauucccaaaucccgucuauucgacgacucguucucuaacaaaaccaucugcgaacggcaacucaacauagacaagucuaacaagaccgccuacagcuucuuucaggaaaaacuuuccgccgaagaguuugaccaguucgaaaagcgcguuaaaucccuuuucggaaagauaucccgaaccaagcaaaacaaguuacugauggccaacaacgaaauuccugaaggauucaucgaccgucaauuacgcgaaacacaguauaucgcuaaaaaggccaaggaaauccuccucgaaguaagccggaacgucaccgccacaauagguagugucacagacaaacugcgagacgacugggaacucguagacgucaugaaggaacucaacugggaaaaguacgacaaacuggggcucacauacauagaggaaggcaaaaacggggaacgucuauacaaaaucaaagacuggacaaagcgcaacgaccaccgucaccacgccauggacgccauuacagucgcauucaccaaacccgcauauauccaauaccucaacaaccugaacgcccgaacuaacacagacaagaaaggcaacuccaucauagguaucgagaacaaauaccucaaacgagacaagaacaacaaacuacgcuucaucgaaccaauccccaacuuccgcgagguagccaagaaacaacuagagagcauacucauaagcuauaaagcuaagaacaaaguugucacgaaaaacaaaaacgucacaaagaaaagcaacggcaccaaccagaaaauucaacucacacccagaggacaacuccacaaagaaacaguauacggcaaacuacaacaauacgugacaaaagaagagaaaauaaaugcaaauuucacaccagaauaugucaccaaggucgccaagaaagaauaccgagaagcacugcuaaaacgacuaaucgaaaacgaaaaugauccuaagaaagccuucacaggcaaaaaugcucuuucuaaaaauccgaucuacaucucauuagaaaacaacauccuagugcccgaaaaaguaaaaauagucuggcuuaaaucggacuacaccauacguaaggacaucacacccgaccucaaaaucgacaaagucaucgacaucggacuaaaaacaauacugcaaaaccgcuugaacgaguucaacggagacacaaagaaagccuucguuaaccuagacgagaaccccaucuggcaaaacaaagaaaaaggcauagccaucaaacgcgucacgauaucgggaguuuccaacgcccaagcccuccauacgaagaaagaccaccuuggcaacgagauccuagacgagaauggccaaccacuccccgucgacuucgugucuacagguaacaaccaccacguugcaauauaccgcgacgaaaaaggaaaucuccaagaggaagucgucagcuucuucgaagccguaacccgaaacaaccuaggccucucuaucauaaauaaaaaccaugaaaaaggaugggaauuucucuucaguaugaagcaaaacgaguucuucaucuuccccacggauggguucaacccgcacgaaaucgaccugcuaaacacagaaaacuaucaucuaaucagccgcaauauguuccgcguacagaaaauugccaccaaaaacuacauguucaaccaccaccucgaaacaaaauccguagauggggaaaugcugaaaaccaagaaacaacuaagcaaaauaucguaccacuucauacaaacccccuccuaccugaacuacaucaucaaaauccguaucaaccaccucggccagaucguucaguuaggagaauacuga

SEQ ID NO: 6514 - RNA, 4059 nt, Artificial Sequence
  Cas9 variant
augaaacaagacuacuacauaggccuagacaugggaacggaguccgucggcugggccgugaccgacgucgacuacaacuugaucaagaaacgcgggcaagacuacuggggcguauaccuguucgacgaagcucaaaccgcccaagggagacgcgcauucagaacaaaucgacggcgccuagcccgcguacgccaccggcugaaccugcuccaggaacucuucgacucagagaucagcgcaaaagacuucggcuucuucuaucgguuggagaauagcaaauacuucgacgaagacaaacccgaaaucgcaagagggaaguuccugcuuuucaacgacaaagacuucggagacaaagaguauuacaagaacuacccgaccauauuccaccuccggaacgcccuaagaacgcaagagauuaaggacgugcgacuacuauaccuagccgugcaccacauccucaagaacagaggccacuucuuauucggagaacaagacuucaauguaaacgaugccucugacgugucaggggaguucgagaagaucaaccgguuccucagugagaacgacggcgcaggcuucgaccgggagaaaauccccgaaaucuucgaaacacuaugcaaugagaaccuggccaaacgcgagcgcaaagagaaaauccucgaacucgcagggaacaguaagaacaaacuccucggcgaagcggucaaugccguagucggccucaauuucucacuaucgaagauguucggugaggacagagacuuccagggagaaaauaagauguccuucaccgacagcagcuucgaagagaagcuggcaaaggcacgcauggcgcuggacgacgacgaagccgacuuccuggaaacgcucaagaaaguccagagcguugccagccuccauaacauccuacacggcaaagaguucauaucagaagccaaaacggaggcuuacgaaacgcaccgcagagacuugagcgaguugaagaaauacguaagggaaaacugccccgaaaaauacgcccuaguuuuccgccgccagguaaagaagggaaagaaaaacaccagcggagcagacgaaaacgagaaagaugacaagaaagugaacaauuacgcggccuacauagguauggauaaaggcaaaggcuucgaaaaaugcaagaaagaggacuucuacgcauuccucaagaaagaaauaggcauaaacgacgagucgcuccuugcgaaaaucgacgaaggcauauuucucccgaaacaaaucucagcagaaaacugugacauuccauaccaagugcaccucgcggagcugaaagcgauccucgcgaacgcggaaaacuacuucccuuuccugaagcaaaaggacgagaacugugaaaugacagucuccgagaagaucauaucccucaugaaauuccggguucccuacuacguagggcccuucaccgacaaggaaaccagauucagcuggaugaucaagaaagaagggcuuucgacacagaaaaucacgcccuggaacuucgacgacguaguugaccgggacgccuccgagaaaaaguucaucgagcggaugacaaacuucugcaccuaccuaaccggagaaaaagugcuaccagcaucgagcuuccuuuauagcgaguacgcauuccuuaacgagcucaacaaucuaaaagugaauggaacgaaagaccuccgcgucaaaaacauccuauucgacuucgccaaaacgaacaagaaauugacacuaaagaaaugcugcgaacaacuugugaaaaauggccuccugcccgaggguuccaaagcccgcgacguauucuccggaaccgacggcgacuucaaaaacucccuaagcagcuacauagauuucaaaaggauaaucggagacaaagcagacuuauauagggacaugugcgagaaaaucauacuguggauuacugucaucucggacaaagaaagacucgucaaaaucauuaaggacaaauacggcaccguacuuuccgacgaggaaauaaaaggccugaaagcacuuaauuacacaaaguggggccggcuaagcgaaaagcuguuggacggaaucuuugagacugacuccgaaggcgaggucggaaacgugucaauaaucgagaaaaugcgcaccgauacugaaaacuucauggaauugcucuccaacaaacacaacuacaagcgcgcaauagaacucgcaaacagcgaaucgauaguugacgagcgagugaccuaccgggccguagaggaacuguacugcagcccggcagugaaacgcucuauuuggucagcccuaaagaucguacgagaaauuguaaaaguccaagggcacuccccgaagaagauauuuguagaaacaacccgcgaaaaacccgacgucaccagaaaaggccaacgcacagucucccgcaaacagcaauuacucgacaaguacagggaaaaccuaagaaaugaaacagagcugaucaagaaaauagaagagacugaggacucaaaauucaauucggacaaacucuucuucuauuucacacagauggggaaagacgccuacaccggcgaaaagauugaguucgacgacguauucaaaacagaaaaauacgacauagaccacauauacccccgaucuaaaaucaaagacgacucccucgacaaccggguccuaguaagacggaagauaaaccaaucggucaagaaagacuccuacccacuaucugcggagauacggaaccgaauggaaggacucuggcgucagcugagagacaagaaacuaauauccgacgaaaaauucuacaggcuaacccguagcacaccgcugacugagaaagaaugcggcgacuuuauuaacgcccaacuaaucgcgacgucccaauccgcaaaggcugcaauccaguugcuaaagcgcaugcugcccgagagcgaaaucguguacucaaaggccggcaacguaaacgaguucaaaaagcgccucgaauuuguaaagauccgagaacuaaacgaccuucaccacgcgaaggacgccuacuucaacaucgucguaggcaauguauucaacaccaaauucaaccacaacccagccgucuuccagcgcucgaacggcacaggaaacuaugauuucgaacgguuauacgacuucgacauaaccaacgccuggaagaaaggagacgaaaaccgcaucaggagcguagcagagaaaaacaccugucgagucgugagauucaguaaaacagagaaagggcaguucuacgacgcaaccauuuaccccgcagggaagaacgacaaacuagcuccagucaaaggaaaagccccacuaaacgacaccucaaaguauggcggguacgacaaagagaccacggccuacuucaugcucguaaagagccgcgacaagaaaaagaaagacaaaacccugcucagucuagaaugugucaccgucuuggccgacaaaaacuuccggacggcugaagacaaacuaaaguauugcgaaaaagagcuuggacuaaaggagccagaaauacugauugagaaaauaaaacucaacacacuuuucaaaauaaacggcucauaugccuggauccggggccgaacgaacgaccggcuggugcucugcaacgcgaaccagcuuuggcuggacaacgguagcgcgaaagaacucaagaaaaucuccaaucacuucagagaugucaagaaauacaacaacaaagaccugccuguacgcgaagaggaguucagcaaagaacagaaccucgcccuguacgaccuguucaccgaaaaacucggaggcaaaauauacgccggccugcccguacaaggccaaaucaaaaaucuagaaaaaggaagagacaaguucgaagcccucgaacucaaagaccaguuauucguccuaauggaaauacucaaguucaugcaaugcaacagcaugaccagcaauauuaagcucauagggggcgcagagaacgccggaaagaacagaaucagcaaacugauccaagacagcgacgucaaaaugauauucugcaguccgaccggcuacuucuguaagguaguggacuucaaaagguuccuuuga

SEQ ID NO: 6515 - RNA, 4059 nt, Artificial Sequence
  Cas9 variant
augaagaaaauacugggccuggaccuggggaccacauccauuggcugggcauucaucaaagaacccgaaaaagacgucguuggcucggaaauagucgacaugggggucagaauaguaccccuaagcagugacgaagaaaacgacuucgcaaaaggcaacaccaucagcaucaacgccgacagaacgcuaaaacgcggggcucgccgaaaccugcaacgcuucaaacagagacgcaaugcacuacucgagauauucaaagagaagaaacuuauauccacgaacuucaaauaugcagaagacgggccauccagcacguucucuacgcuaaacuuacgagcaaaagccgcuaaagagaaaaucgaacugcaggaccuggugaaaguccuccuccagaucaacaagaaacguggguacaaaaguucaagaaaagccaaaagcgaagaagacgacggaucagcuaucgacucuauggguauagcgaaagaacucuacgaaaacgaccucacccccggacaaugggucuacgaagcacuccaaaaagggcgcaaaaacgugcccgacuucuaccgaucagaccuacaggaagaauuuaagaaaaucguaaacuaucagucggaguucuuuccggacauauucaacgccucauucguggaagauuggaugggcaaagccagcaccccaacgaaacaguacuucaauaagaaagguguucagcuugcagaaaauaaaggcaaacgagaggagcgacgacugcaagaauacaaauggagggcagaggcggugaacuucaaaaucgaccucucagagauagcccucauccucagccaaaucaacucccagaucagcaauuccucaggcuaccuaggcgcaauaagcgaccgcuccaaagaacucuacuucaaaaaccuaacggugggccaguaucuuuaccagcaaaucaagaaaaacccgcacacgcgcuugaaaggccaaguauucuaccggcaagacuaccuggacgaguucgaacggaucuggagcguccaauccucguucuauccacagcuuaacgacgcacuaaaacgcgaaguccgugacaucacaaucuucuuccaacgcaggcuuaaaagccagaaacaucuaauaucgaauugcgaauuugaagaccaucacaaaguaguucccaaaagccacccagucuuccaagaguuccguauauggcaaaaccuuaauaacuuacuacuuaucaagaaagacaaucuaaacgaaaaauuugaccucgaacucgagaguaaaaucgcucucgcaaacgaacucgccuucaaacgcgagcucaacgucaaagacgcacugaaaauacuaggccugaagccaaacgagugggaguucaauuucaccaagauugaaggcaacaggacgaaccaagccuucuuugacgccuucgcaaagaucaucgaguuagaagacggagaaccgauugaucucggugaccuaaaagccgacgauaucuuggaucaauucagcgaagcguuccugaggauugggauagauacagaauugcuacaaguaaacucagauauagaaggcgcagaauacgaaaagcaaaguuacauacaauucuggcaccuacuguacuccagcgaggacgaccagaaacucaaacugaaccucauacgcaaguucggcuucaagccagaacacgccaaaauacuagccuccauaagccuacaagacgaccacgccucccugagcagccgggcgaucaagaaaauacuaccccaucugcaaagcggacuaaucuacgauaaagccugcaccuacgccggcuacaaccacaguucaucauucacgaaagacgaaaacgagaaacgcgagcuacgcgcagaacucgaacuccucaagaaaaacucacuccgaaaccccguugucgagaaaauccugaaccaaaugaucaacguugucaaugccauccuaaaagaccccgaacucggacguccggacgaaauaagagucgaaauggcacgcgagcucaaagccaacgccgagcaacgcaaaaacaugacaagcaacaucgccagcgccacccgagaccacgacaaauaccgagaaauucuaaaaucugaauuuggccuaaaacgcgugaccaagaaugaccuacuacgcuacaaacuguggcuggagaccgacggaaucucgcuauacaccggaaaaccgauagaagccucgaaacucuucaguaaggaguacgauauagaacacaucauaccgaaagcacgacuuuucgacgacuccuuuucaaacaagaccauaugugaacggcagcucaacauagacaaagcgaacgugaccgcguucucguuccuccagaacaaacuaagcgccgacgaguucgaacaauaccaaucgcgggucaaaucacuuuauggaaagcugagcaaggccaaaauccagaaacuccucauggcaaacgauaaaaucccggaagauuucauugcacgccagcuacaggaaacgcgcuauauaucuaagaaagccaaagaaauccuauucgaaauaagccgacgcgucagcguaacgacugggaccaucacggacaaacugagagaagacuggggacucguagagauuaugaaggaacuuaauugggagaaguacgacaaacuaggccuaaccuacaccaucgaagggaaacacggggagcgccucaacaagaucaaggacuggagcaagcgcaacgaccaccggcaccacgccauggacgcacugacaguagcacuaaccaagcccgcauacauacaguaccugaauaaccugaacgcgaaagggcuaaacaauaagaaaggcaccgagguauucgccauagaacaaaaauaccucaaacgcgaaaacgggaaacuuuguuuuauaccgcccaucgaaaacauacguuccgaggcaaagaaacaucucucgaggauccucguguccuacaaagccaaaaacaaagucgucacgaucaacaaaaauaaaacaaaaagcaaggccggccuaaacgagcaaaucgcccucacacccaggggccagcuucacaaggaaacgguauacggcaagucauuucacuacagcacgaaguucgagaaaauuggagcuuccuuuaacguacagaaaaucaacacaguagcaaagaaagaagaaagggaagcccuccucaagcgacuugcggaaaacggcaacgaccccaagaaagccuucacugggaaaaacacccucaauaaaaugcccauauaccucgauuuggguaaaaacauaaaauuaagcgagaaggucaagacaguuguacucgaacaaaacuauacaauccggaagaacauagaccccgaucuaaaggucgacaagguuauagacgugggaauaaaaagaauacucgagagucgacuugaagaguucggaggcaacgcuaagcucgcguuuagcaaccuagaagaaaaccccaucuggcuaaacaaagagaagggaauaaguaucaaaagagucaaaaucucgggcgucagcaacgucgaaagccuacacgucaagaaagaccacuucggggaaccaauccucgaccaagagggcaacgagaucccagucgacuucgucagcacaggcaacaaccaccacguagccauauacgaggacgaaaacggaaaccuacaggaagaagucguguccuucuucgaagcgguaguacggcaaaaucaaggacuaccuaucaucaagaaaaaucauacccucggguggaaauuccuauucacgcugaaacagaacgaguacuuuguguucccgagcgacgacuucgucccagccgacgucgaccuaauggacgagcaaaacuaccaccucaucagcccgaacuuauucaggguccagaaaaucgcacgaaagaacuacgucuucaacaaccaccucgaaaccaaagccgucgacaaugaccuguugaaaagcaagaaagagcuauccaaaauaaccuaccauuucuaccaaaccccugagcaucuacgagguaucauuaaaaucagaaucaaccaccucggcaaaaucauccaaaucggcgaauacuga

SEQ ID NO: 6516 - RNA, 4059 nt, Artificial Sequence
  Cas9 variant
augaacaaaaaguacuaccugggccuagacauagggacaaacagcguggguugggcagugacagacgaaaacuauaaccuguacaaguacgccggaaaacggauguggggcauccgacuguuugaagcagccgacaccgcagccgagaggcgaaugaagagaagcaaccgcaggcgccuaagccgcaagaaacaacggaucgaccuacuacaagaacuguucuccgaggaaauagugaagaaagaccugaccuucuuuauacgccucaacgaaucccgccuacacuucgaagacaaaagcaccggcgagaaauauccccuauucguagacaaagaauacacagacaucgacuaccacaaacaauacccgacaauguaccaccuccgaaaagagcuaaucgaaaaccccgaaccacaugacauacgacugguguaccuagcaugccaccauauacuaaagaaccgcgggcacuuccuaaucaauggcagcauaagcgacguaaagaaucugagcuucguuugcggagagaugauaaaagaguucaacagcguaagcgaauaugaaaucagccucacggacauacgagaacucgagcggauucuaagcgacaaaaagaccgcgaagaguguaaaggcgaagcaagucgcacagcucuuugaaugcaccccggcagaggacaaagagcaacaaaagugcgcgaaagccaucauaaccaaccucucgaagcuaaucgucggacugaaagggaauauaucaaaaauguuccaccaaccccucgaggaaauaucaaccaaaucauucaaauucaccgaagccaaauacgaggaugaaaucaugcccgccaucgaagagaacuacccagacuacgcguccgucauagacaggauaaaaggggucuacgauuggaguguacuuguagagauacucgauggcgaagauuaccucagcuucgcgaaagugaaggccuacgaaaaacacggcaaaaaccuacacauccucaagaacgucaugaagaaguacugcaaagacgaagucuaccaggcuuucuucaacgggauaaaugagaaaaauggcuacggaaacuacauaggagcgauuaggaagaacggucacaccuacaagauggaccgcugcaaaagcgaggaggacuuuuacaaagggcuacagaaaauccuauccacaauagugcccgaccaagaagacgaggaacuacuagagaaacucaaggcagaggucgaaaaccaaacccuccuaccccucgcacggucgaaagaaaacggaacgauaccgaaccaaguacaucugcaagagcucaugaaaauacuagauaacgccaaggaauaccuggacuuccucaagaaagaagacgaauacggcacaauagccgagaaaaucaucucaaucgccaaauucaggaucccuuacuacgucggcccccucucgcggcgccacaaagaagaagguagcaacaguuggaugaucagaaaggaggaaggccgcaucuacccauggaauuucggagacaaagucgacguugaacaaaguaacaaagaguucaucgaacgaaugacuaacaaaugcacauaccuaauaggggaagacgugcuccccaaaaacucgcugcuauauagcaaguacaugguacugaacgagcuaaacaaccuaaaaauacggggaaacaagaucagcguagaacucaaacagcgcauauacaaagaccuguucugcacgauggcaaaagucacaggcaagcgcauccuggaguaccucaagauggaagacccagagauaguccaggaggacauaucaggauucgacauagacuuuaaguccgcccuggccagcuaucuagauuucaagaaacaggucguggggaacgaaauagagaaggaccacuacaaggaaauaaucgaagagauuauaaaguggaaaacgaucuacgacgacgauagcaagaugaugcgacgcaugauugaaagagaauacccagaaguauucgacaaagaacagaucaagaagauaugccagcucaaguauagcggauggggaaacuucagcgaccgguuccuaaacggaguccgcggcgccgacaaagagacagaagagucauacaccauuaucgaggcacuguggaagacgaacuacaaccugaugcaacuacugucgaaacaauucagcuucaaagaggaaaucgaccagauaaacgccgaaaaagccggcgacgucggcaaaauaaauuacgaaaacaccgucaaagaccugauaguguccccgagcaacaaacgcgcaauauggcagaccauacagauagccgaagaaauaaagaaaguaaugaaaugcgaacccgagcgaauauucaucgagauggcucggggaggcgagaaagagaagaaaaggacggucucgagaaaaacacgacugcaggagcuuuacgcuggcugcaaagacgacaccagaaacuggaugaaagaaaucggggaccgagaagaacgugaguucaacaguagaaagcuauaccuguacuacacacagauggggaaaugcauguacacuggcgaugaaauagacguagaugcccuaaugaaggggaacagcaacugggacauagaucacaucuacccacagagccgaaucaaagacgacagccuagacaauaugguucuggugcgcaaagacgugaauaacaagaaacgcaauaaaauacuaagcccgaaaauccgagaagacaugaaaggguacuggaccaugcuuugccagaagggccucauuuccaaacgcaaguacgaccgccuaacgcgaacgaccgacuucaccgaugaggaacucucaggguuuauagaaaggcagcugguagagacccgccaaagcuccaaagcaguggccgagcuacuaaaccgccucuauaaagacucggaagugguguacgucaaggcaggccucgucagcgacuuccgccacgauaacgaccugcucaaaucgagacgagucaacgacuaccaucacgcgaaagacgcauuccucaacaucguagugggcaacguguaucacgugcgguucacgagcaacccgcgaaaauggaucaaggacaaccgggacagcaacuacagcauacgcagagucuucaacuacgacguaaagcaaggcgacaaaaucguauggcacggcagugagaacggaggacacaguaucgaccagaucaagaagauaaugagccgcaaugauauauuauauacggaguacaccuacugcgagaagggacaacucuucaacgaaacgcuggcaaagaaaggcaacgaaaaagcaauagcguugaagaagaaccuagacccaguaaaauauggcggauauacaacgccaaagaccucagccuucgccuucguggaguucgacggcaagaaaaaggagcgaaagaaccacaucguagagaucccuguuuacgucguuaacaucgcgaagagggaaccagacgccguaaagaaauaccuagaggagcggaaaggguacuccaacgucgucauaaagaaauacccgauaaagaaaaacaguuuaauaaagauggacggcuaucuagcccggcuacgcggggcaaacgagaaagacauaauccugaaaaaugccguucaacucauccuaaacaaagaccucuacgagaucgugcgcaagaucgagaaguacuuggaauauaaucugcaauaccaagcagaugcgaaguucgaaggauucacgaugaaagaccuuaacaugaucuacgaagaacucuaccucaagcugaaagagagcauauuccaaaaacguccggcccagcagaugaaaacgcucgaaaaaggaaaagaagccuucauauccauugagaaccugggagaaaaagcaaaggucauaaacgaaaucauagcaauguuuaggugcgaugccacaacaguagcaaaccucaaaguaaucaacgggagccaaaacgccgggagcaugaaagugaacaaaaacacccugacuucgaaaaguuuaaaacugguacaccaaagcaucacgggacucuucgaaacagaagaggaacucguuuga

SEQ ID NO: 6517 - RNA, 4062 nt, Artificial Sequence
  Cas9 variant
augaagaagaaauacuaccucggccucgacauaggcaccaacucagucggaugggcagucaccgacgaaaacuacaaccuaugcaaguucaacggcaaaaagaugugggggauacgauuguuugaagacgcaaaaaccgccgcagaacguaggacaaaacgcagcaaccgacggcgcauagcgagaaccaaacagcgcauagaccucuuacaggaacuaugcgagaaaucaauauucgaaaaagauccgaccuucuucauccggcugaacgagaguucgcuacaccucgaagacaagagcaccggcgagaaauauccauuguucguagacaaggaauauacggacauagacuaccaccgagaguauccgacuguguaccaucugcgcaaggaacuaaucgagaaccccgagccgcacgacccacgucuaguauaccucgccuguugccacaucaucaagagccggggacauuuccugguuaaugggucgaucagugaugcuaaagaccuauccuucauaugcgaaaacaugauaaacagcuucaacgcggccuccgacuacaaaaucaacauacaggauaugaccgcacuagaaacgauacuuacagaccgcaagauggcaaaguccgucaaggcaaagcaaauagugcagcuguucaagugcauccccugcgaggacaaagaacagcagaagugcugcaaagccauaaucacgaaccugagcaaacuaauagucgggcucaaaggggacaucagcaaaaucuucaacgagaguuucgaagagaucaaauccuucaaauucgcggagacaaaauacgaagacgaaauacuccccacgauggaggagaucuacccggaccacgccgaaauaaucgagaaaaucaaaagcaucuacgacugguccauauuagacgaaauacuggacggcgaagaguaccugucauucgccaagguaaaggccuacgaaaaacauaagaagaaccuucacgaccuaaaaauacucauaaagaaauacugcgacgaugaaacguaccagucauuuuucaacgguaugaacgagaaaaacaaauacaguaacuacaucggcucaauccgcaaaaacggacauacguacaagguggagaagugcaaaagcuccgaagacuucuacaaagaacuccuaaaacuacuaucgucagucaacccaggccaggaagaugaaucgcugcucgaacagauaaaguucgagaccgaaaaccaaacucuacugccucuacuacgaacgaaggagaauggaacaaucccuaaccaaguacacaugcaagaacucaucaagauacucgacaacgcaagcaaauaccuagacuuccugaacgaaaaagacgaauacggaaccaccgcagacaagauaaucucaauagcaaaauucaagaucccguacuacguaggcccccucucggaccggcacaaggagaacggcagcaacuccuggaugguacgcaaagaaaaugggcgaauauacccauggaacuucgacgacaaaguagacgccgagaaaaguaacaaagaguucauacagcggaugacaaacaaaugcaccuaccucaucggggaagacguccuaccaaagaacagccuccuuuauucccgcuacaugguccucaacgaacucaacaaccugaagauacgcgggaacaaaaucuccguagagcugaagcaacaaauuuacaaugaccuauucugcaccaaggcccgugucacgggaaagaacauccuaaacuaccugaaaaaggaagacccggaacucgcggccgaagaccuaaguggcuucgacguggacuucaagagcgcauuaacaucauaucuagacuuuaagaaacaggucgucggaaacgagaucgagaaagacuacuauaaagagauuaucgaagaaauaaucaaauggaaaaccaucuacaacgaagacuccaagaugaugaaacgcaugaucggacgcgaguacccggaaacacucaaccaagaccaaauuaaaaagaucugccaucuaaaauacaacggauggggaaacuucagugaaacauuccucaaugguauaaagggagccaacaaagagaccggcgaaugcuacacgaucaucgaggcgcucuggaaaaccaacuauaaccucaugcaacuucugucaaaacaguucuccuucaaagaagaaauugaccaaauuaacgcggagaaaaccggagcgaucggcaagauuaccuacgaaaaucucguaaaagaccucguagucagcccagccaauaagcgcgcaaucuggcaaaccauacagaucaccgaagaaaucaagaaagucaugaaaugcgagcccgaacguauuuuuauagaaauggcgcgaggcggagaaaaagaaaagaaacggacggucucacggaaaacgcgccuacaagagcuauacacagggugcaaagacgauacacgggacuggaugaaagaaauaggcgaccgggaagaacgagaguucagcucacgcaaacuauaccuauacuacacccagaugggcaaaugcauguacaccggcgaagaaaucgacguagaucuccucaugacggccaacuccaaaugggacauagaccacaucuacccccagagucgaaucaaagacgacagcuucgacaacaugguccucguacgcaaagacauuaacaauaacgugaaagggaacaacaucguccccucaucgauacaaaaggaaaugaccucauacuggaaaaugcuccuucagaaagaauuaaucuccaaaaagaaauaugaaaggcuaacgcgcucaacagacuuuacugacgaggaacuaucgggguucaucgaacggcaacucguagagacucggcaaagcaguaaagccguggccgcacuccucaaucgucucuauaaaaacagcgagauuguguacguaaaagcaggucucguaucagacuuccggcaugacaacaaacuucucaaaucuaggcgcauuaaugacuaucaccacgcaaaagacgccuuccugaacaucguggucggcaauugcuacaggacaaaauucaccgcgaacccccgucaauggauuaagaaaaaccgggauacaaauuacucaauacggagaguauucgacuucgacauaaaacaaggggacaaaaucgucugguacggcaacaaaaacgaaaacggcaaacacaccaucgaccaaaucaagaaagcgauguccaggaacgacauccucuacaccgaauauacguacugcgagaaagggaaacuguucgacgagacacuuacgaagaaaggcaacaagaaagccauuccucucaagaaaaaccucgacccgcucaaauacggcggcuacaccuccgugaaaacguccgcauucgcuuucauugaguucgacgacaaaaagaaggaacguaaaaaccacaucgucgaaauccccaucuacgucgcgaacaucgccaaaagagaaccagaagccgucauuaaauaccuagaagaacaaaagggcuaugucaacaucgucguuaagaaauaucccauaaagaaaaacucacuauugaaaaucgacggcuaccuagcccgccucaggggcggcgacagcuccauaauaacacucaaaaacgcaguccagcucgugcuagacaaaaagagcuacgagauuauccgcaaaguagaaaaauaccuggaccacaacagcaaguaugaggcgaacuccaaacuagaaaaguuuaacgagaacgaccuaaauaucaucuacaacgagcuaugccugaaacuccgaaacagcaucuaccaaaagcgccccguccaccaacuagagacccuggaacaaggcaucgacaacuuccguagccucgagucccuaaaagacaaagcgaagauaauaaacgaacuccuggcgauguuccguugcgacgccaagaccggaauggacuugcgccuaauuggaggagcaagcaauucaggcaggaugcggaucagcaagucaagauuaacaagcaaaucccugaaacuuaucaaccagagcguaacagggcuguucgagacggaagaggaacucgucuga

SEQ ID NO: 6518 - RNA, 4062 nt, Artificial Sequence
  Cas9 variant
auggagaaaaacuauuaccuaggccuagauaugggcacgucaagcgucggaugggcuguaacggaugaaaacuacaaccugaugcgaaagaagggcaaggaccuuugggggguacgacuauucaaagaggccaagacuagcgcugagcggcgcgucaaaagaaccucccggcgccggcugcaacgcgagaaagcacguauaggcuaccucaaagaacucuuugcagaugaaaucaacaaaguagacgccggguucuaccagcguauggaagacuccaaauucauaucagaugacaagacaguacaccaaaaauucaccuuguuuagugacaccaacuacacagacgaggacuacuacaacgacuacccaaccauauuucaucugagaaagaagcuaauagaaagcgacgacgaauacgacguacgaauggucuuccucgcacuccuaaauauguauaaacaccgaggccacuuccucaacgcaaaccuuucugacaacggcaugggagacauaaacgaacaauacgaccgacucaaagaguugugcagcgaguaccucaacgucgaaugggaaaacaagcccgacaaauucgaggagauucuuaaagagugcaacugcucaaacagucuccggaacgagcggcugcuagagacauucaaccuaaagaaaaccgacaaagagaaaugcgaaaugcugaaacucauuugcggcuugaguggaacacucagcaaaaucuucaaggaccuagacgacgacagcgagacgaaaaaaaugacgaucuccuuccgcucgaguaacuacgacgaagaagccaucaacgucgaagaaauuaucggcagcgagaauuucgaaaucauagcaguacucaaagagauccacgacuggagcaugcuagcuaacauaaugcguggcaaaaaguaccucagcgucgcccggguagaggaguacgagaaacacaaggacgaccucaaaauacucaagaaaguaaucaaggaauacaguauugaggaguacaauaacuucuuccgagucauggccgacaacaacuacucagcuuacgucaacaguguaaacagcaacaaagaaagcacaaggcgaggggcaaagugcgacaacgacacauucuucaaagaaaucaagaagaucguaaacaagugcuacgacuccgaagagaaagaauacauccucaaagagaucgaaaaaggcaccuuccuucccaagcaaaucaucucaagcaauggaguuauaccaaaccaaguacacaagauagaaaugaagaaaauccuacagaacgccgaaaaauaccuccccuuccucacagagaaagacgacuccggccucuccguaagcgaacgaauccuccagauguuuuccuuucaaauacccuacuacaucggcccaauuuccggcaagauaggguccgacgagaaaucaaaaaacagcuggagcguucgcaaagaaaaagggagaaucuacccauggaacuuuaaggacaagaucgaugagaaggaguccgccgagaaauucaucgaacgcaugguaaaccacuguacauacuugaacaacgaaaugguacugccuaaaaauucgcuacuuuaugagaaauucaugguccucaacgaacugaauaaccuaaaaauaaacaacgaaaacaucuccgucgaacuaaaacaaagccuauacaauaaucuauucaaaacgggcaagaaggugacagccaaagggaucaaguccuaccucgagcgcaauggccucugcgagcccaacgaggacauaaaucucacugggauagauggugacuucacgaacaggcucaguaacuacgcgaaauucaagggaaucuucaacaccgacgaacugacguacgaacaauggaacauggccgaaaaaauaauaaaguggucgacuauuuacggcgacagcaagaaauuccucgaagagaagauccgaaacgaguacucagagaaacucgauucccaacaaaucaaacggauacugggaauuaaauuccgcgacugggguaggcuuucugaagagcuccuaaacauggaaggagcggacguuaacacgggggaaaucaaaagcgugaucggacgcaugugggacgaaaacuacaaccucauggagcucauagcuaccgacaacuucacguacaaacaggucaucaaagaaaagcagaacggguuagacaagagccucagcgagaucgacuacgacgaccucgacgagcucuacguaagcgccccaguuaaacgcaugaucuggcagacccuccucaucaucaaagaacugguaucagucauuggcuacgagcccacgcgaguauuuguagaaauggccaaagacguaaacacggaaaagaagcgaacagacucccgcaaaaaaaaauuccucgaccuauacaaacaaugcgagaaggaugaaagagacuucuggauaaaggaaaucgaugacaaaucagaagcagaauuucgcaaaaaaaaacucuaccuauacuacacacagaaaggccgaugcauguacaccggggagcaaaucaacccccuggaccuaaccaacgacaaccuguacgacaucgaccacaucuacccucgacacuucgugaaggacgacucgauagaaaauaacuuaguauuggucaaaaaggagaaaaacgcccacaaaucagauacuuucccuauugaagacgacauccguaaaaaccaauacgccuucuggaaaaugcuauaugaaaaaaauuuuauaacaaaagucaaguaccagcgccucacccgaaaagaaccauucucggacgaggaaaaggccaacuucaucaugaggcaaaucguggagacacgccaaggcacaaaggugaucaccgacauccucgagaaaaguuucgauaaaacacaaaucguuuacgucaaggcugggaacgucagccucuucagacaaaaauaugaaugcaucaagugccgcgagaucaacgacuuccaccacgccaacgacgcguaccucaacaucguggucggaaacguauacgacacgaaauucacauccgaucccagaaacuucauaaaagaguaccggaaaaauccccagaaaaacgaauaccacauguacaagcuauucgacuacaauguccaacgaggagaucgagucgccuggaccgcaagcaacggcgaaucaaugaaggugguuaaaggaacccuaaaaaagaacacaccccucguaaccuuuaugagcuacgaagaacacggcggccucuaugaccaaaacauaaucuccgcaaaagacauagagaaggucaagggcaaagguuaccucccaauaaagagcuccgacucccgccucaacaacaccgaaaaauacggcggauaugccaaagucagcggcgcauauuucuuuguggucgaacacaccgucaaaaacguacgaauaaggaccaucgagcccaugccaugcuacuuaaccaagguacugaccacaaaggaaaagauagaggacuacuguuguaauauacugaaauacgacucaccgguggucaaguacgaaaaaaucaagauguacagccugaucaaaguaaacggguacccgauguaccucacaggacggaccggcaaccaacuaaucgucaguaacggcauacaacuagucuuguccuacgaugaagcaaaauacauaaaagaccuccuaaaaaucaaucaagaggaguucgaccaaaaccgccucgaaaaccucggaauaaacaaauuucgcaacgaaaagcuuuacgacacccuaaacaagaaauacacuaacgagaucuacaaaaagcgccccaauagcauggggaacaagaugauagaauggaaaaacaccuuucagaaccuuucgaucaaagaccaaaccgaaguucugcuccaacuuauacagcuggggcaaaagcaaaacucaggcguaaacuuagaaaagcuuggagcaagcaagaagaccggcgucagccuaguguccaaaaaaaucaccgacaaagaaagcuuugagcuaauaaacaaaucaauaacgggccuguacgagaauaagguagacuuacuucgcguauga

SEQ ID NO: 6519 - RNA, 4062 nt, Artificial Sequence
  Cas9 variant
auggcagccuucaaauacuaucuaggacucgacauggggacuaacuccguaggaugggcuguaaccgaucccaauuauaaucuccuaaaagccaaaggaaaagaccucuggggaauacgggaguucaacgaagcaagcacugccguagaaagacgcacacaccgcaucucgcggcgccgucgucaacgggaacaaguacgcaucggacuacugaaagacuacuuccacgacgcgaucggcgaaguggacccagacuucuuccaacgccucgccaacaguaaguaccaccuggaagauaaagacaccgaaguacgcuauaagaacaacguguucaacgacgacgacuacacggacaaagacuacuuugaccaauacccaaccauauaccaucuucggaaggagcugaucgagucaacagacaaacacgacguucggcucguguuccucgcccuccucaacauguucaaacaccgaggccacuuccucaacuccggccucggagagaacuccggcgaaaacaacaucaacaaugcguaccuugagcucaccaaccuacuaagugaauuuacccaguacaaucuuaacgagaccaucgacgggaagaaaaucgaagauauccucagcagacgagacaugucacgcacgcgcaaagcagaaggacuagccgaaauccuggguguagacuacaagaacaaaccauacaaagaacucauucgcggccucugcggguuaaaguucaacgccugcgcuaucuuccccgaaauccaguccgacgaaguucccaaacuugacauaugucuuucagaagccagcuucgacgagaaaucugacgaaauagcaaacaucuuaggcgaggacuauuucgaaaucaucauggccaugaaggacauauacgacaucggaucccuggcaggcauaaugaaagggcacaacuaccugagccaagcacgcgucacgagcuacgagaaacacaaggaagacuuacgccuucucaaaaacgugauacgaaaguacugcuccaaagaggacuacgacaacuucuucaacagcgaagccgacgggucauacgccagcuacgugggaagcuacaacuccaagaccaagcagagaagagucgggaacaaacgguccagcgaagaacucuacaaggcgauuaagaagauccucaagaacguccccgcggaggacgcugauguccagcguauccucaugucaauagagaaugagacguuccucccaaagcaacuaaccgcguccaacggagucauacccaaccagguucacgccaaggagaucaagaagauccucuccaacgcagaaagguaccucccauuucuacgcgagaaggaugaaacagggcucucagucagcgaaaagaucaugaaacucuucagcuuccaaaucccguacuacgucggacccacgacagagaaaagcagcaaagacgguggaaacggcugggucgugcgcaaagaagaaggucaaguucuaccauggaacauagacgagaaaaucgacaugaaggcaacaagcgaggcuuuuaucucgcgcaugguccgaaggugcaccuacauuuccggggaacccguccuccccaagagcucucucgaauaccaauccuucugcgugcuaaacgaaauaaacaacauaaaaaucgacggcgaacgaaucagcguagaacucaaacaggacauauacaaagaagucuuccaaaagggaaaacgcgucacuaagaagcagcuaugcaaauaccuccacacccgcggcauaauagaagccgaagaacaggucacugggauagacguaaccauaaacaacgcucuaacgacauacggcaaguucaaagccauacucggggacgauauaucuaaagacucaguacagaaaaugguagaaaauaucguguucuggugcacggucuauggcgacagcaagaaauuccuaaaagacaggauugaagaaaaguauggggaaaagcucacgaaagagcaaaucaaacgaauaguaggauucaaauucaaagacuggggaaaccucagcaagaacuuccucgagcuuagcggcgcugacguuuccaccggcgaaucgguuagcauaaucagggcgcuuuggaacaacaacuugaaccucauggagcugaucaacucacgccuauacaacuacaaagagcgccuagcagaauaccagaacacaaugaugaaaacacuuagcgacauugaagccgaagacuuagacgaguacuacuuuagcgcgcccgugaagaggaugauauggcaaaccauacucaucauuaaagaacuugucaaaguacuugggugcgaacccgaucgaaucuuugucgaaaugacccgacgacccgaugaaagaaaaaugcgcaccgagucaagacggaaaaaguucgaggaacucuauaaaaaggucaaagacgaggacguagacuggaugaaggugaucgcgcacgccgaugaaaccggguccauaagaagcaagaaaauguaccucuaccucacacagaaaggccgaugcauguacacagggaaacacaucgaguuaagugaccucuucaacaacaaccucuacgacauagaucacguauacccgcgacacuucguaaaagacgacaauauagacaacaaccucgucuuagugugcaaagagaaaaacgcccacaaaagcgacaucuacccccucgaagacgaaauccuagccagccagaaaaacauguggagcgaacucagacggagcggguucaucaccgaggagaaauacaaccggcucaucggccgaaacuccuucacugacgaacagaaggcaggauucaucgcccggcaacuggucgagaccagccaaggaaccaaaggcguagcaaacauacuccaacagcuccuacccgaguccaagaucguguacgccaaagcaucaaacgucagcgaguuccgaaauaccagggacauccccaagucgagacucaucaacgaguuccaccacgcucacgacgcauaccuaaacaucgucguagggaacguauacuaugucaaauucacccagaacccccuaaauuucauaaagaacgacuacgaccgugacaaaacgaagaacaacuacaaccuuaguaagauguucgacugggacgucgagagaaacggcgagguagccuggauagcgcagaaaaaggacggcgaagccggcaccaucgcgacaguaaagaaaguccucgggcgcaacaccccucucaugacucgauacucauucgagggaaaaggaggccuaacaaacgagacauuauacagugccaagaaagcaaaagaggaaggguauauacccuucaagucuucagacgaaaagaugaaagacguaacaaaguacggaggcuucacaucaguaacaggcgccuacuucuucuuagucgagcacacagaaaagaagaaaagaagccgcaugauagaaagcgucccccuguaccucgcgcaaaagauagagcaaaauccacacgagcucgaaaaguacugcgaacaaguacugggccucaucgacuuugauauccgcguccggaaaaucaaaauagggagccucauaaaacggaagggauacuucuucuacauaacaggcaagacagggcaccgucucauacugcgaaacgccgugaacaugugccugaaaaaggaaugggugaaauacauaucaaaacuagagaaagcggucgacaagaacaacguagaaggaauuauaacgaaggagaaaaaugaacuccuguacuccgaacuaauugaaaaauucaagaauagcaucuucagcaauagacccaaucccgucggagacaagcucgacgaagcuaaggaaaaguucaucaaccuggacauagagaaacaauguaucguccuaugccaaauccuccagcucuccuccguucuaggcagcgagugcgacaugaccuuacucggcgaauccgcccacugcggaaaaauccuaauaucgaagaaaaucggcgaugaagacauauaccuaaucaaccaaagcgucacuggccuguaugagaagaaaaucaaccuacguaccgucuga

SEQ ID NO: 6520 - RNA, 4065 nt, Artificial Sequence
  Cas9 variant
augaaaaagauccucggacuagaccuaggaaccaacucaaucggcugggcguucaucaacgaggccgagaaugaaauagaaguguccucuauagucaacacgggaguccggaucgucccccuaaccacggacgaggaaagcgacuucaagaaagggaacacgaucucaauaaacgcagaccgcacacuaaagcgaggcgcccgccgcggccuccaaagauuuaaacaacgacgggaagccuuacuagaaacauucaaccgcauuaaauucauagcgacugacuucguuuacgccgaaacaggcgcagcaacgacguucucgaguuaccaacuccgagcaaaauccgccguggaagcugugacuaaagaggagcuagucaaaguccuucuuaugcuaaacaagaagcgagguuacaaaaguucacgaaaagccaaaaccgcagaagagggcgacgccauugacggcaugaaaaucgcaaaagagaucuucgagaacaacuugacaccaggccaauggguguacaacucgcucagcaagggcggaaaauucauccccgacuucuaccacagugacuugcagaaagaacucgaaaagauaguacgauuccagaaucaguuccacuccgaacaaaucaacgacaaacuccuagcagacauccaaggcaagucccgaacacagaccagccagcacuuuucuaaaacccugaacaucccgcucgcagagaacaaagggacacgagaagaaacaaaacuccagcacuaccaauggagaaaugaagcccuagcgaacgaacucgacaugaagauacuagcauuuaucaucacugaaaucaacaaccagaucaaccaaagcucaggauaccucggcgcaauaagcgaccgcuccaaagaacuguacuucaaccaagaaacagugggccaauaucaauacaaacaacuccaagaaaacguccaugccaaauuaaagaaccaagucuucuaucgucaagacuaccuagacgaauuugaaaagauaugggaaacccaggcaaaauuccacucagaacucaacgaaaaauuaaaagcagaaauaagagacaucaccauauucuaccaacgaaagcugaaaucgcagaaacaccuagucuccuucugcgaauuugaaaaaggacacaaagcaaucccaaagucaucgccccuauuccaagaguuccguauuuggcaaaaccucaacaauguagucgugaaaaacgaaaccaccaaagaggucuucgagcuuucagaggaacuaaaacaacuaaucgcggaggaacuccaguucaaagaaagcaugaccgacguccagaugcugacauucugcgaacugaaaaagggaacccacaccgugaacuucaagaaaauagaaggaaaccgcaccaacacaagcauuuacaaagcauucgagaaaauccuagaaguggaaggguacgaaaucgacuucuccaaaaugaaaccccuagaaaucaaagaaaccgucgcaccgaucuucgaaacacugaacauaaacacgguaauccucgacuucgaccccacaauacaaggcaaugacuucgacaagcaaccauacuaccaguuauggcaccuauuauacuccgcagaagacgacgacaaacuaaaggaaacacuuaagaccaaauucggauucaaagaaaaccaccuccccuuuauacuuaacaucaaucuccaagccgacuacgggucccuuuccgcaaaagccaucaaaaagauccugccccaccuaauggacggacacauauacgacaaagcaugccugauggucgguuauaaccauagcagcagcuuaaccacagcccaaaacaacgaucgcgucuuaaaagacacccucgaacugcuaaagaaaaauucgcucaggaaccccgucgucgagaaaauacucaaccaaaugaucaacgucaucaacgcuauaaugaaagacccggccaugggcaaacccgacgagauccgggucgaacuggcccgggagcuaaaggccaacaacgaacaaagaaagaaagccaccagcgacauaaacacggcgacaaccgaacacgaaaggauccgcaagcugcuccacagugaguucaacaucccgcgcgugacgagaaacgacauaauccgcuacaagcuauggcuugaaaccggaggaaucucccuauacaccgggaacccaauaaaagccuccgaccuauucagcaagaauuacgacaucgaacacauaauuccuaagagcagacuuuucgacgacagcuucuccaacaagacgcuaugugaaaggcaacugaacauagacaaaagcaacaagaccgccuacucuuuccuacaggaaaaacuaagcgagaacgacuuugcugcauaugagaaccgcguuaaggaccuuuucaagacgggcaagauaaaaagcuacaccaaguacaagaaauugcucauggccgacaacgaaaucccggagggcuucaucgacagacaacuacgagaaacccaguacaucgccaagaaagccaaagagauccugcuagaagugagccgcaacguuacggcaacaaucggcagugugacggauaagcugcgccaggacugggaacuugucgauguaaugaaggagcucaacugggaaaaguacgacaaacuuggacugacccacauagaagaaggcaaaaacggagagagacucucaaaaauaaaagacuggaccaagagaaaugaccaccgacaccacgcgauggaugcaaucaccguagcguucacaaaaccggccuauauccaauaccugaacaaccuaaacgccaaaacacagggagaaaacaaggccaauaguauaauugggaucgaaaacaaacaucuguaucgcgacaagaacaacaaacuacgcuucauaagcccgaugaaaaauuuccgggaggaggcgaagaaacagcuagagucgauccugauuagcuacaaggccaaaaacaaggucgucaccaagaacaaaaacacaaccaagaaaagcggaggcaccaaccagaaaauacaacucacgccccgaggccgacuccacaaggaaacggucuauggcaaacuacagcaguacgccacaaaggaagagaaagucaacgcuucauucacagaagauuacauccagaaagucgccaagaaagaauaccgggaggcacuauugaaacgccuagaggagaacgacaacgacccuaagaaagcguucaccggcaaaaacgcgcucaacaaaaccccaauauacaucagccucaaagacaacaucaucguccccgaaaaagucaaaacagucuggcucgaaaccgauuacaccauccgaaaagacauaacgccagaucucaagauugacaagguaauagacguaggaaucaaacgcauccuccaaaaccgucucaacgaguucaacggagaucccaagaaagccuucgucaaccucggagaauccccuauauggcucaauaaagaaaaaggcaucgcgaucaaacgggucaccaucuccggagucucaaacgcucaagcccuccacacaaagaaagaucaucugggaaacgaaauccucgacaaaaacggcaacccaauccccgucgacuucauuagcacggguaacaaucaccacguggccaucuaccgcgacgaaaaaggcaaccuccaagaggaaguagugucauuuuacgacgccguaauccgccgcaacuuaggacucagcgucaucaacaaaaaccacgaaaaagggugggaguuucuguucucuaugaaacaaaacgaguucuuuauauucccuagcgacggcuucaacccccacgaaauagaucuccuaaacccaaacaacuaccaccucauaucaccuaacaucuuccgaguucagaaaaucagcacgaaaaacuacauguucaaccaccaucucgaaacuaaagccguggauggggaaaugcucaaguccaaaaaggaacuaucaaaaacaucauaucacuucauccaaacccccacaaaccugaacggcaucauaaaaguccgcauuaaccaccuuggaaagaucguccaccugggagaguacuga

SEQ ID NO: 6521 - RNA, 4065 nt, Artificial Sequence
  Cas9 variant
augaagaaaauccugggacuagaucucggcacaaacuccaucgguugggcauucauaaacgaagccgaaaacgaaaucgaaguaagcucgauagucaacaccggcguccgcauagucccgcuaacaaccgacgaagaauccgacuuuaagaaaggcaacaccauaagcauuaacgcugaccgcacccuaaaacgcggagcucgucggggccuccagcgguuuaagcagcggcgcgaggcgcugcuagagacauucaaccgcaucaaauucauagccaccgacuucgucuacgccgaaaccggcgccgcgacaacuuuuuccucauaccaacugcgcgcaaaaucagcugucgaggccguaacgaaagaggagcuagucaaaguccugcugaugcuaaacaagaagcgcgguuacaaaagcucccguaaggccaaaacagcagaagagggcgacgccauagacggaaugaaaaucgccaaagaaaucuucgaaaacaacuuaaccccaggccaguggguauacaacagcuuauccaaagggggaaaauucauccccgacuuuuaccacucggaucuccaaaaagaacuagaaaagaucgucagguuucagaaccaguuccacucggaacaaauuaacgacaagcuacucgcggacauccaaggaaaaucgcgcacccagaccucacaacacuucuccaagacgcucaacauaccccuggcagaaaacaaagguacacgcgaggagacaaaacuacagcacuaccaguggcgcaacgaagcccucgcaaaugaguuagacaugaagauacuggcguucauaauaaccgaaauuaacaaccaaaucaaccagagcucaggcuaccugggagcaaucagcgaccgcuccaaggaacuguacuucaaccaagagacggucggccaauaccaauacaaacagcuccaagaaaacguccacgcgaaacucaaaaaucagguauucuacagacaggacuaucucgacgaguucgaaaagauuugggaaacgcaagccaaauuccacuccgaacucaacgaaaaacucaaggccgaaauacgagacaucacgauauucuaccaacgaaaacuaaagagucagaagcacuuggucuccuuuugcgaguucgaaaagggucacaaagccaucccuaaaagcucuccacucuuccaggaguuccguaucuggcaaaaccugaacaacgucgucgucaaaaaugagaccaccaaagaaguauucgaacucucagaggaacucaagcaacucaucgccgaggaacuacaguuuaaagagaguaugacggacguucaaaugcucacguucugcgaacucaagaaaggaacccacaccgucaacuuuaagaaaaucgaagggaaccgaaccaauaccugcaucuacaaagccuucgagaaaauccucgaaguugaaggcuacgaaauggacuucuccaaaaugaaaccccucgagaucaaggagacggucgcccccaucuucgaaacacuaaacauaaacaccgugauacuagacuucgacccaagcauacaagggaacgauuuugacaaacaaccauacuaccaacucuggcaccuccuuuacucggccgaggacgacgacaagcucaaagaaacacucaaaaccaaauucggcuucaaagaaaaccaucugccauuccuccucaacaucaaccugcaagcagacuauggaucacucucugcgaaggccauuaaaaagaucuuaccccaucuaauggacggccauaucuacgauaaagccugccucauggucggguacaaucacuccucgagccugaccaccgcgcagaacaaugaccguguucucaaagacacacuugaacuccucaagaaaaauucccuccgcaaccccguaguggagaaaauccucaaccaaaugaucaacgucauuaaugcgauaaugaaagauccagcuauggguaagcccgacgaaauacgaguagaacucgcccgcgagcucaaagccaacaacgaacaacgcaagaaagccaccucggauaucaacaccgccacgacggaacacgaaagaauacggaaacuacuacacuccgaguuuaauaucccucguguaacacguaacgacauuauccgguauaaacucuggcuagagacuggcggcauaucacuguacaccggcaacccaauaaaaggcagcgaccuauucagcaaggauuacgacauugaacacauaaucccaaaaagccgauuauucgacgacucauucagcaacaaaacacuaugcgaaaggcagcuaaacaucgacaaaaguaauaagacugccuacucauuccuucaagaaaaacuauccgaaaacgacuuugccgccuacgaaaaucgaguuaaagaccucuucaagaccggaaaaaucaaauccuacacaaaauacaaaaagcuacucauggcagacaacgaaauacccgagggcuucauagaccgccaacuccgagaaacacaauacauagcgaagaaagccaaagaaauucuccucgaggucucacgcaacguuaccgccaccauuggcuccguuacggacaaacuccgugaggacugggagcuagucgaugucaugaaagaacugaacugggagaaauacgacaagcuaggucucacucacauagaagagggcaagaacggcgaacgacucucgaaaauaaaggacuggacaaaaaggaacgaccauagacaccacgccauggacgcaaucacaguggcguucaccaaaccagccuacauccaguaccuuaacaaccucaaugccaaaacacaaggagagaacaaagccaacucgauaauaggcaucgagaacaaacaccucuaccgagauaaaaauaacaaacuccgguucauaucccccaugaaaaauuucagagaagaggccaagaaacaacuagaaagcaucuuaaucucuuacaaagccaaaaacaaggucgucacaaagaacaaaaacaccaccaagaaauccgggggcaccaaccaaaagauccaacuaacuccgcgcggaagacuacacaaagaaacggucuacggcaagcuacaacaauacgccacuaaggaagagaaggugaacgcuuccuucaccgaagacuacauacaaaaaguagcaaagaaagaauauagagaggcccuucuuaaacgauuagaagaaaacgacaacgaccccaagaaagccuucacggguaaaaaugcucuaaacaaaaccccgauuuacaucuccuuaaaagacaacauaaucgugcccgaaaaagucaaaaccgucugguuagaaaccgacuauacgauccgcaaagacauaacccccgaccuaaaaaucgacaaagucaucgaugucggcauaaaacgcauccuccagaauagacucaacgaguucaacggagacccaaagaaagcauucgucaaucucggggaaucacccauaugguuaaauaaagaaaaaggcaucgccauaaaacgagucacaauaucaggaguaagcaacgcacaagcucuacacacgaagaaagaucaccuagggaacgaaauacucgacaaaaauggaaaccccauaccagucgauuucaucagcacgggcaacaaccaccacgucgccauauaccgugaugagaaaggcaaccuacaagaagaaguagucagcuucuacgacgcgguaauucggcgaaaccuggaacucucugugaucaacaagaaccaugaaaaagguugggaguuccuauucucgaugaagcaaaacgaguucuuuaucuuccccucagacggguucaacccccacgaaaucgaccuccugaaucccaacaacuaccaccucauaucgccaaacaucuuccgcguccagaaaaucagcaccaagaacuacauguucaaccaccaccucgaaacgaaagcaguagacggggaaaugcuaaaauccaaaaaggaacucagcaaaaccuccuaccacuuuauacaaaccccaacgaaccugaacggcaucaucaaaguccggauaaaucaucucggcaaaaucguucacuuaggcgaauacuga

SEQ ID NO: 6522 - RNA, 4065 nt, Artificial Sequence
  Cas9 variant
auggccgacuucgccaaauaccagcccggaaugguagccgacggccgcaaaaucccccuagacuggacccucuacuaccuccggaaaaaggcgcuaacccaagcgauacgcaaagaagaauuagcauggauccuacucaauuucaaccaaaaacgcggauauuaccaacugagaggggaggaagaagaagaaaacagcacaaagcaugaggaauacuacgaacugaaaguaguaagcgucgaagccgccgaagaaggcaaagggggaaacacuugguacaacguaacccuggaaaacggauggauauaccggcgucagucuaaaaucgagcuuaacgacuggguaggcaaaguacgccccuucauagugacaacagaauacgagauugacggcgucaccaucaagaaggacaaaaacggugaggucaaacgcagcuucagggccccgucagagaacgacugggggcuaaggaagaaacgcaccgagucucuccucgaggaauccgggaaaacaguaggcgcauucauauacaaccauauccuaagcgaaccagcagauaaaauccgaggcaacuucauccggacaauugaacgaaaguucuacaagaaagaacucgaagcgauacugcgagaacagucaaaacaccagaaggaacugaaagacauagacacccuuauugccugcaucaaggaauuauaccccaacaacaaaccacaccaggauucguugaucaagaaagacaugaccuaccuccucaucacagaccuaauauucuaccaaagaccucucaaaucaaagaagucacuaauagcggacugcccauaugaauacuacgaauacgugauaaaagagacuggagaaaacaagagacaauccaucaagugcaucgcaaagucaaaccccuacuaccaagaguuccggcuauggcaauuuauaauaaaccuucgucucuucgaccgcaacaacgacaaggaaguaaccucugaguaccuauccaguauggaggacuacacuagacuauucaccuaccucaacgauagaaaggacaucaaccaggaaacacuccugaaggacuuuuucaaacagaaaaaggugaaacgcgggauggaaaaggaguuccccauccgauggaacuacauagaagauaaagagaagaaauacccauguaacgagacgcgacacgagcuccuaaccgcgcucggaaaaguagggaucgaucauucuuggcuagacgacaaagaacuguuuuaccgauuauggcaccuccuguacucagucgaaagcaaagaggaagcugagggugcacuucggaaacucgucgacaacgacgacuucgugaaugccuuccuuaaaauaaaacccuucaaaaaggaauacggggcguacagcgaaaaagccaucaagaaacuucucgccgucaugcggaugggaaaccuguggaacgaaguggacaucugcgagcaaacucgagaccgaauacagaacauaaucaagggagacauagaugagaagaucaaggacaggaugggaagaacauucucgcaacuuuccgauuuccagggacucccagaauggcuagcgugcuacguaguauacggucaacacuccgaagccaccgacauccagagguggaccaagcccgaaaaccuuauggccuacaucaacggauucaaacaacacucacuccgaaauccaauagucgaacaaugcauucucgagacccuccggacgguccacgacaucuggaaagaagcaggacacauagaugagauccacaucgaacuaggacgcggcaugaagucgaccgcggaccagcgagcccggaugagcaaaucaauaaugcaaaacgaaaacacaaaccuuaggaucaaaucccuacucauggagcucaaaaaugcaaaagaguucgaaaauguaagaccguacucacccaugcagcaagaaauccugcguaucuacgaagaaggagcccuccaagaacucaccaaggaagacgcccaauacaaugaaaucagcaaaauuagccaaauggcacagccuucugccaacgaacuacucaaauaccggcucuggcuugaacaaaaauacugcaguccguacaccggaaaacccaucucccucagcaaacuuuucaccagcgcauaccagauagaacacaucaucccacagagucgguacuucgacgacuccuucaccaacaaaguaaucugcgaagcagaagugaaccaacucaagagcaacaugcugggcuaugaguucauaaagaaacacggcggugaaaucguccgcugcacaaugaucggagacgucaaacucuuagacgcgaaagaauacuauaacuucguaacagagcauuacacaaacaaccgccgaaagaaagaaaaacuacugauggaggacaucccacaagaguuccuaaaccgccaaaugaacgauucccgcuacauaagcaaaaagguaauggcaauccucagcaauaucguaagggaagaagacgagcaggaagccaaaagcaaauucgucauagcaugcuccggcgguaucaccgaccgauuaaaacaagacuggggacugaacgacguauggaacuccaucgucuacccccgauucgagcgccuaaacaagcucaccaauacagagaauuucggacgcugggaaaacaaaaagggcaagcagguauuccaaacaagcgucccacucgaacuccagaaagauuucagcaaaaagcgaauagaccaccgucaccaugcaauggaugcucucguaaucgcaugcgcgucgaacaacaucauaaacuaccugaacaacgagagcgcgaaaagccaggagaaaagagaagaccugcggaagaaacucugcgacaagaaccgaaucauccgcaaacccugggaaacauucacucaagacgcucacaccgcccuagaaaacguggucgucucguucaaaaacuacauucgugucaucaacaaagcaacaaacuacuacgaaaaguaugacaaaaacggcaagaaagaaauagcggagcagaaaggacaagacaugugggcuauccgcaaaccaaugcacaaagaaacggucuucggacaggucaaccugcgccgcaaaaucaccauaaaacuaaaagacgcccuggagaaaaucccagcgaucugcgacaaggaacuucgagacuacaucaauauacucguagcaaaacaauucaacaagaagcagauacuugcccacuucaaauccauaaacuaucgccuaaacaugaaaucgguggauaaaguggacgucuggcaauucagcaacgaaaaagaaccaauggucgcgacgcguaagucuguagacaccuccuucgacacaaagcgcaucgcaacgauaacagacacgggcauacagaaaauccugcuaaacuaccucaaggcgaaaaacaacgaccccaacaucgccuucacccccgaggggaucgccgaaaugaacaaacacaucacggaauacaacaacggcaagcagcaccaaccaauccuaaaaguccgggucagugaacccaagggcgcuaaauaccaggucggggaaacaggcaacaagagaucaaaauuugucgaagcccagaaagggacaaaccucuacuucgccaucuacgaggacaaagaagggaacaggagcuauaacaccaucccucucaaugaagucauugagcgacucaaacaagggcugagccccgucccugacgcgaacgagaaaagcaucccacugaaauuccaccucucgcccaacgaccucguguacguccccaaaacggacgaagaaaaugaaaucaagaugggccaaaucuacaaauucguggacagcagcgggacuacugcuaauuucgugccccacagagucagcaaccuuauauacaacguagacaagaaaaucgcagaaaacuucuguaaccaugaaaucauacagaaugaguacggaauaggaucaccccaaagcaaaaaccaaaagagcauaaccggcgaaaugauaaaagcagucugcuggaagcucgaaguagaccgccuaggcaacauccacaagaucaucaaguga

SEQ ID NO: 6523 - RNA, 4065 nt, Artificial Sequence
  Cas9 variant
augaagaaaauccucggccuugacuuaggcaccaccucuauuggcugggcguucaucaaagaacccgaaaaagaugucguaggaucggagaucguagacaugggagugcggaucgucccccuaagcuccgacgaagaaaaugauuucgcaaaaggaaacacaaucuccauaaacgccgaccgcacucugaaacgcggcgcacgacgcaaccugcaacgauucaaacaaagacgaaacgcccuucuagaaaccuucaaggagaaaaaccugauacccucuaacuuucaguacgcagaggacgguccaagcagcacauucagcaccuuaaaacuacgggacaaagcggccaaggagaaaaucgaguuagacgacuucgucaaagugcuacuacagaucaacaaaaagcgcggguacaaauccucccggaaagcaauguccgaagaagacgaaggaacagcaaucgacagcauggggaucgccaaggagcuauacgaaaacgaccucacucccggccaaugggucuacgaagcccucaagaacgggcguaagaacgucccagacuucuaccggagugaucugcaggaggaguucaagaaaauaguaaacuaccaaagugaguucuaccccgacauccucaacaccucguucguugaagacuggaugggcaaggcgaguaccccaaccaagcaguauuucaacaaaaggggagugcaacucgcggaaaacaaagggaaacgcgaagaaagacgucuccaggaguacaaauggcgagccgaagccguaaacuucaaaauagaucuaucagaaauugcacucauccuaagccaaauuaacagccagaucuccaacucaagcggcuaccuaggagccauaagugaccgcuccaaagaacucuacuucaaaaaucugacagucggacaauaccuguaccaacaagugaagaaaaacccgcacacaagacucaaaggccaaguauucuaccgucaagacuaucuagacgaauuugaaaagaucuggagcgugcagucgagcuucuacccgcaacugaacgacgaacuuaaacaagaaguccgcgacgucaccaucuucuuccaaagacgacucaaaucacaaaaacaccuaauaagcaacugcgaguucgaagaacaccacaaagucgugcccaaaagccacccuaucuuccaggaguucaggauauggcagaacuuaaacaaccugacacucauuaagaaagacaaccuaaacgaaaaaugcgaacuagcgcuagaagauaaaacagcccucgccaacgagcuagccuucaaaaaggaacuaucgguuaaagacgcgcucaaggucuugggguuaaaacccagcgacugggaguucaauuucacgaaaaucgaaggcaauagaacgaaucacgccuucuucgaagccuucgcgaaaauaauagaacucgaagacggcgagccgauagaccucgggaaccuaaaagcggacgacauccuugaccaauucuccgaagcauuccuacgaaucggcauagacacagaacucuugcaaguaaacuccgacaucgaaggcgccgaguaugagaaacagucauacauccaauucuggcaccuucucuacucaagcgaagacgaccagaagcucaaacaaaaccucauucgcaaauucggguucaaaccagaacacgcaaaaauccuagcgagcaucucacuccaagacgaccacgccucucucucgucucgggccaucaaaaagauccuuccgcacuuacagagcggacucauauacgacaaggccugcaccuacgcuggguauaaccacagcuccagcuucaccaaagaugaaaacgaaaaacgcgaacuaagagccgaacucgaacuacugaagaaaaacucccuacgaaaccccgugguagagaaaauccugaaccaaaugaucaacgucgucaacgcgauccuaaaagacccaaaccucggacgacccgacgaaaucagggucgagauggcgcgcgagcucaaggcgaacgcagaacaacggaaaaauaugaccaguaacaucgccuccgccacaagggaccacgaaaaauauagagagauacucaagaaagaguucggacuaaaacgaguaacgaaaaacgaccuacuccgcuacaaauuguggcucgagacagacggcaucagccucuacaccggcaagccaaucgaagccuccaaauuguucucuaaagaauacgauaucgagcacaucauacccaaggcacgccucuucgaugacagcuucaguaacaagacaauaugcgaacggcagcucaacauagacaaggcaaacgugaccgccuucucauuccuacaaaacaaauuauccgccgacgaguucgaacaauaccagagucgggucaaaucucucuacggcaaacucucuaaggccaaaauccagaaacuacuuauggccaacgacaaaaucccagaagacuucaucgcacgccaacugcaggagacacgcuacaucagcaaaaaggccaaagaaauccuauucgaaauaacgaugcgaguaucaguaacaaccggaacgaucacagacaagcuacgggaggacuggggccuagucgagauaaugaaagagcucaauugggaaaaauaugacaaacuuggacuaacuuacacgauagaaggaaaacauggcgagcgccuaaacaagaucaaggauuggaacaaacgcaaugaucaucgacaccacgccauggacgcccugaccguggcacuuaccaagccggccuacauacaauauuuaaauaacuugaacgccaaggcuauuggaaacaaaaagggcacagaaaucuuugccaucgagcaaaaauaccucaaacgagaaaacggaaaacuaugcuucauaccgcccauagaaaacaucagagcagaggccaagaaacaucugaguaaaauccucguaucuuauaaagccaaaaacaaggucgucacgaucaacaaaaacaaaacaaagaagaaagcagguuucaacgagcagacggcccucacaccgcgcggccaguugcacaaagaaaccguguacggcaagagcuuucacuacagcacaaaauucgagaaaaucggggccagcuucgacgcccagaaaauuaacaccgucgcgaagaaagaagaacgagaggcauuacuaaaacgacucgcagaaaacggcaacgacccuaagaaagcauucacaggcaaaaauucgcuaaacaaaaugcccaucuaccuggaccucggcaaaaacaucaaacuauccgaaaaagugaaaaccguaguccuggaacaaaacuacacgauccggaaaaacaucgaccccgacuugaaagucgacaaagugauagacgucggaaucaaacgaauccuagaaagucgucucgaggaguucggagggaaugccaaacuggcauuuucaaaucucgaagaaaaccccaucuggcuaaacaaagaaaaagggauccccauaaagagaguaaagauauccggcguaagcaacguugaaucccuucacguaaagaaggaccauuucggugagaaaauccuggacgaggagggaaacgagaucccagucgacuuugugagcacaggcaauaaccaucacgucgcaaucuacgaagacgaagaugggaaucuucaagacgaaguaguaaacuucuacgaagccgucauacgccgcaaucaaggagaaucgauaaucaaauauaggcacgaagaaggauggaacuuccuauacagcaucaaacaaaacgaguucuucguguucccuagccaagacuucaaccccaacgacuuugaccuauuagaucccaagaacuacgaccucauaucaccgaacuuauaccgugcucagaaauuuagcaaagucauguacgggaacucagcaguacgagauuacguuuuccgccaccaucuggaaacagugcuaaacgacgugaaagagcuuaaagacguggcguauaaacaacuaaagucacuacaauaucuaaauggcauaaagaaaguccgacucaaccaccucggacagaucauccaaguuggugaauacuga

SEQ ID NO: 6524 - RNA, 4065 nt, Artificial Sequence
  Cas9 variant
augacacuccacuacaacgucggccuagacaucggcaccaauagcgucggcuacacaaucguagacgacaacggcaaaauccuacaaguaaaaggaaagaauggcuacggaguaagagucuucaaagagggcgcgaccgcagcagaacgccgcauuuuccgaaccacacaccgacggcucaagaggcgaaaauggcggcuucggcugcuucaggacuucuucgaacccuacauacugccacaggacgacgguuucuucauccgccguaaggaaaguaaccuagugcuaaacgaccgcgacgaagacacagccagucuauucaacgaucgcuccgaccgcgauuucuaccaggccuaccccacgaucuaccaccuacgccaagcccucaugaccgaaaaacggcaauucgacguccgcgagaucuaccucgccaugcaccauaucauaaaauacaggggacacuuccuacucaacggcaccgucaauaacuuuacaaacaacaagaucgaucuacauagcgacuuugaagaacuaaacgcacuucuacuaaacguuauccccgaacuaaaauuccaaaucgaccucgaucacagcacaauguuccaaaccacccuacugaacaccaccaucagcagaucaggucgacaacgcgaccucguaaaguccuucuacaauggcucagacgauaagcaguuagcaaaacaacaaaaaucuguugcuacggagcucuuaaaagcuauccucggccugaaggcaaaguuccauaagcuauuuaaccuugaucuccucgaaaccacggagugggaguucucauucgacgccgaagacaucgacgauaaacucgcaaaacuggaaccucugaugaccgaaaaccagcaacaggugauggacauacuccagagaauuuucgcagcgauaacgcucaacggcaucguuccagaagggaaaacacucagcgcaagcaagguugacagcuaccagaaacacaaacaagaccucaaacuucuaaaagcaauagcccaacacuccgacaagaaaacagccaccguacugcagaccgcauauaacgaauacaucaauggcaucgccagcaaaccccucaagcaggaggacuucuacaagaggcuuaccaacgcaguuaaaaagagcuccgacccacaagucgcagacaugcucgcacuaauugaccaggagaaauuccuaccuaaacagcgcacuaaagagaacggcgccaucccccaccaacuacaccagcucgagcucgaaagaauaaucgacaaccaaaaggacuacuaucccuggcuagcagaauuaaaccccaaucaagcccgacagaaaguagcaaaguacaaacuauccgaacucguagcauuccgggucccauacuacgucggaccccucauugaacccgaaguccaacaagcaacuagcaacgcacauuucgcauggauggcccgcaaagaggcgggccccauaacaccauggaacuuugaccaaaaaguugacaggaacgucucagccgaacgauucaucaaacgaaugaccacaaaagacacuuaccuucucgccgaagacguccugccacuccacucacuccuauaccaacgauucauagucuuaaacgaacuaaacaauguacggguaaacggccaaaaacucaccaagaaacaaaaacaagccguauaccaagaccuguucaagaggcaaccgcaugucaccaagaaacaauuuaaguccuaccuaguccaaaccggagaguucgcggaauccuccaaaauagagggacuagcaaaugaaacauccuucaacuccggccugacuaccgaaaacgaacuacguaagauauuuggcgcccaauuagacgaggcucgcuaccaaguggauuucgaacaaaucaucgaaugggcgacccucuucgaagacgcaaaaauccuccgcacaaaacucgccgaaaucaccugguuaaccacagaacaaauagaaaaacuagccggcauccgguaccguggcuggggacgcuucucacgcaaacuucucgcgggccuaagagaccaaaacggccaacagaucauagaccuacucugggacaccccaaacaacuucaugguaaucguuucgcaagcggcauucucagaggccauaaccaaagagaacgaaaagcugauugaccgacggggugcacaagacguaauaacugaccuauacacuagcccccaaaauaagaaagcccuccgucagguacuagcgaucguagccgacguccaaaaggccaugggaggcguaccgccccaacgcaucuuuauugaguucgcccgagaggacgaaaagaauccgcgucguuccgucgaacgcuccagacaauuagaaaagcucuaccaaaccaucucuaacgaguuccucauaaacagcgaaguucgacaagagcucaaggaagcagucgaccaaaaagucaacuucaaggaccgacucuuucucuacuuccuccagggcggcguggaccucuacuccgggaaacggauaaacauugaccaacuaagccacuacgacauagaccauauccugccccaauccuucauaaaagacgacucccucgacaacagaguacucguuucucaaaaacucaaccgaucaaaguccgacuccguuccccucucagaguucgcuaacuacaaauucggaccggccaugcaagccaaauggcuccaacuaaaggaagccggucucuuaaguaaaagaaaguacgacaaccuuacccuggacccaaccaaacucagcaaauucgcgccacuaggauucguuaauagacaacucgucgaaacuagacaggugaucaaacuggcagcuaaccuccucgccuccgaagaaacaaagguagucaccauuaaagcaaacaugacucaucaaguccgcaaggaacuagacuucccaaagaacagaaaugugaacaacuaccaccaugcauuugacgcauaccuaaccgcuuucguaggcauauucuugagcaaacgcuacccuaaacugaagcccuacuucacauacggugacuuccaaaagggaaacaaacucccagaccucaaaaacuucaacuucuuauacgaacugaaaaauaaggaccgaucaauugacuccaacacaggcgagauaaucugggacaagcagcgagaccuugccuacaugaauaaaaucuacaauuucaagaaaguuaccguaguacacgagguguuaacuaaaagcggugcccuguacaaucaaacucuguacaaggccagcgaagacaaagccucuggccgagggaccaaacaauugauccgcaagaaagacaacaugccaaccgaacucuacggcggauacacaggaucuacaucagcuuucaugagcaucguacgcuuauggaagaaagacaaacccuauuacaaagucgucggaauccccacccgcauggcugccaaacuagcuaaccaagcacagcuacuagauuaccucacgaagaaauucaccacacggaaacucguaaagaaaacgggcgauuacaaaacaacggucgaacgcuucgaacuugucguccccaaagucggcuucaaucagcucguuaucgacggcggacaaccguuuauguuaggcuccgcaacauaccaauacaacgcccgcgaacuuuucaucuccaaagaagccgucaaagcauuaaacaagcagcuaagcacccacguagaccucgugcaaguauucgacgaaauacucguccaaguaaaccgcugguucccccuguacgacacgaacggcuuccgcgagaaacugucccacggccgggacagauucaugaaacugaacgacucuuuugaggaaaagagcgacacgcaaaucgacguccuuaacagaauacucaucggcuuccacgcaaacgccgcacgcacaaaucuaaagauacugggauugggaacugaucuaggauucaugacccagcaagccgggauccgacucaccgaaaaagcaauucuuguccaccaaucaccauccggacuauucgagcgcaagguagcccuccgcgaccugaaaggucugcgcuga

SEQ ID NO: 6525 - RNA, 4068 nt, Artificial Sequence
  Cas9 variant
augacauacucaauaggccuagacaucgggacgggauccgugggcugggcuguaaucggcgacgacuaccgacuuaaaagagccaaaggcaaaaaucucaucggaguuagguuguucgacucagcaacgacugccgccgaacgucgcgguuaccgaaccaccaggcgccgccucucccgucgucacuggcgccugcggcuacuuaacgacaucuucgcaucagaccuugcugagcaggacgaaaauuuccuuccgcggcugaaauacucgugggucaacccggaugacgaacagaacccccagcuuaacagcgacgucgccaacggcgcacuuuucggaagcucugagaccgacaaagccuuccacaagaacuacccgacaaucuaccaccucaggcacgaacucaugacggacacugccaagcacgaccugcgggaggucuaccuagccauucaccacauagucaaauaucggggaaacuuccugaacaccgcagauaaaaucaaugccgaaaauagcuuuaacgucgaccuguucauugcagcacuagacgaauacaacgaguuccuggaaaccccuaucaccagcauaaaagacgcccaacuuuucucggacaaacucaccgacaucaacgcacgaaacaaaucggugaggguagaaaaugccauguccgagaccuacgacgacaaaagcaagaucuuuaaagccauacugacagcgcucguaggcaauacggccaacuuccaaacuauauucgaccuaagcgaccuggaaaaggacgaagcgaaaaacuucaaauucaagcuagaccucgaagacgucgagacaaaacuggacgucguacgcgcaaaguugagcgaugaacaaaacgcguuccuagaagcuguacugaucgccuacgacggaaucacccuuaaaaugauacucggggacuauaaaucuaucagucagucaaugaucgaauccuauaagagccaccaacgcgacuggaaauacaucaaaaacaacguucgccugaacgaacagaagauagagcccgacaaaaacagcgucaaauucuuuaaacucgacccaaagaaauuaauauacccuuccaaccucgcguaccuacaagugaucuccagcaacgaagacgagcacaggaaaggacucgacuacuucaaaacggccauccaagacgcagacauauuacaaagaauagaaaacgacaccuuccucccccgccagagaacaaaaaggaacggaguacucccauaucaacuccaccuagccgaacucgaacaaauaauaaagaaacagagcaaauauuacccauuccucgcaaacaucuacacgcaggauaacaaaacugaaaacaaacucauaggucucuuaaaauuuagggugcccuacuacguaggaccccuagucgaagcagagaaagugaccggugacggcaagaaccauuggcuaaucaagaaagaacuccaagaaaacaccccaaucacccccuucaacuucgacgacgucguagacaaagacaaaagcggcgaacaguuuauaaaacgaauaaccggaacagauucuuaccucauaggcgaacccacgcuaccagaaaauucgcuacucuaccaaaaguacaacguccuccaagagcugaacaacguccggaaugagcgacaccagcggcuaccaauaaaagucaaacaagacauauucgagcacguauucaaaauugacaagaacgucaaugcaaagaaagucauggcauaccuaaaauugaacggauauggcgacuuucagaucgccggccuauccgacacucgaaccggaaaauucaauuccaaccucagcuccuacaacuacuucgucgaccuccuaggccgagaaaagacagagaaaauuagagaagaccgccuagaagaaauuaucgaaauacaaacaguuuucgaagacaaaauccuugucgccaaacgucucuccaaccucgacuuccuaacuccccaagaaaagucaaaacugucagccaaacauuacaccggcuggggccgacucucacagaagcuccucaccacacaguucaucaaaaccgcacucuccgaagccggagacaucauaccucagucccacagcaucaucgaccuccuguauuacaccgacaaaaaccucauggaaauccucaacgacaagaccuucaacguucgaaacuggcucaccgaacaaaacaaaggaaccgaauccgguaauucccucuacgaccagaucgacgcgcuggccggccccaaggacaucaaacgcggcaucacccaagucuucuccauaaucgacgacaucaagaaagcaauggggagcaaccccgaaaccguauaccucgaauuugcgcgcgaaacccagacuucgcgccugaccaacucaagacuaaaucgcguccaggaaaucuacaacagccccgagcuaaaaacugaguucgcguaccuugcuaagaaacuagaagcagaaaccaaagaauccauccacgacgaccgccucuaccucuacuaccugcaagaaggaagagacauguacacgggcaaagaaauaccuuucgaccagaucuccucaaauuacgacaucgaccacaucaucccccaagccuucacgaaagaugacucgcuugacaaccgcguacucguaaauagggcgacaaacgcacgcaaaagcaacucuccuacauucaccaacgacaucauagacaaucgcaaaagcugguggcaauccuuagugaaacgcgggcuuaugucuaaagagaaauuugaacgccucaccgacaaacguaagaccuucucagagaaccaaacaaaccacuucaucgccaggcagcuugucgagacacggcagaucaucaaaaaugucgcggauuuaaucaaaaacaacuacgauggaacacaagcaguggcgaucagggcaagccugaccggagagaugcgacgcuaccuagacuggcccaaaaaccgagacaugaacgauuaccaucaugcgcacgacgcacugaugauggcgaccgucgguaaauacguagaccgccguggcuucuucgacaacggcuccgucuccgauggcgcagggaacgccuacaaucuguacaccaaggacuggcucgucgccgcacgagucggcacccgcaacgacagccagcgugucaaccccuacggguucaucgucggaagcaugaacagcaaagccgugcgccagcagguaaacaaagagacaggugagauaguaugggguaacgaaaaccucgacuacuuaaggcacguccucucauacaagaagauccucgucacgcgccgccucagcggaagcucaggaagacuauacgccgaaacccucuuuucacccaacccaaaagccaaacuuaucgcacagaaggccaaccgauccgucgcccuauauggcggauuuacaaaagccgaauccgccuacaccgcccucgucgaguucaacaaaaagggcgaccgcuccuacaaacugaucaagguccccauggcaaucgccaaccgaguaaacgacaagcaaaucaccgucaccgcguacauagcaucccuaaaccuuagagauuucucccgagugguccucgaacaccuuccccugggcacccuaauccgggaaagcgacgguucugaguuuuacgccgccuccucagaauacaagcacaacgccaaagagcuaugggccccuaaagaaauccuacgcucuagcaaaaagcuagauaaagccaccgccgacaaucugaucgacaucuucgacuuccuuacgaacgauaaaaccaucagcaacuucaaguuuuacgaaaaagaccucuuacaccuuaaaaacguacgagacaaguucguggaagcaucagacgaaaucaaaauaaaaguucuuuccgacgugauauacgaacugcacaacgaugccggauggcgcgaccccuucaaacacauccaggaaaaaccugccuggacgaugcuccaaguaaaaggagggaucaaacucagugaaaaagcggccaucgucuaccaaucaccaaccggccuauuugaaacaauuaccauagucggugaguga

SEQ ID NO: 6526 - RNA, 4071 nt, Artificial Sequence
  Cas9 variant
augaagaaauucgaagaauacuacaucggccuagacaugggcacagggagcgucgggugggccgucacagacucugcguacaacauaaucaaacgacauggcaaagcccucuggggcauuagacuauucgaaagcgcgaaaacggcggaggaacgaaggauauuccggaccuccagacggcgcacagaacggcggaagaauagacuccaccuccuacaagaaaucuucgcagaggaaauaagcaagaaagacaugggguucuaccagcggaugaaagagucuaaguacuggcacgaggacaagaaagacaucaacgguaauaugccagaacucccguacgcgcuauucgccgacgauggguucacagacaaagacuacuacaagaaauaccccacaauauuccaccuacguuacgcccuugcuacuaacaccaccgacaaaccagacauacgccuccucuaccucgcacuccaccacauaauuaaacacaggggucauuuccucuucgaggggaagaaacugucagaggucaaagaguuuaguacagcgaucgaggcacugguccagcaagcagaagaacaggaaaucgaccugaagagucugacacaagaagagguacucacccaacucgaacacaucaugagcgacgcacagugcaccaaaucggacaagaaaacccagguaagcaaacucaucguaggcacagacaaacagaaacaaaagcaggaaaaagccaucgcggcgcugauaacaggaugcaccgucaaacuaagcgacaucuucgcggacccagaacuagacaaagaagaaauaaguaagaucugcuucucagauaauggauaugaagaaaaagagguggaaauagaaucaguacucgcagaucgcuuccuccuaauagcagcagccaagggcgucuacgacuggaccgugcuacacgacauccuaggagaugcccgguuucugucugaggccaaagugaagacauacgagaaacaccgcgaugaccuacgaaaagucaaacaacuccuacgcauggacaaggaggucuaugaagccgucuucggagugagugagaaaaacgaagccaacuauagcgccuacauaggaauggcgaagaaaaacgguaagaaacaacccaucgaaaagaaaugcucacaagaagauuucuacaaauuccucaagaaacaauuggaccgccuuagcgucgaugagauggggcaggagaucaucgaugagcucaaagccgagauggaccuggggacccuguuccccaaacaaaugauacgagacaacggcgugauaccuuaccaguuacaugagaacgaacugaacgccauacucgacaacgcccagaaguuuuacccauuucuacuggaaaaagaccaagacggauacacccccguugagaaaauccagaaaauauuccgauucaggauaccauacuacguggguccgcugaacacggcacaccaggacaagggugggcauagcuggucaguaaggaaaaaggaaggaaaaaucuaucccuggaacuucuccgaaaugaucgacgaggaagaaucagcuacgaaguuuaucgaaagaaugaccaacaagugcacguaucuaaucggagaagacguccuacccaaagaaagccuguuauacgcaaaauucaaugugcugaacgaacuaaacaaccucagaaucgacggggaacuaaucgcgcccgaacuaaaacaggacauauacaacaacguauucaaaaaguaccaacgcguaacgggaaagaaagucaaagacuaccuacggaucaacggcgucauaagcaaagaacaagaacuaagcggauucgaccaaaacuucaaaucgucgcuaaaagccuaccacgacuucaaacaaaucguaggcacaggaguccuaagcgaaagcgaacaagaagacauuguaagagauauaacccuauucgcggacucccagaaaaugcugaaacaaaggauccaccgaaaguacccaauguuaagcgacaagcaaauagcccaacucgcaaacaagaaguacgccgggugggggcgucucucccgaacguuccuagaaaacaucgaaucagucaacaaggaaaccggggaaguuaugaacauuaucacagcacucugggagacgaacgaaaauuugaugaagcugcuuagcgggaaguacgacuacacaaaacagauagaacaauggaacgcaagacaaaugaaaaagggcgaaauagaguaucaagacaucgaggaacuuuacgucagcccagccgucaagcgcccaauauggcaaaccaucaaaauaguaagagaaauaacgaacaucaugggcggagcaccaaaacgcauuuucgucgaagucgcuagggagcccggggaaaagggcgugagaaaagucuccaggcgaaaccaacuccuugaucuauacaaggcauguaagaaagaagcgccggagcucuacgauaggcuagccaacaaagaguccgacaacgcgcuaaggucagacaaacucuuucuguacuacucccagauggggagaugcauguacagcggagacgcgauagaccuagacgaacucuucacaaacagauacgauaucgaccacaucuacccccagucgaaagucauggacgacuccauagacaacaggguccucguuaaacgcgacuugaacucgaagaaaacagauaccuuuccagugagcgaagaguacagaaaagcagggaaggcucucuggagcacacugcucaagaaaggucuaauaagcaaagagaaguauaaaagacuaacucgaacagaaccauucggcgaggacgagcuggccggauucauugcgagacaacugguggaaacacggcaaagcacgaaggcugucgcccaucugcucgaggaagcguaccccgaugccgagauaguauacgcuaaagccagagccgugagcgaguuccgacacaaauucgacaugaucaaaguacgggaaguaaacgacuuucaccacgccaaggacgcauaccucaacaucguuguaggcaauacuuauuacgugaaguuuaccaaggacgccgccugguucgugagaaacaacccaggacgcacuuacaaccuaaagaaaauguucgaaaacgagacuguaaaacgcggcaacgaaacagcauggauccccggagacaauggcacuaucugcacagugaaaaaguggaugcgcaaaaacaacguccucuucacgcgacgagcauacgaaguaaaaggaggucuguucgaucaaaacauccuaaagaaaggaaaaggucagauccccaucaaaggcggagcagacgaaagacugcgaagccgggacaaguacggagccuauaacaaagcgucaggcgcuuacuucaugcucguagagagugaugggaagaaaggggaacggaagcgcacaauagaguucgucccaguauaccucgccaagucacuggaagaaagcguggaacuacgacgaagguacugcgaagaggaacugggccucgugaauccggacguccgccucaguaaaauccgaaagaacgcacucaucgacguggacggcuucaaaaugcacuuagucgggcgaacagagaacagacuacugcucaucggcgccacccaguuaguacucuccgaagacgaccaacaacuuaucaaaaagauagggaaauacugccucgaccauagagaaaauaaagaugcaguccuguccgaaaaauacgaacucacaauggaucuauucgaaaaacuauacgacauauuugucuuuaaacuggaacaaacgguguacgccgucaaacugaguaaacaggcaaaagaccugaaagaggugaaagaagaguuccuagcacuagacgacgaacagaaaugccuccuacuuauggaaauccuacaccuauuucaauguucaccgcagcuugccaaccucacaaacauaggaggcgggaaaagcgccggcagccucaagauccuaagcgacauaacaaagcaacaaagcgugcugcuaauuaaccaaucgauaaccggauuuuacgagcaaguaauugaccuaaaaaccauauga

SEQ ID NO: 6527 - RNA, 4071 nt, Artificial Sequence
  Cas9 variant
auggaggucggcaacuacuaucuaggcauagacgcaggcaccgacucagucggaugggcaguaacagacaaccaauacaacgugauacggaagaaaggcaaaucccuguggggaauuaggcuauucgacggagccaacacggcgcaagagcgacgaacguuccgcgcccucaggcgccgaaaugagcgcaagaaacagcgcauaaaucuccugcaggaacuguucugcaaagaaaucugcaaacucgacccaaacuucuucaucagacugcgagacuccagccucuggucggaagacaaggaagaaaaacaaauauacucccucuucaacgacaaaaacuucaaugaccgaaacuaccacaacaacuacaaaaccaucuaccaccuucgcgccgaucuaaucaaaaacaaggaaaagcaugacgcccgacucguguaccuagcgauccaccauaucaugaaaaauaggggccauuuccuauucaacggcaacaucgaaagcguaaccuccuucgaaaacacguucaacgaauuuaaaaacugccuccucgacgaacuggagauaaaccuagaaugccccagcaucucagaguucgaaaauauccucaaagaccgcaccuucaaaggaacacaaaagugcaagaaacuaaaagagcugugcuccaucccaucaagcgacaagaagcucgacaacaucuucaagcugaucuccggacucaaagccgaccuauccauaaucuucgaagacgagucauucaaagagaacgaacacaacaaaaucuccuucgcagacagcaauuacgaagaaacccgggagguacuaaacucagaaauucaggagaaaacccugauaaucgacaucuucaacuccaucuacaacugggucauccuuucagacauccuaucaggaggcgaguacaauggugguuuauaccugucaauugcaaagguaaacacauacaacaagcauucaaaggaccuaaaaauacugaaaucagucaucaagaaauacuuuccccaaaaguacaccgacaucuucgcgagcaacaaagaaaacaacuacuguuccuacaucggaauguacaaaucaggcggaaagaaauacucggucaagaaaugcuccgacaaaccagaagaguucuacaaaacgaucaaaaacauaauuaacaagaacaccgccgaagaaauaucuaacgacaaagacguccaguacauccucagcgaaaucgaaaacaauagcuuccuaccacuccaaaucaauaagaauaacggcgucauccccuaccaagcuaauaaaaucgaacucgaaucaauacucaagaaugccgaaaacuaccugccuuuucucaaggaaauagacacagaaugcaacaagaccaccagugaaaagauuaucgaucucuucgaguuccgcauucccuauuacgucggaccccucaacacauccaagggagaaaacgcguggaugauccgaaaggaagacgguacuauacgccccuggaacuuugagcaaaaaguugacauagacaagacagcggcugaguucaucacacgcaugaccaaucaguguacauaccugaacaacgaaaccguacugccgaaauacagccuccuauacuccgaauacaccgugcuaaacgaaauaaauaacauccgcauuaacggagagaaaauaagcguagaacuaaagcaagacauauucaacauacuguucaaaaacaacaaacaaguaacaugcaaaaagcuccucucgcaucuaaacucaaacggguacaaccucaagaaagaugaccuuagcggguucgacgggaauuuuaagagcagccucuccuccuacauagaccugaaaaacuacauauucggcgacaacaucgacaaaccccagauuuacaaccuagccgagaaaaucauacucuggaucacacuuuacggggacgacuccaaauuacucaagcgggucuuacaaaagaacugcucagaacagcucaaccccgaacaaaucaagaaaaucaccaaacugaaauucaaaggcuggggcagacucuccaaagccuuucucagcgaacugcgcggggccgaccgcgaaaccggcgagaccaugaccaucaucaaaggacuccgaaauacccaaaacaacuuaaugcaacuacuaucccaaaacuauacguucaccgaagaaugugagaaaauaaauucaggauacuucauaaaccccaacgaaauaucguacgacuccauugucaaaaacauagucgcuucccccuccaucaaacggagcgucuggcaaaccauucaaaucgucgaggaaauccagaaagucaugggcuccaagccccguaagauuuucgucgagauggcccgcggugaggaagaaaaaguccguaccacauccaggaagcagaaacuccuugaccuauacaagaacauuucggacgaaugcgcaaaggguauguacgacgaaauauacucaaaagacgaguccgacuucaaaaacauucgccucuaucuauauuauacucaaaugggaugcuguauguacagcggcaaacacauagaccuuucacaacuaucgaacacaaacaucugggaccgcgaccacauuuauccgcaauccaaaaccaaagacgacucccuagacaaucucgugcuaguauauaaaagcaucaacagugaaaaaucggacgacaucauaagccccaccauacaaaacaacaugcgaaccuucuggaaacuccuauucgaccguaaauucaucuccgagaagaaauaccaccgccugacucgaaccaccccacucacugacgaagaacucgccggguucaucaauagacagcuaguagagacgcggcaaucaaccaaagugauggccagcaucuucaagagaaucuaccccaacacugaaaucaucuacguuaaagccaaaaacgucagcgacuuccggcaccgcaaagacugcgagaauggcgucaagguaagggaacugaaugacuaccaccacgcaaaggacgcauaucucaacauaguagucggaaacgucuacuccagcaaauucacaaacaauccccuaauguggcucaaaaacaaccgaaauguaaaguacucgcugaaccgcauguacgacuucaaccuaacagucaacaaugaaaacaucuggguagucggcaacgaagggacccagaagacggucaacaaauaccugggcaagaacgacauacucuacacacgauacgccaugacgaacaaaggcgagcuuuucgaccaaaacccccuuaaagcaaccggcgacaaaucgaaacaaaccacccuagucccgcuaaagaaagggaaagaaguguggaaguacggaggcuacaauuccauuacccccagcuacuucauguuaguugagaguaaggacaagaaaggaaacuacauacgcaccauagagacgaugccacucuacagagagaaagaguucagcaaaaacgaagaauuuuuauuaaacuacuguaaagaaguucacaaacuaaaggaaccuaaaaucauucucaaaugcaucaagaaaaacgcgcugcuaaucgucgacggcuucccuaugcaccucaaaggaucaaccggccuacagcucaaacuccaaggggcuguccaacugauucuggaaucggauauggucaucuaccucaaaaagcuaaugaaauucguaaacgagaacaacauaaacaagaacaaauuagaagucacacccuacauggaauuaagcgcgaaggaaaacaucaagcuguacgacaucuuuauccaaaaacugacuacaggcaucuauagcaaacgacccgccaaucccguagaaaaacugaucaacgcgcgugacaucuucauugagcuaaccguaaaagaacagugcaucguucuaagcgaaauccuucaccuauuccagugcaaaccccuaaccagcgccaaccuugucuccauuaaccuaaagaaaaccguugggauaauacaaaucgccaaaaacauaacagccaagaacguuaaacucguccaucaaucaccaacaggcaucuaugaauacaccgucgaccuaaacaaaaucuga

SEQ ID NO: 6528 - RNA, 4071 nt, Artificial Sequence
  Cas9 variant
augacaaagaaagaacaaccuuauaauaucggccuggacaucggaaccuccuccguaggcugggccgucacgaacgacaacuaugaccuccucaauaucaaaaagaaaaaccuauggggcgugcgccuauucgaggaagcacaaaccgccaaagaaaccagacucaaccggagcacccgcaggcguuaccgccgccgcaaaaaccgaaucaacuggcuaaacgagaucuucagcgaggaguuagcaaagaccgacccuucguuccuuauccgacuccaaaauucuugggucuccaagaaagacccggaucggaagcgugauaaauacaaccuauuuauugacggccccuacaccgacaaggaauauuacagagaguucccuacuaucuuccaccuaaggaaggagcucauucucaacaaagacaaagcagauauacgccuaaucuaucucgcccuacacaacauacucaaauaucgaggcaacuucaccuaugaacaccaaaaauuuaacauaagcaaucucaacaacaaccugucgaaggaguuaaucgaacucaaccagcagcuaaucaaguacgacaucucauuccccgacgacugcgacuggaaccacauaucggauauacuaaucggaagggguaacgcuacccaaaaauccucuaacauccuaaaggauuucaccuuagauaaggaaaccaagaaacuccucaaagaagucauaaaccucauacucggcaacguagcccaucucaacacaauauucaaaaccucccucaccaaagacgaggaaaagcuaaacuuuuccgggaaagauauagaaucaaaauuggacgaccuagacucaauccucgacgacgaccaguucacgguacuagacgccgccaaucgcauauacucuaccauaacccucaaugaaauccucaacggcgaaucauauuucucgauggccaaagucaaccaguacgaaaaccaugccaucgaccuguguaaacuucgagauauguggcacaccacuaaaaacgaggaagcggucgagcagucccgccaagcauacgacgacuacauaaauaaacccaaguacggcaccaaggaacucuacaccucccuaaagaaguuccuaaaagucgcucucccgaccaaccuagccaaagaagcagaagagaaaauaucuaaaggaaccuaccucguaaaaccgcgcaacuccgaaaauggcguuguccccuaccagcucaacaaaauugaaauggagaaaauaaucgacaaccaaagccaauauuaccccuuccuaaaagaaaacaaagaaaaacuccucuccauacuauccuucagaaucccauacuacgucggcccccuacaaucggccgagaaaaaccccuucgccuggauggaacgcaaauccaauggccacgcccgccccuggaacuucgacgaaauaguugacagagaaaagagcucuaacaaauuuauccgccgaaugaccgucaccgacagcuaccuagucggcgaacccguccuacccaagaacucacuaaucuaccagcgcuacgaaguccuaaacgaacucaacaacauucgaauuacggaaaaucucaaaacaaaccccauaggcucacgccuaacagucgaaacaaaacagcgcaucuacaacgaguuauucaagaaauacaagaaaguaacagucaagaaacucaccaaauggcucaucgcccaaggauacuacaaaaaccccauacuuauaggguugucgcaaaaagacgaguucaacucgacacuaacgacauaccucgacaugaaaaagaucuucggcuccucauucauggaagacaacaagaacuacgaccaaaucgaagaacugaucgaauggcucacaaucuuugaggacaagcagaucuugaacgaaaaacuucauucguccaaguacucauacacgcccgaccaaauaaagaaaauuuccaacaugcgauacaaaggcugggggcgccuaucgaaaaagauccuuauggacaucaccacggagacaaacaccccacagcuucuccaacugucaaacuacucaauccucgacuugaugugggcaacuaauaacaacuucaucucaaucaugucaaacgacaaauaugauuucaaaaacuacauagaaaaccacaaccuaaacaaaaacgaagaccagaacauaagcgaccuuguaaacgacauacaugucucccccgcgcugaaacgcggcauaacucaauccauaaaaaucgugcaagaaaucgugaaauucaugggacacgccccaaagcauaucuucaucgaggucacuagagagacgaagaaauccgagauaacuaccucgcgcgaaaaacggaucaagcgacuccaaucgaagcuacuaaacaaggcaaacgacuuuaagccacaacucagggaauaccuuguaccaaacaaaaagauccaggaagaacuaaagaaacacaaaaacgaccuguccucagaacgcaucaugcucuauuuucugcaaaacggcaaaucgcucuacagcgaggaaucccuuaacauaaacaaacuauccgacuaccaggucgaccacauacugccacggaccuacaucccggacgacagccuagaaaacaaagccuuaguucucgcaaaagaaaaccaacgcaaagcagacgaccuacugcucaauuccaacgucaucgaucgcaauuuagagcgcuggaccuacauguuaaauaacaacaugaucggucuuaagaaauucaaaaaccugacccgccgcgucauaacagauaaagacaaacucggguucauacaccgccaacugguccaaaccucccaaaugguuaagggggucgcaaacauacucgauaacauguacaaaaaucaaggcacuacaugcauucaggcacgugcgaaccucucgaccgccuuccgaaaagcacucucgggacaggacgacacuuaccacuucaagcaccccgaacucgucaaaaaccgcaacgucaacgacuuccaccacgcgcaggacgcuuaccuagcuucauuccugggcaccuaccgccuccgacgcuuuccaacuaacgaaaugcuccuaaugaauggcgaguauaacaaauucuauggacaggugaaagaauuguacagcaagaagaagaaacucccagacucacgcaaaaacggcuucaucaucucgccgcuggucaacggaacgacgcaauacgauagaaacacgggcgagaucauauggaacgugggauuccgagacaaaauccucaaaaucuucaauuaccaccagugcaacguaacacgcaaaaccgaaaucaagaccggccaguucuacgaccagacaauauacucccccaaaaacccaaaauacaagaaacucaucgcacaaaagaaagacauggauccgaauaucuacgggggcuucucaggcgacaacaaaagcuccauuaccauaguaaaaaucgauaacaacaagauuaagcccgucgcaaucccaauccgacucaucaacgaucuaaaagauaaaaagacacuacaaaacuggcuagaggaaaacgucaaacacaaaaagucuauccaaaucaucaaaaacaacgucccgauaggccaaauaauauauaguaagaaagucggccuguuauccuuaaacucagaucgggagguagcaaaccgacaacaacucauccucccgcccgagcauuccgcacuccuacggcuacuccagauacccgacgaagaccuggaccagauacucgccuucuacgacaaaaacauccuagucgaaauacuacaggaauuaaucacuaaaaugaagaaauucuacccauucuacaaaggagagcgcgaguuccuuaucgcuaacaucgaaaacuucaaccaagccaccacguccgaaaaagucaacucacuagaagaacucaucacgcuguuacacgccaacucaacaucggcccaccuuauauucaacaauaucgagaagaaagccuuuggccggaaaacacacggucucacacuuaacaacacggacuucaucuaccaauccgucacgggccucuacgaaacucgcauccacauagaauga

SEQ ID NO: 6529 - RNA, 4071 nt, Artificial Sequence
  Cas9 variant
augacaaagaaggagcagcccuacaacauuggccucgacaucggcaccgguucgguaggaugggcagucaccaacgacaacuacgaccuacugaacaucaaaaagaaaaaccucuggggcgugcgucucuucgaaggugcccaaaccgcaaaagaaacccgccuaaaucgcuccacuagacgccgauaccgccgacggaaaaaccgcauaaacuggcucaacgagaucuucagcgaggaacucgccaacaccgaccccuccuuccucauccgccuccagaacucuugggucucaaagaaagaccccgaccgcaaacgagacaaauacaaccucuucauagacaaccccuacacagacaaagaauacuaccgugaauuuccgacaauauuucacuuacggaaagaacuaaucauaaacaaaaauaaggccgacauccgacucgucuaccuggcucuccacaacauacucaaauaccgaggaaauuuuaccuacgagcaccagaaauucaacauaagcacacucaacagcaaccuauccaaagaacuaauagaauugaaccaacagcuaaucaaauacgacaucuccuuccccgacaacugcgacuggaaccacaucagcgacauccuuaucggccggggaaacgccacacaaaagucguccaacauccugaacaacuucacccuggacaaggaaaccaagaaacuacuaaaagaaguuaucaaccuaauacucggcaaugucgcccaucucaacacuauauucaaaaccucccugacuaaagacgaagaaaaacucagcuucuccggcaaagacaucgaaagcaagcuagacgacuuagacucaauccuggacgaugaccaguucaccguacuagacacagcaaauagaauauacucaaccauaacgcucaacgagauccucaacggggaguccuauuuuagcauggccaaggucaaucaguacgaaaaccaugcgauagaccucugcaagcuacgcgacauguggcacacaaccaaaaaugagaaagccguaggccucucaagacaagccuaugacgacuacaucaacaagcccaaauacggcacuaaagagcuguacacaucccugaagaaauuccucaaagucgcgcuccccacaaaccucgccaaagaggcagaagagaaaaucagcaaaggaacauacuuagucaagccccgaaacagcgaaaauggcgucguccccuaccagcugaacaagauagaaauggagaaaauaaucgacaaccagucccaguacuacccguuccugaaggaaaacaaagaaaaacuacuguccauucucaguuucagaaucccuuacuacgucggaccccuccaaucuuccgagaaaaaccccuuugccuggauggaacgcaagucgaacggucaugccagacccuggaacuuugacgaaaucgucgaccgggagaaaagcuccaacaaguucauccgacggaugacugucaccgacucuuaccuagucggagagcccguauuacccaagaacucgcuaaucuaccagcgguaugaaguguugaaugaacucaacaacauucgaauuaccgaaaaccucaaaacgaaccccacggggucaagacuuaccguagagaccaaacagcacauuuauaaugaacuauucaaaaacuacaaaaagauaacagugaagaaacugaccaaguggcucauagcccagggcuacuacaaaaaccccauccugaucgggcuaucacaaaaagacgaguucaauuccacacuuacgaccuaucucgacaugaagaagaucuuuggcagcagcuucauggaaaacaacaagaacuauaaucagaucgaagaacucaucgaauggcucaccaucuucgaggacaaacaaauacucaaugaaaagcuccacucauccaacuacagcuacaccagcgaccagauaaagaagauuucaaacaugcgcuacaagggauggggucgcuuauccaaaaagauucucaccuguauuacuaccgagaccaauacucccaaaucccuccagcucucaaauuacucaguccuugaccugauguggacuaccaacaacaacuucauuuccauaaucuccaacgacaaauacgacuuuaaaaauuacauagaaaaccacaaccucaauaagaacgaggaccagaacaucucaaaucuugucaacgauauccacguauccccagcccucaagcgcgggaucacccaauccauuaaaaucguccaagaaaucguuaaauucaugggccacgcccccaaauacaucuucaucgaaguaacacgcgaaacuaaaaagagcgagaucacaaccucucguggcaaaagaauccaacgccuacaaucgaaacuauugaacaaagccaacggcuucaaaccgcaacuccggaaauaucuugugccuaacgagaaaauccaggaagaacucaagaaacacaaaaaugaucuguccagcgaacggaucaugcucuacuuucuucagaacgggaaaucgcucuacuccgaagaaagccugaacaucaacaaacuaucugauuaucaagucgaucauauccucccacgcaccuauauccccgacgacagccuugaaaacaaggcgcuaguccuagcaaaagaaaaccaacgcaaagccgacgaccuucuucucaacucgaacguaauugacaagaaccucgaacgcuggacauacauguugaacaacaacaugaugggucucaagaaauucaagaaucuaacacggagggucauaacagacaaagacaaacugggcuucauccaccgacaacucgugcagacaucccaaauggugaaaggagucgccaacauacucaacagcauguauaaaaaccaaggcacaacaugcauccaagcccgagcgaaucucucaaccgcauuccgcaaggcccucuccgaccaggacgaccgguaccacuucaaacacccggaacucgucaaaaaccgaaacaucaacgacuuccaccacgcacaggacgcauaucucgccucauuucucggcacuuaccgacuacggcgcuuccccacugacgaaaugcuccucaugaacggcgaauacaacaaauucuacggccaagucaaggaacucuacuccaagaaaaagaagcucccugauagucguaaaaacggauucauaaucuccccgcuaguaaacggcacgacucaguaugaccgcaacaccggcgaaaucaucuggaaugucggauuucgcgacaagauccuuaaaauauuuaacuaucaucaguguaacgucacgcgcaaaacagaaauaaaaacaggacaauuuuacgaucaaacaauauacuccccuaaaaacccaaaauacaagaaacuaaucgcccaaaagaaagacauggacccaaacaucuauggagguuucagcggcgacaacaaaucuucgauaacaauugucaagauagacaacaacaaaauaaagccaguagccauccccauccggcucauaaacgaccuuaaagacaagaaaacacuccaaaacuggcuagaggagaacgugaaacacaagaaauccauccagaucaucaaaaacaacguacccaucggccaaaucaucuacaguaagaaaguuggucugcucucccuaaacagcgacagagagaucgcuaaccgccagcaacucauccuuccacccgaacacuccgcccuccuccgaauccuccaaauuccggaugaagaucccgaccagauccuugccuuuuacgacaaaaacauacucguagagauacuccaggaacucaucacaaaaaugaagaaauucuauccauucuacaaaaaugaacaggaguuccuugccucgaacaucgaaaauuucaaccaagcuacgacaucggagaaaauaaacucccuagaagaacuaaucacacuccuccacgcaaacuccacaagcgcccaccucaucuucaacaacaucgaaaagaaagcguucgggagaaagacccacggacugacgcugaacgauacugacuucaucuaccagagcgucaccggccucuaugaaaccagaauccauaucgaauga

SEQ ID NO: 6530 - RNA, 4071 nt, Artificial Sequence
  Cas9 variant
augagcaagaaagacucagaguacuauauuggccucgauaucgguacgaacuccgucggaugggcggugaccaacgguaaguacgaccucuugaacaucaaaaagaaaaaucuauggggggugcgccuguucgaggcagccgagucagcagcaggccgccgcaucaacaggucgacacguagacgauaccgcagaagacggaaccguaucaacuggcuaaacgaaaucuucgcagacgagcucucgaaagucgaccccuccuuccuuacaagacucaacucuucauggauaucuaaaaaagacagcagccgcacucgcgauaaauacaacuuauucauggacgcagacuauaccgacaaaaauuaccaucauaaauaccccaccauauaccaccuccgccgugaccucauguucgacgacaaacaguuugacauacgacuuguuuaccuugcccuacacaacauaauuaaguaccgcgguaacuucaccuacgaccaccgaaaauucaacgucagcgaaaugucguccaaccuaaccaaagcccuggaaaacuucaaccaagaacuaauggaauucgaagacgcguucccugacaacacagacuacuccgccauaucggaagugcuucucaaaagcaauaacgucucuacaaaaauugacgagaucaucucaaaccuagaacucgacaaggacaccaagaaauaccucaaagagguccugaaacucauucucggcaacuccgccaaccuaaauaccaucuuccacaccucgcucgacaaagaugacgagaaacuaucccuaucagcaaaggacauagaacucaaacuaaacaaccuggauucccucuuaucagacgaacaaauccacuucauaagcagcgcuaacgaacuuuacagcagcauuacgcuaaacgacauucuggacggcaagaccuaccucagccuagcaaaaaucaaacaguacgacacccauugcuccgaccuacaggaacuuaaagaaaugugguacaagacuacgaacccagaccucauuaaaaaaagucggaaagccuacaaagaauacguccacggcucguacaacacagaagacuuuuauaaagcgaucucgccauucuugaaaauagcaauccccgaagaccuugccaaggacgcccugaaaaaaauagacgccaacacuuaccuuccaaaacagcgcacaucaaacaacggcguaaucccguuccaacucaaucuaauagaacucgaaaaaauaaucgauaaccaaucaaaauacuaccccuuccuaaaggaaaaccgcgagaaaaucauuaguauccucuccuuccgcauaccguacuacguuggaccaauacaagcaccgaccgacaagaacuucaguuggauggucaaaaaaauacaagccaaagcgcgcccauggaacuucgacgaaguaauagaucgcgaaaaauccucgaacaacuucaucaagcguaugacaacgacugacaccuaccuugucggugaacccguccuccccaaaaacucacuaaucuaucagaaguucgaaguacuaaacgagcucaacaacauacgaaucucaaaaaaccugucgcaggacccccucgggagcaaacucucggucgaagucaagcagcaaauuuucgaggaacucuucaaacguuacaaaacaguuaaaucagaccaacugaaaaaauggcucauccgaaacucauauuucacugacccaaccaucaucggccucucuaaacccuccgaauucaacuccucccuguccaccuucauagacaugaaagcgauuuucggcauggacuucgucaacaacccuaggaacagcucacagcucgaagagcucgccgaguggcucacagucuucgaggauaaacaaauccuuuccgaaaagauccgacacucgaauuaccccuacuccgaccaacaaauccgcaaaauaucgaacaugagauauagaggcuggggccgaauaucgaagaaauuacuaugcgacaucaaaguugagagcaccauauacaaaucacaccaacuccaccccuacucaauauuagaccucaugugguccaccaacaacaacuucuacaguauccuucauaaggacaaauacaacuucgaauccauacuugaagacuauaaccuaggaaccgacgacaagacggacaucaacgaacucguugacaacauacacaccucccccgcccucaagcgcgguaucauacaauccauuaacaucgugaaagaacucgucaaauucaugggccacgccccccaacacauauuccuagaauucacccgcgaggacaaaacaucaacacuuucagaaucgcggaagaaaagacucaagaagcucuacaacaaucucucagaagacacaaagaaguucaaacucgaccucagagacuaccuaguccccgacaaaucaauucagaaagaauuagaaagucacgauaaagaccugaguaaagagcgccuaaugcuauauuuccuacaaaacggaaaaagccucuacucagacgaagcacuggacaucaaccgacucuccgaguaccaaguggaucacauccucccccgcacauacaucaaggaugacagccucgagaacaaagcccucguccuagcgaaagaaaaucaacggaaagccgaugaucucuuacuccaacccucaaucauaaacaaaaacauggaacgcuggaucuacaugaaggaccacggcaugaucucaccuaaaaaauucaagaacuuaacacggaccacgauuacggaggaugacaaaguacacuucauaaaccggcaacucguacaaaccucacagaucauaaaaaacguagccaacauccuagauaacauguauaaagagcaagggaccacaugugucgaaacaaaagcaaaccucuccucagccuuccggacagcuuucucugaacaggacgacaaauaucauuucaagcaccccgaguuuaucaaaaacagggacgucaacgacuuucaucacgcccaagacgcguaccucgccugccugcucgggcuauacaggauacaacgauuccccagcgaugaaaugcuccucaucaagaaggaguacaggaaguuuuucgcgcaagcgcaaaacagcgucaagaaccacggaaagaucccagacagccaaaaaaacggauucauccucgccccccucguuaacggggaaaccuuaauuaauaacaaaacuauggagaccaucuggaacauggauuacaaacggaaaguaaucaaaaucuuuaacuauaaacaauauaacaucaccaaacgaaccgagauaaagaccggcgaauucuacaaacagacccuguacagcccccacgacgaaaacgucaaaaaccccauaccacagaaaaaaaaccuggaccccaaaaucuacggggguuacagcggcguccaguccuccuaccucgcaauaaucaaaguagaccaaaaaaaaccuacaauggucagcgucccaauacguuucagcaagaugauugacgacggaaagcucucgcuucaauccuggcuagagaacaacaucaaacacaaaaagaccauugaaguacugaaaaccaaaauucccaucggucaacugacauauaaccccaaaaacggauaccuaagcguccagucggaaaaagaaaucgcgaacgcucaacagcucuuccugcccuucgagcacgucgcuuuacugacccuccuccaugcgcccacguccgaauaugaccagauccugucguucuacgacacagacauccuccuagagaucuucgacgagauaaccaacaagauaaaaacguucuuuccauucuacauagaugaacaggaguauuuagucagcauccgcgaaaacuuccagucugccacugucaucgaaaaagucaacgugcuacaacagcuacuaauaaugcuacacgcgaacuccagccgaaucagcauaaaacugggcgaagucuccaagaaagaucuuggccgcaagaaaaagcguaucccacucgaaaacaccgaccuagucuaccaaucugucacgggucucuaucaaacgaaauuccauaucgacuga

SEQ ID NO: 6531 - RNA, 4074 nt, Artificial Sequence
  Cas9 variant
augaaugaccgcaacaaaaaguauaacaucggacucgacaucgguacaggaagcguugguugggcaguaacggauaacaacuacaaccuguuacacgccaaaaagaaaaaucugugggguauucgccucuucgacggcgccgaaacugccgccagccggcgaaccuuccgaucaacgcgccgccgauaccgacgacggcggaaccgaaucaacuggcucaaugagauauucgcagacgaacuagcaaagaaggaccaauccuuuuugguccguaugaacagcuccugggucagcaagaaagacaagauccggcaaagggaucaguacaaccucuuuauggacucagauuacacagacgucgaauaccaucgcgaguuccccacgauauuccaucugagaaaacgacuaaucgaagacaaaagccaggccgauauacgccuggucuaccuggcccuccacaacaucaucaaauaucgcggcaacuuuaccuacgaacaccagaacuucgacguuucucauauggauaguggguuagcccugcuccucaaucagcucaaucaacaacuacaagcauucgagguagcauucccggacgaaacaaacuuugaaaguaugagcacaauacuacucgaaaagaaaacacccacccagaaaaucgacgaaaucgucgaucaaauccaaccggaaaaagaucuccugcaaauaaccaagaacaucaugaagaugcuccuagguaacaaagccgaccuggucaaaaucuucagccucgacucggacgacaaaaucacaguugaguucagcagcaauagcaucgaacaggaccucuccaaccuggaggagacacuuucugacgaacaguucaacauaaucacacuagccaacagcauauauuccaguaucguucucaacgauauccuuucgggcgaaacauaccucuccuucgccaaagcacgucaauacucagaccacaaaaaggaccucgcuaaacuuaaaaccauguggagagaaucgcccgaccguaaagcagucggcaaggccaaaaaggcuuacgaugacuaccuacacuccgggaaauauggcauagaggacuuuuacaaagacauguccaaauuccucgaaacggccacgccagucgaacucgccaaagaagccaacgagaaaaucuuaaacaaauccuaucuccucaaacaacggaacaacgaaaacggcgugauucccuuccaacucaacaaaaacgaaaugauagaaaucauaaacaaccaggcaaaauacuaccccuuccuggcagaaaacaaagacaagcuacucagcauccuauccuuccgaauccccuacuauguugggccccuacaguccaagaaagauaacccguucgccuggauggaaaagaaaucccaaggcaaaauacgccccuggaacuucgaugaaaucguagaccgagaagccucaagcaacaacuucaucagacgcaugaccuccacagacaccuaccuaauaggcgaaccaguacuaccacuaaaaagccccaucuaccagaaauacgaaguacuaaacgagcucuccaacguccgcauaaacgccgacgaggucgauaacccacugggagacaaacuguccgucgaucuuaaacaggccaucuacaacgagcuauuccucaaacaucgauccgucagcaaggcucuccuaacaaaauggcucaucaaccaaucauacuuccagaacccacaaaucuccggccuagccgacaguaagaaguucaacucaggccugaccacuuaccacgacuucaagaaaaucuucggcgaagacuucgucaacgaccccaccaaccaaucucagcucgaacaacucgcggaguggcucaccaucuucgaagacaagaaaauccuuaaaaucaaacucgacgacucacaguucaacugcacccccgagcaaauuaaaaagaucgccggcaugagauaccaaggcuggggcaggcuaucaaagaaacuccugugcgacaucaaaacgaccaccgucacaagcaaaaaccaccagcaggccuccuacucaauccucgaccucauguggaauaccaaccgcaacuucaucucaguuuugaaaaacgacaccuacaaauucgaagacaaaauccaaacauuuaaccuagacaaaaaugaagcggcaacuccgcaggcaaugauagaugaauuacaaaccagcccugcacucaaacgaggcauacgccaaucaguuacaaucauccaagaacucgugaaguucaugggccacgccccagaacacaucuuccuggaauuuaccagagaggaugauguaagcagccuuaccaaaagccgggacagccggcuaaacaagcucuacgcacgcaucgccaagaacacuaagaaaacagacgacgagcuaaagaaaucccugcuccccaguuccgacaucaaggccacccuaaaagccaacaaaaacaaccuauccaacgauagacucaugcuauauuaucuucagaugggaaagagucucuacuccaaucaaccucuagacaucaacagacucuccgaauaccaaaucgaccacauacucccucaaucauauauaaaagacaacagccucgaaaaccgggcccuaguacucgcgucggaaaaccaacacaagagcucagaccugcucuugaagccugaaaucaucaaccaaaacaucgcacgauggcguuacaugaaggaugccggccuuaugggaccgaaaaaguucaaaaaccucacccgaauccaaauaaccgacuccgaccagaacaauuucaucaaccgccagcucgugcagaccucccaaauaauuaagcacguauccaauauccucgacucgauguacggagaccaaggcacccaaugcguugaaacgcgggcccaccuaucaaccgaauuucgcaaggcauucuccaacgaagacgacaacuaccacuuccaacaccccgaguucguuaaaaaucggaacaucaacgacuaucaucacgcgcaagacgccuaccuggcgugccugcuaggucucuaucaaaugaaaaaguaccccaccgacaacaugauccuacugaagaaagaauacaaacgcuucuucucaaacacaaagaaaaucuacgacaagaaacaccacuucccugauuacgugaaaaacggcuggaucaucggcucaauguucaacggagaaaaguacgucgacgaagagaccggccaaauaaucugggaccaacagaccaaagauaugguaucgugcaucuuccaauauaaacaauacaacgucacgaaacgcacagaggccgcuaacggugaguucuacaaccagacagucuacaaaaaggacccaaacgaaaagcgcaaacuuauuucacuaaaacaaggacucgacacuaaauuauaugguggcuauuccggcgauaaucccgccuacaucguacucgucaaaaucgacgacaagaaaaacaagcucgucaaaaugcccaucagacucgccgaacaaguagacaacaaaacgauagaucuacaaaccuggcucgaagaaaacguaccacacaagaaagguauacagguucucaagacgaaaauaccccuuggccaggugaucuacagcaaaaagaacggcuaucucgcacucaagagcgauaccgaaauagucaacgcccagcaacucguccugccauacgguuacguugccuuacucacacuacuccagaaaaugccugaaaauaaauaugacgaagugcucgcauguuacgaugacgguauacuagacaacaucuucguggccauaauagacaagaugaagcacuucuacccauacuacucaggcgaacucaagacccucuccgacaacaucgacaacuucaaagaaucaccugacgucaauaaaauaaaaacucuccagcaacuccuucuccuccuucacgcuucaucaaccacggccucgauugaguuuaauaacgucaaaaagaacucccuuggaagaaaaccaaacuccaucaacauacagaacacugaccuccugagcuucagcgccaccgggcuguacgaaucccggauacacauagacuga

SEQ ID NO: 6532 - RNA, 4074 nt, Artificial Sequence
  Cas9 variant
auggccgcuaagaacuacaacaucggacucgacauaggaaccucaucgaucggcugggccaucgucgaugacaacuaccaauugaugcaugccaaaggaaaauacggguacggcacucgcaucuacucggaaggccaaacggccgccgaccgacguggauuccgaaccacgcggaggaggcucaacagacgcaaauggcgccuacgccuacugcaagacuucuucgaacccuacauacucccccaagacgaagccuucuuuauccgccaaaagcaaucaaaccucguaccccaggacacaaagaaacaguaccccgaaucaguacuuuucgaugacacaucagacaaagacuucuacaccgaguacccgaccauuuaccacuuacggcaggcccucaugaccgagaaccggcaauucgacauaagagagguauaccucgccauacaccacaucgucaaauaccggggacacuuccuuaacaacgcaccgguaaaaaccuucaaaagcgggaaccuggaccuggcaauaaaguucaacgagcucaaugaagaguucaaaagcgucuacccugaccuggaauuacaguucaaccucgaucaaauugacgagaucaagaaaauauuacuugacagcaccaagagccgcuucgaccgccaaggcgaagccgugaaacuaauauacacagugagugaagucaaaacaauugaaaaacuucagaacaagaucgugaaacaguuucuaaguggaauccucggccuaaacacacgauucgacguacucacaaauacagaaagcgacgacucgauguggaaauucucccucgacagcgaauccucagaugacgcacuagacgagaucaucgcacaauuggacgaccccgcaauacacgucguagagcuagucaacgaaauacauuccuccaucacgcucgcgggaauaguaccagaaggacaaggauuaagcgaaucaauggucgagaaauacgaagcccacaaagcacaccuacagcuccugaaagcagucgaaaagcuaguagacaagaaagccgccgacaagcucgaaguggccuacgaccaauacaucaacggcaaagacaguaagcaguuuaucaaagaggacuucuacaaggcuguacaaagcgagauaaaaggaguagcaggcgacgaagucgccgaaaucaaccaacucaucgaacucgaucaauucaugccaaaacaaagaacgaaggagaauggagcaauuccccaccaacuccaccagcacgaacuugacgucauuaucgaaaaccagagcaaguauuacgauuggcucggagaaaaggucggaaacgaauacaaacucgauaaacugguaucauuccggguaccguacuaugucggcccccugguugacacggcaagcaaggaaaagaaagaugaaacgagguucgcauggaugguuaggaaaaaucccgaauccacagaggcgaucacaccguggaacuucgaggacauaguugauaaaaacgccucagccgaaaacuucaucaaacgaaugaccaccaaagacaaauaucucuuaaacgaagacguucuccccaaaugcucgcuauuaacgcaagacuucgagguuuacaacgaacuaaacaacaucaggguaaacggagaaaaauucaccgcagaacagaaacaacucauucaugacgaacuauucacgaaacacgcaaguguaucaauaaaacaacuuaaagacuuccuggucucagaacucauguacguccgcgacaaccucaaaguggaaggccuagccgacgaaaagaaacuaaugagcucacuuagcacgcaguuugauuaccagaaaaucaucccagaccaaauaaacgauguaaaauacagggaagauauagagcaaaucaucgaauggucaaccaucuucgaagacgccgccauauucaaaaccaaacucaaggaaauagacuggcucacggacgaacagaggaacaaacuugccaauaagcgcuacagaggaugggggucguuaagcaaacgacuacuagcaugccuagucgacgagaacggccaacgaaucaucgacauccuccgagauucaagcgacaacuucaugaugauagucaaccgcccagaguucaaacaagccaucuucgacgaaaacgcaaaccucacugagaccaacucuaaaaaggacauguucgaaaugauagacaacuucuacaccucaccccaaaacaagaaagccauacgacaaguacuccuaguagugcaagacauccagaacgccaugggcggggucgcuccacagaaaauauuuauagaguucgccagggaagacgaagucaauggccggcgaacaaacucccgcuacucgcagauccgagagauguacagcaagguaaccgacgacguaauuaacaaaaccgugcgaggcgaacucgaagcaaacaagggcucacucaacaaggaaaaacuguuccucuacuuccuacaaggagggauugacuuguacucgggcaagaccauaaacauagacaacaucucgagcuaugacgucgaccacguacuaccacagucauucauuaaagacgacuccauaaacaacaaaguccuaguaaacgcuaaaggaaaccgcguuaaaaacgacaacguacccauggaacuguucggcgccaaaauguacccaacauggaaacgaaugguagacaccggcaucaugagcaaggccaaguucaaaaacuugacacugaaccccgacaacgucgacaaauucaaggccgaaggcuucaucaacagacagcugguagaaacacggcaaauaauaaaacugguagcgcaaauacuuaacgacaaacugggagaugacaccaagaucgucucugucaaggcaaaccuaacccacgacaugcgaguguucuucgacuuccccaaaaaccgaaacguuaacaacuaccaccacgccuuugacgcuuaccuaagcgccuucguuggcacauaccuguacaaacgauauccaaaacuccagccguacuucguauacggcgaguucaagaaaauggauaaauugaagaacaugacgucauucgacuuccuccgagaccuaaagcacacagacaaagucguggacaaggacaccggcgaaaucaucgccgacaagcuggccgucauaaccaauaugaacaaaauuuacgacuucaagaaaguccucgucacccacgagguccacgaaaauagcggcgccauguacgaccaaacccuguacccggcaaaacucgacaagagucugggccgcaaaggggccaaacagcucaucccuaagaaagacgacaugccgaccgcgcucuacggaggauauaccggcuccaaagacgcauucaugagcauagugcgucugaaaaagaaagacgaggucuacuacaaaguaaucgggauacccguaagaaucgcugacuccguccagcacggaaaagaagucgacguggaagcccuaacccaauucaucgagacuaaauucaccaaagaaaaccucaacaagaaaaccggagagauaacgcgcaaagucgaaugguucgagcugguccuccccaaaguccuguucgggcaagccgucuucgacggagggcaaccuuuuaugcucggcuccuccacauauccccacaaccuaagagaacugguucuaaccaaagacuccguuaagaaaaucgcgggaaaagagaguaacaaaagcuaccucgacgcauacgacgaaaucauggaggcuaugaacaaauauuucccccucuacgacacaaacaaauuccgagaaaaagucaucgaaggcagaagcaaguucaucgaccuccccgacaaagacgaauacgagaacaacaaacucguacaagugggcaagucuacuauaauagacagaauguucaucggcuuacacgcaaaugccgcgcgcacagacuugaaaaacaucggcaucacaacccccuucggauucaugcagcaagcgagcggcaucaaacuaacaaaagacaccguaguccuauuucaaucaucgacgggucucuucgagcgcaagguagcacucaaggaccuauga

SEQ ID NO: 6533 - RNA, 4077 nt, Artificial Sequence
  Cas9 variant
augaaagagccguauggaguaggacucgauaucgggaccaauagcguaggcuggacagucgucgacgccuccggucauguccgcaaaauaaaaggacaaacgggaaucggaguaagacuauucaaagaaggcgccgccgcagccgaccgccgaggauuccggaccacacggcgccgucucaaaagagugaaguggcgucuucgccuacuucgcgaguucuucgaccaaccaauaucgaaagucgacaucaacuucuuugcaaggaggaaguacagcgacgucucaccuagagacccgaacuacaacggccuagagaaaacacucuucaaugaccgcuccgaccaggacuuuuaccacgacuauccuacaaucuaccaucuaagagaagcacucaugacacagcaccgcaaauuugauguccgagaaaucuaccucgcaauccaccauauaguaaaauauagaggcaacuuccuccguaacgacgcugcuaccgccuacagaucgggcacccuugaccuacaacaacacuucgaaacucucaaccaccuauucucgcaagcugacuuagaacucaaccucaaucuaacgaccgacgucgcccuucucgacagcaucaaacaaacacucguacguaccgacauaagccgauccgacaggcagaaacucaucaugccgcuccuagccguccugacgggcgcgaccacugccgagaaaaagcgccaaaaagccguaguaaccgaguucgccaaagcacuugugggcaacaaaacaaagauagacguccucacacuuacggacaucgacgccacggaagccaaagacugggcauucucacucgaagaaaaccaagauaaacugcccgguaucgaagacagauuuucggaaguaggacaacaaaucauagacgaagucauacgacuauacgcguccgucaaccucgcacagcuaaucccagaaggcaaacgcuuuucccaaagcaugguagaaaaguacaaacgacacggcgaagaucuaaaacuccucaaggccuauaucaggagccaguccgacgcuaaacgcggcagagcuaucagagcaacauacgaccaauacauugacggagucaaauccaagcaggucacccaggaagcauuccaaaaagcccucgggaaauuugucgacgcggacguagacuuaaacuccugggccgcccagaucaaacaggccauagacagcgagcaauucaugcccaaauuacgaacaaaacaaaacggagcgauccccuaucaaguccaacaaaacgagcuagaccaaauaauaucaaaccaaaaggaauacuacccauggcucggagaggaaaaucccgucauaaaacgccgcggaaaauucccauacaaacuggacgaauuauucggcuuccgcgugcccuauuacgugggaccacugauaacgaaggaaaugcaagcagccaccgccaaugcagguuucgccuggaugguccguaaagcggacggaccaauaaccccuuggaacuuugacgauaaagucgauagagucgccucagccacagcauucauccaacgaaugcaaacuacagacaccuaccugauuggcgaagaaguccugccggcgcgcucucugauauaucagcgguuuaugguccuaaacgagcuuaauaacauccggguagacgacggccaacuaacaccccgacaaaaacaacgccuauacaaccaaguauucaagaaacacaagcgcgucaccgccaagaacauucaagacaaccucgucgcggcacgagaguuccccaccgcgccccgcauaacaggacuagcagaucccaaaguguucaacucaagccucucaaccuaccacgaccucaaacaaguacuucccgaggcaauguccgacguccguaaacaggcagacauagaaaagauaauccuaugguccacaauauucgaagauucaaccaucuucaagcagaaacucacagaaauauccuggcugacggcugcccagcuaaaacaacuaggccaacugcguuacagagguuggggccaacuacuacguaagcuacuaacaggacucaaagacgacaacaaccgaagcauaauggacgggcucugggaaaccaacgccaacuucaugcagcuaagaagucaaccugcgaucgaaaaccaaaucaaauccgcuaaccaagcgaaccucacaacagccgaccuccaagacaccauaaacgaauuauacacaagcccccagaacaagaaagccauccgcgaagucauggucguccuagcagacauaaaagacgccaugcauggacagacccccaauuggauauucguagaagccgcuaggggcggaggcguggccgguagacgcacacaaucccgguccaagcaaauagucgccgcguaccaaggcaccgcccaggccauaguccgcgaccagguccagcgagaacucaaagagaaaaucaaaaacaaagcaaacuucaacacgaggcugguccucuacuuucuccaaaacggacgagacuuauauaccggcgacgccaucaacaucgaccgccuaucagaauacgacauugaccacauccucccccagagccuaguaaaagacgacucucucgauaauagaguccugacaaacgcaaggauaaaccgugagaaaaacgacacauucgcgucagaaaaguucggcaagaaaaugggcgccaaguggaaagaaaugcaccgcaugggauugaugaccaaacgaaaguuggaccaccuucucaugcgaccagacgagauaaguaaauacgccacgggcuucaucaaccgucaacucgucgaaacgcgacaagucaucaaacuugucgaggaacuaauaaacgcagaguaccccuccaccgccaucguaagcguaaaagccaaccuaacucaccaauuccgccaaaccuucgauuuccccaagauaagggaaguaaaugacuaccaucacgcauucgacgcagcgcucaccgccuucauaggcacuuaucugcucaagcgcuaccccaaacuugaacgcuucuuugucuacgguaaauucgcaaaacaaccggucaaccucaccagauucaauguaauacgcaaacucgcaaaaaccgacacccccauuacggacauagacacgggcgaaguccucugggacaaacucacagacauaaaguacuucgaaacccuguacgacuauaagcgauuauuaguaacucgcgaggucucagaaaacuacggugcaauguucgaccaaacacuucucaaggcauccgauaacggcaaacgccucauaagaaagaaacagagcuucgacacagcuaucuauggaggguacaccgggaagacccuagccuauauggcaauugucaaagucuccaccaagaaggacguacaauaccaaguggucggcguuccaaccaccauggugacccagauagaacagcuagagcagcaaggcaugacgaacaagcaagcugucacuaaagucaucgagccccuaauagcugcaaauaacaagaaaauguuaacauacgaagugcuccuccccaaggucagauucgaacaagucgucagagaccgcaucaagggucaaacacaccgauucgcacucgggacggacaccuacuaccauaacauacaagaauuauaccugccacuaacgcuccaaagggccuuccucggcaagcaaaacgagucagaaguacagcucaaucaaaaccuacuuaccgucuucgaugcgacgcucgcacaaguaaaccgcuacuucccacucuacgagaugaacaaauucaagaaaauccucaacucugcccgggaucaaaucgagcuauuagaagcuaaaaaccaguucgucaagaacaaacuugucuuaggcaaacagggcauccucaccaauauguucaucggauuacacgcaaacgcauccuacggcgaccuaaaagugcucggugugaaaaucgacuuuggaaaauuacaagucccaggaggcauaaagcucacgggcgacgccgaaaucaucuaccaaucccccacgggccucuucgaacgaaaaaucgcccuaaaagaccuauga

SEQ ID NO: 6534 - RNA, 4077 nt, Artificial Sequence
  Cas9 variant
augaacgagccauauggcgucggacuagacauagggacaaauucaguaggcuggaccguaguggacaugaacggacgggucagaaaagucaagggcaaaacagcccucggagcgcgccuuuucaaagaaggcgccaccgcagaggaccgcagggguuuccgaaccacgcggagaaggcuaaagagagucaaauggcggcugagacuccugcgggaguucuucgaccaacccaucagcaaaaucgaucccaauuucuucgcacgucgcaaauauucagacaucucgccccgggacccaaauuacaacggacuagcgaagacacuauucaacgaucgcaccgaccaggaguucuaucacgauuacccaacaauauaccaucugcgcgacaagcugaugacauccgaccgaaaauucgacauacgagaaauauacuuggccauccaccacauagucaaguacagagggaacuuccuccgcaccgggccggcaucucaauauggauccgcgucacuacaucucgccacgagcuuccaaaaacuaaacgaucuauuugcacagagcgaagaaagucugaacuucaagcuaguaacagacgaagcgcaacuacagcaaauccaacaaauacucgugcgcacggaucuaagcagaagcgaacaacaacgacaaauauggccuuuaaugguaguccucaugggagcgaccgccgcagagaaaaagagacagaaagacuucgcgaaggaacucgcaaacgcccuaguuggacugaaagcgaagcugaauguuguuacgcucacaaacgucgauacaaccgucgucaaagacuggacauucacacuagaagaaucgcaggacaaacugccagaaauagaagaacaacucucagaagucggacagcagaucauggacgaagucauacaacuauacgcaucagucaaccucgcccagcuaauuccugcaggaaaacgcuuuucucagcacauggucgagaaauauaaccaccacgagaaaaaucuggaacuacucaaggccuacauccacucacaauccgacagcaaacgaggccgggagauacgagcaacauacgacagauacauagauggcguaaagucaaagcccgucacucaagaaauguucuacaaggaccucaugaaauacguagaagccgacgcuaccagcaaccaccucgccgccgagauaaaggacgagaucgacuccgagcaauuuaugccaaaacuuagaacaaaacaaaacggaucaauaccauaccagguccaacaguacgaacuggaucaaauaauaucacaccagaagaaauacuacccauggcugggcgaggagaaccccgucgcagaaagaagaggcaaauucccguacaaacuggacgagcuaguuggguucagaguccccuauuacgucggaccccuaaucacaaaagaagaccaacaagcaacaucuggugccgguuucgcauggaugguccggaaagccgacgggccgauaacaccguggaacuucgaccagaaagucgaccgcaucgcauccgcaaccgcauuuauccaacgcaugcaaacaaccgacaccuaccuaauaggagaagacgugcuccccgcucgaucacucauuuaccagagauucaugguacuaaacgaacucaacaauaugcguguagaagaccaaaaacucgcgccacgccaaaaacaaagguuguacaaccagguauucaagcaacaccagcacguuuccguuaaaaacauccaacagaaccugauggacgccggggaauaccgagaaacccccaaaauuacgggacucgcagacccgaagggguuuaauuccagccugagcaccuaccacgacuucaaaaagauccucccagaagcgaucgcagacgaacacaaacgcgccgacauagagaaaauaauacuuuggucaaccacauucgaagacuccgccaucuucaaacagaaauuagaagaaguagcguggcuaacugacgcacagcggaaacagcucagcggccuccgauaccggggcuggggacagcucucgcacaagcugcucaccgcauucaaagacgauaacggacgaucuguaauggacggacucugggagaccagcgacaacuucaugcaacugcgcaagcaacccgcaauagaaacacaaauuaaagaagccaaucaagcaaaccucaccgacgccgacauacaagacacuaucaacgaacucuacacuagcccgcaaaauaagaaggcaauaagagaaguaaugcuaguacuagacgacaucaaaaacgccaugcacggccaaacacccagcuggauauucauugaggcagcacgcgggggagggguagcaggacgaaggacacaaagccgaucaaagcaaaucguugaggcauauaagagcaccgccaaagaaaucgugucagagaaaguccagcacgaacuaaacgagaaaaucaaggccaaagcggauuucaacacacgucugguacucuacuuccuccaaaacggucgagaccuauacacgaaugaagcgaucaacauagauagacuaagcgaauaugacaucgaccauauccucccccagagccucgucaaagacgacagccuggacaaccggguccuaacaagcgccagaaucaacagggagaagaacgacacauucgccuccgagaaauucggccgcaaaaugggcgcgcaauggcgggaacuccaccgaaauggccugaugacacagaggaaacuaaaacauuuacucaugaggcccgacgaaauauccaaacacgcaacugacuucauaaacagacagcuugucgaaacuagacaagucauaaagcuagucgaagaacugaucuccuccgaauacccgucagcaagcaucguggcggugaaagcaaaccucacacaccaguuccgacagacguucaacuuccccaaacuccgcgaggugaacgacuaccaccacgccuucgaugccagccucacggccuuuaucgggauguaucuauugaagcaauacccaaaacuugaacgcuucuucguauacgguaaauucgccaaacaaccgaucaaccuaacgcgauuuaacguaauucguaagcuagcggucgcggaggaacccaucgcuaauauagaaaccggcgaaauccucugggacaaaacggcagacaucaaaugcuucgaaaaacucuacaacuauaaacggcuccucguaacacacgagguccgcgaaaauuacggagccauguucgaccagacgauauucaaagccaccgacagccgaaaacggcucauacaaaagaagaaaggauucgcgacagagacauauggaggcuacaccggacgaacacucgcauaccuggcaauagucaaagucgucacaaacaaagauacccaguaccaaguugugggaauaccaaccaccaugguaacccaaauacaacaacuagaagccucaggccuuaccagcaaacaggccguaaccaaagcaauaggcgcuaugaucaaugaaaacaacaaaaagcuacaaucauacgaaguccucuuaccaaaggugcgguuugaacagguaguaagggacgagguaaagggucacauccaccgauucgccuuagggaccgacacuuacuaccacaacauccaggagcuuuaccuaccgcuuaccauccaacgagcuuuucuugggaagcgcaacgacaccgacgcacaaacagaacaaaaucugcuaacggucuucgaaaccacccucgcccaagucaacagauauuucccacuuuacgagaugaacaaauucaagcagauccucaacagcgcgcaagaaaaauucgccgcgcucccaacaaagaacaaaacagugaagaacaaacucgucaccgguaaagacggaguccuaaacaaccuauucauaggccuccacgccaacgcaagucuuggggaccugaagauccuaggaaugaaaaccggauucggaaaauuacaaguaccaggcggacucaaacuaacagaucaggcagaaaucauauaucaaucacccacaggacuguuugaacgcaaaguggcacugaaagaucuauga

SEQ ID NO: 6535 - RNA, 4077 nt, Artificial Sequence
  Cas9 variant
augaacgagccauacggcgucggacucgacauaggaaccaacucagugggguggaccguagucgauaugaacggacguguacgcaaggucaaaggcaaaacagcacuuggcgcucgacuuuucaaggaaggagcgacagccgaagacagaaggggauucagaaccacccgccgcagauuaaaacgcgucaaguggcgccuccgcuuacuccgcgaauuuuucgaccaaccgauuucuaaaaucgacccaaacuucuuugccaggaggaaguacagugacauuucuccucgcgaccccaacuacaacggccuugcuaaaacccuuuucaacgaccgaaccgaccaagaguucuaccacgacuacccaacgauauaccaccuccgcgacaaacucaugacaucggaucguaaauucgacauccgcgaaauauaccuagcaauacaccacaucguaaaguaccgcggaaacuuccuacgcacagguccagcuucacaauacggaagugccucacuccaccucgccacguccuuccagaagcucaacgaucucuucgcgcaguccgaagaaagccucaacuucaaacuugucacagacgaagcucaacugcagcaaauccaacaaauccucguccgcacagaccuaagccgcucugagcaacaacgccaaaucuggccccuaauggucguccuuaugggcgcaaccgcggcugaaaagaagcgccaaaaagacuuugcgaaagaacucgccaacgcccucguugggcucaaggcaaagcucaacgucgucaccuugacgaacgucgacacgaccgucgucaaggacuggaccuucacgcuugaagagucacaagacaaacugcccgaaauagaggagcagcucuccgaaguagggcagcaaauaauggacgaagugauccaacuauacgccucaguaaaccucgcccaacuaauccccgccgggaaaagauucucacagcacaugguggaaaaauacaaccaccacgagaaaaacuuagaacuuuuaaaagcguacauacacagccaaucggacucaaaacgaggucgggaaaucagagcaaccuacgaccgguacaucgacggugucaaaagcaaaccggucacucaggaaauguuuuacaaagaccuuaugaaauacgucgaagccgacgccaccagcaaucaccucgcggcagagaucaaggacgaaauagacuccgaacaauucaugccaaaacuucgcacaaaacaaaacgggucgaucccauaccaaguacagcaauaugaacuggaccaaauaauaucgcaccagaaaaaguacuacccauggcuaggugaggaaaaccccgucgccgagcgucgcggcaaguucccauacaagcuagaugaacucguuggcuuccgaguaccauacuaugucgggccccucaucaccaaagaagaccaacaagcgacuucaggcgcaggcuucgccuggaugguaagaaaagccgacggaccuaucacacccuggaauuucgaucaaaaagucgaccgcauagcguccgccacagccuucauccaaagaaugcagacgacggacaccuaccucaucggugaagauguccuuccggcgcguucacucauauaccaaagguucaugguacucaacgaacuaaacaauaugagaguggaagaccaaaaacucgcgccccgccaaaagcagcgccucuacaaccagguauuuaaacagcaccaacacgucuccgucaaaaauauccaacagaaucuaauggacgccggcgaauaucgugaaaccccaaaaauaacaggacuagccgacccaaaaggauuuaauuccucccuuuccacauaccacgacuucaaaaagaucuuacccgaggccauagccgacgaacacaaacgggccgacauagaaaagauaauauuauggagcaccaccuucgaggacagcgcaaucuucaaacaaaaacucgaagaaguagccuggcuaacagacgcccaacgcaaacagcuaagcgggcugagguaccgcggguggggccaacugagucacaagcuccugacagccuucaaggacgacaacggucgcuccgucauggacggucuaugggagacauccgacaacuucaugcaacuccgcaaacaacccgcgauugaaacacaaauuaaggaagcgaaccaggcaaaucuuacagacgcagacauacaagacaccaucaacgagcuauauaccucuccccaaaacaagaaagcaauccgcgaagugauguuaguucucgacgacaucaaaaacgccaugcacgggcaaaccccguccuggauauucaucgaagcagcaaggggagggggcguagcuggccgcagaacgcaaucccggucaaaacaaauuguagaggccuacaagucaaccgccaaggaaauaguguccgaaaaaguccagcacgaacuaaacgagaaaaucaaagcgaaggcagauuuuaacacacgccuaguccuauacuuccuccagaacgggcgagaccuauacaccaacgaagcaaucaacaucgaucgccuuucggaauacgauaucgaccacauucugccgcaaucacuuguaaaagacgacagccuagacaaccgcgugcucacauccgcccguauaaaccgcgagaaaaacgacacauuugcaucagaaaaauucggccguaaaaugggcgcccaauggcgagaacuucacagaaauggccucaugacucagcgcaagcugaagcaccuccuuaugcgccccgacgaaauauccaaacacgcaaccgacuucauaaaccgacaacucguagaaacccgccaaguaaucaagcuagucgaagaacucaucagcucugaauaccccuccgccuccauaguagcagucaaagccaaccuaacccaccaauuccgacaaacguucaacuucccaaaacuccgagaaguaaaugauuaccaucacgccuucgacgcaucccugacggccuucaucgggauguaucucuugaaacaauacccaaaacucgaacgauuuuucgucuacggaaaguucgcaaaacaacccaucaaccuaacccgauucaacguaauuagaaagcucgccgucgccgaggaacccauugccaacaucgaaacaggggaaauucugugggacaaaacagccgacauuaagugcuucgaaaaacucuauaauuacaaacgccuguuaguuacccacgagguccgcgaaaacuacggagcaauguucgaucaaaccaucuucaaagcaacagauuccagaaagcggcuuauacagaaaaagaaaggauucgcgaccgaaacauacggcggauauaccggacguacccuggcauaccucgcgauagucaaggugguaaccaacaaagacacacaguaccaagucguaggaauacccacgaccaugguaacccaaauccaacagcucgaggccuccggccuaaccuccaagcaggccgucacuaaagccauaggugcuaugauaaacgaaaacaacaagaaacuacaaucauacgaaguccuacucccaaaaguacgauucgagcaagucguaagagacgaggucaaaggccacauccaccgcuucgcgcuggggacugacaccuacuaccacaacauacaagaacucuaucugccccugaccauacaacgggcguuccuaggcaagcgcaacgacacagacgcgcagacagaacaaaacuuacucacaguauucgagaccacccucgcccaagucaacagguacuucccacuguacgaaaugaacaaauucaaacagauccucaacucagcccaggagaaguuugcagcccucccgacgaaaaacaaaacagucaaaaacaagcuggucacaggaaaagacggcgugcuaaacaaccuauucaucggccuacacgcaaacgccucgcucggcgaccuaaaaauccuggggaugaagaucggguuuggaaaacuacaagucccgggcggccuaaaacuaacagaccaagcagaaauuauuuaccagagccccaccggacucuucgaacgcaaaguagcacucaaagaccuauga

SEQ ID NO: 6536 - RNA, 4077 nt, Artificial Sequence
  Cas9 variant
augaaagagccauacggcgucggacucgacaucggaaccaacucaguuggcuggaccguggucgacgccagcggccacguccgcaaaaucaagggacaaaccgggauaggaguacgccuauucaaagagggggccgccgcagccgaucgccguggcuucaggacuaccagacgccgacucaaacgagucaaauggcgacuacgccuacuucgugaauuuuucgaccagcccaucucaaaagucgacaucaacuucuuugcgcgccguaaguacucugacauaaguccccgcgaccccaacuacaacggccucgaaaagacacuauucaacgaccgaucagaccaggacuucuaccacgacuauccaacuaucuaccaccuacgcgaagcacugaugacacagcaccgcaaauucgacguccgcgaaaucuaccuggccauacaccacauagucaaauaccgcggcaauuuccucaggaaugacgccgccacagcauaccgcucaggaacacuagaccuucagcagcacuucgagacacugaaccaccuguucagucaggccgaccucgaacuaaaccucaaucucaccacggauguagccuuacuggacucgauaaaacagacacucguaagaacagacaucagccgguccgaccgacagaagcucaucaugccccuauuagcgguccuaaccggcgccaccacugcagaaaagaaaagacaaaaagcugugguaaccgaguuugcaaaagccuuaguugguaacaaaaccaaaaucgacguacuaacccugacagacaucgacgcaacagaagccaaggacugggccuucucucuggaagaaaaccaggacaagcuaccuggaaucgaagaccgcuucagcgaagugggacaacaaauuaucgacgagguaauaagacucuaugccagcgucaaccuggcccagcuaauaccagagggcaaacgcuucucgcaauccaugguagaaaaauacaaacgccacggagaagaccugaagcugcugaaagcauacauccgcucccaaucagacgcaaaaagaggcagagcuauuagagcuaccuacgaucaauauaucgacggcgucaaaagcaaacaagugacacaggaagccuuccaaaaagcccucggcaaauucguugacgccgacgucgaccuaaacagcugggccgcacagauaaagcaggcgaucgauuccgaacaauucaugcccaaauugcgaaccaaacaaaacggggccauaccauaccaaguccaacaaaacgaauuggaccaaaucauuaacaaccaaaaggaauacuauccauggcuuggcgaagaaaaccccgucauaaaacgccgcggcaaauuccccuacaaacucgacgaacugguuggauuccguguaccauacuauguuggcccacugaucacgaaagaaaugcaagccgcuaccgcaaacgcgggcuucgcauggaugguccgcaaagcagacggacccauaaccccuuggaacuucgacgauaaaguugaucgcguagcaucggccacugcauucauacaacguaugcaaacgacugacaccuaccucauaggcgaagaggugcucccagccagaucacucaucuaccagcgauucauggugcucaacgaacucaacaacauacgggucgaugacgggcaacuaacccccagacaaaaacagcgcuuauacaaccaagucuuuaaaaagcacaaacgcguuaccgccaaaaauauacaagacaaccuaguggcagccggagaguuccccaccgccccucgaauaaccggccuggcggaccccaaaguauucaacuccucacuguccaccuaccacgaccugaaacaaguacuacccgaagccaugagcgaugucagaaaacaggccgacaucgagaaaaucaucuuaugguccacgaucuucgaggacagcaccaucuuuaaacagaaacuaacugaaaucuccuggcuuacagcagcgcaacuaaaacaauuaggucaacuacgcuaucgcggcugggggcaacucucucgcaaacuccuaacggggcuuaaggacgacaacaaucguucaaucauggacggacuaugggagaccaaugcgaacuucaugcaacuccgcagccaaccagcgauagaaaaccagauaaaauccgcgaaccaggccaaucuaaccaccgcagaucuucaagacacaauaaacgaacucuacacaagcccccaaaauaaaaaggcaauucgagaagucaugguuguccuagcagauauaaaagacgccaugcacgggcagaccccaaauuggaucuucguagaagcggccaggggaggaggcgucgccgguagacgcacacagagccgcagcaaacaaaucgucgccgccuaccaaggcacagcccaagucaucgugagcgaccaaguccagcgcgaacuaaaggagaaaaucaaaaacaaagcgaacuuuaacaccaggcuggugcuguacuuccugcaaaauggcagagaccucuacaccggagacgccauuaacauagaccgccucagcgaauaugacaucgaccacauccucccacagagucucgucaaagaugacagccucgacaacagaguauuaacgaaugcucgaaucaacagagagaagaacgacaccuucgccagugaaaaguucggcaagaaaaugggcgcgaaauggaaagaaaugcacaggaugggacucaugacuaaacgcaaacucgaccaucugcuaaugagaccggacgagaucagcaaauaugcaaccggauucaucaacagacaacuggucgaaacgcgacaggucauaaagcuagucgaggaacucaucaacgcagaguacccuagcacagcaaucgugagugucaaggccaaccucacacaccaauucaggcaaaccuucgacuuucccaaaauacgugaagucaaugauuaccaccacgcguucgacgccgcccucacagcuuucauaggaacuuaccuacuaaagcgauacccaaaacuugaacgauucuucguauacggcaaauuugcaaagcagcccguuaaccucacccgcuuuaacguuauaaggaagcuagcaaagaccgacacucccauaacagacauagacaccggcgagguucuaugggacaaacugacagacauaaaauacuucgagacccucuacgacuacaaacgccuccuaguaacccgagagguuucugaaaacuacggggcaauguucgaccagacacugcugaaagccucggacaacggaaaacgccucauccguaaaaagcagagcuucgacacggcgauuuacgggggauacaccgggaagacgcuagccuacauggccaucgucaagguuucgacaaagaaagacgugcaauaccaagucgucggcguccccacaaccaugguaacacaaauugaacaacuggagcagcaaggaaugacgaacaaacaggccgucacaaaagucaucgaaccacugauugccgcuaacaacaagaaaaugcucaccuacgagguccuccucccgaaaguccgcuuugaacaaguuguccgcgaccgcaucaaaggccagacccacagauucgcacugggcacagacacguacuaccacaacauacaagagcucuaccuaccccugacgcuccaaagagccuuccuaggaaaacaaaacgaaucagaaguacaacuaaaccagaaccucuugaccgucuucgaugccacacuagcccaaguuaaccgauacuuuccucucuaugaaaugaacaaauuuaagaaaauccuaaacuccgccagagaccaaauagaacuccuagaagcgaaaaaccaguucgucaaaaacaagcuaguccucgggaaacaaggcauacucacuaacauguucaucggacugcacgccaacgcgagcuucggcgaccuaaaaagccuaggagugaaaaccuccuucggacaacuacaagucccgggcggcauaaaacucacaggggacgccgaaauaaucuaccaaucacccacuggccucuuugaacgaaaaauugcgcucaaggaccucuga

SEQ ID NO: 6537 - RNA, 4077 nt, Artificial Sequence
  Cas9 variant
augaaacaaggaaaacgcggcuacuaccuuggccuugacaucggaacagacuccaucggauacgccgucacagacgaacaauaccaucugcucagguuccacggaaaugacgccuggggcagccauguauucgacagcgcaucacucugcgacgaacggcgcggguucagaucggcaagacgccgucuggaccguagacagcaacgggucaaacuacuacaggaaauauuugcgaaagagaucgcgaacaucgacccacgauucuucauccggcucuccgaaagcuacagauggcgugaugacacagacgacagauacaucuacuucaaugaagaagaauacacggacauucaauacaugcgcgacuaccccacuauacaccauuuaaucugcgaacuuauggagaacgaagaggaacacgacaucaggcuagucuaccuugcaugcgccuggcucgucgcgcacagaggccacuuccucucacagcucuccgucgacaacauagacucgcuuauagacaucgaaagcgucuaccaaaaauucuugcauuucuucaucgauaacggaugcgagaaccccuggauccaggacgccgaacucgucggaggcauacugaaagaacacauaggggucaccgaaaaacauaaccgacuaggagaaaucauguuaggaaaccggaaaccgucgaaggacgugcgagauacuuuccuauacucggaguacugcaucauccggcuacuugccgguggcacaugcaaacuccgagaccucuacggcaaagaagaguaugaggacuuuggcuccgucucgcuggaaauggaugacgacaaacuggccgaaauaaugauuaacauuggcgaagacuacgaacucaucgcgguacugcgcagccuccacgacugguccguacucgcagacauucucgacgggcagaacggccuaacaaacaucaguaccgcaaaaguugccaucuacgaacaacauaagaaagaucuagcaacgcucaaauacuucauacgaaaauacuguccugaaaaauacaacgccaucuucaaggacgcccgugaagacaacuacgucgccuacagcuaucacuacaacaacaagcucgacggacaaauaaagaagaaagcagacacagaaacguucagcaaauuccuaaucaaaaucauccacucaaucaagcccgacaaagaagacgaaauaaucuaccaagacauggacaaccgccuggggcuacgccaauuccuaccaaagcaacggaacacagauaaccgagucauaccacaucaacuauacgaauacgaacuuaagaaaauucucgaaaacgcggcaaaauacuuguccuuccuaaaucaaaaagaagacgggauauccaacacugagaaaauaauaagcaucuucaaauucaagauacccuacuacguaggcccauuaaauaaacacagcgaguucgcauggauagacagaaaaucaggaaaaauacuaccauggaacuacgaaaacaugauugacgacgacgccagcgaagaggcauucaucaagaaaaugaccaaucaauguacuuaccuccccggggaauccguacuccccaaagacucccuuugcuaccagaaauucaugguacugaaugaaaucaacaacauaaaagucgacggcagaaaaaucagcgugggugcaaaacaaggcauauacagcgaucucuuccucaaauacaagaaagugaaacgaucacagauagaagaauaccucaucucaaacggacaacuagagaaaaaucggcgagaaacccuguccggcauagacauucagaucaaaucgucccucuccagccacaucgcauuccggcgacugcucgaacagaaaauccucaaugaagcggacgucgagcgaaucaucgagagagcgucguacgccgaggacaaggggcgagucgcuaaauggcuucgcgccaaguacccccaccucaccgaagcugacauuaaguauaucuguaaggucaaaauaaaagacuucggccgacucucccgcaccuuccuaacaggcauugagggcgccugcaaggaaacuggcgaagucgcaaccaucauuucaaugaugugggaaagcaacgacaaccugauggagcuucucucagaacguuacacauucgccgauacaauacucgaguucaaaagcgacuacuacacagaaagaaagcaaacgcuaagcgaaagacuugacgaaauguacguguccaacgcaguaagacgaccaauauacagaacccuagacaucgugaaggaccuugaaaaagccuucggcaagccagagaaaaucuuuauagaaaugacccgaggcgcaaugccggagcucaaaggcaaaagaaccaaaucccgacaacaacagcuguuggaguacuacgacaagugcaaagaggaagauguacgugaccuaaaacaacaacuagaggcacuaggcgaguacgucgacaacaaacuccaaucagaccgucuguuccucuacuucaugcaauucggaaaaugcgcauauuccgggaugcccauaucgcuugaacgacugauggccggcucaaaagaauacgacauagaccacaucuacccacaagcauacgucaaagaugacucgauaauuaacaauaagguccucguccuauccgucgcuaauggcgagaagaaggacguauaccccaucaaaucagaaauccgcaacaaaaugcagaaaacaugguccuucuggcaccacguaggaacuaucucagacgaaaaguacaaacgucucauacgcucaacuccguucacagaggacgaaaaguacggcuucauaaaucgucaacucaccgaaaccagccaaagcacaaaagucgucgccgagcuguuaaaagagcgguaccccgaagcggaaaucgucuacuccaaagcaggccuuauaucagacuuccgacacgaguucgaccucuacaaaucacgcuccuacaacgaccuccaccaugccgucgacgcauauuugaacauuguggucggcaacguauaucauaugcgcuucucccggcagugguucaacguaaacucauccuacuccauuaaaacgaagacacuguucacccacaccgugaacugcaaugggaaagaagucuggaacaaggacaugcuucccggggugcuuaaaaccgccaagaaaaacacugcccacuucaccaaacaugcaacauucaaaacuggcgggcucuuugaccagaacccagucaaaaaggcucccgggcuaacuccccucaaggccggguuaccgacggaaaaauacggaggauauaacaaagccggcguaauguuuuucauaccgguaagauacaagagcggcaagaaaacaguccucauggugcucuccgucgagcuacucuaugggaaccgcuuucucgaggacgagaucuuugcgaaggaauacgcaaaagaccgccugcaacgcaugaucggcaaaucgguugacgaaaucgacuucccaauuggaaugagaccauggaaagugaacacaauauuaucccuagacggcuuccguauuugcauaacuggaaacgcgucaggcggcaagugccuuaucgcccaacccaucaugcaguuuagcuccgacgaguacuggaaauacuaccucaagaaaguugaaaaguucguagaaaaagugaagaacaauagcagcuacgucuacgacgucgacuacgaugccguucaacacgaggacaaccugaaacucuacgaucuguacuuggacaaacuacaaaacucuaucuaccgcaaacgaaucaacgcccccauucagacacucaucgaagggcgcgaaaaauucauugacugcucagucaucgaacagugccaaguauuacuuaacauccaccaaguuuuuggacggaugacauccgggugcgacuuaacgcuuaucggcgggaagaccaggagcgcaucgaccguaaacuucagcucuaucauauuaaauuggaagaaaaacuauacagacguccggaucaucgaccaguccgccuccggucucugggaagucguaagcgaaaacauccucgaguaccuauga

SEQ ID NO: 6538 - RNA, 4077 nt, Artificial Sequence
  Cas9 variant
augggcaaaauguacuaucucggacuggacauuggaacaaacuccguaggcuacgccgucaccgauccgagcuaucaccuacuaaaguucaagggcgaaccaauguggggcgcccacguguucgcagcggggaaucagucagccgaacgccgcagcuuccgaaccagccgccgaagacuugaccgccgacaacaaagaguuaaacuuguccaagaaaucuucgcacccgucauaucacccauagacccucgguucuucauccgacuccacgaaagcgcacucuggcgcgacgacgucgccgagaccgacaaacacauuuucuucaacgaccccacauauacagauaaagaauacuacagcgacuaccccacuauccaccaccucauagucgaccucauggaauccucagagaagcacgaccccagauuagucuaccuugcagucgcguggcuagucgcgcaccggggccacuuccuuaacgaggucgacaaagacaacauaggagacguacuauccuucgacgcauucuacccggaguuccucgccuuccuaagcgacaacggcguaucuccauggguuugcgaaagcaaggcacuccaagccaccuuacuaucgcggaauagugucaacgacaaauacaaggcauuaaaaagccuaauauucggcucacagaaacccgaagacaacuucgacgcgaacauaucugaagacggccuaauccaacuacuagcagggaagaaagucaaagucaacaaacuauucccccaggaaucaaaugaugcaucauucacacucaacgacaaagaagacgcaauugaagaaauccucggcacccuaacgccggacgaaugcgaauggaucgcgcauauccgacgccuauuugacugggccauaaugaaacacgcgcuuaaagacggacgaaccaucagcgaauccaaagugaaacucuacgaacagcaccaccacgauuuaacacagcucaaguacuucguuaagaccuaccucgccaaggaguacgacgacaucuuccgcaacguagacucugagaccacuaaaaacuacguagcuuacuccuaccacgucaaggaagugaaaggcacccuacccaagaacaaagccacucaagaagaguucugcaaauacguccugggcaaagugaaaaacauagaauguucagaggcagacaagguagacuuugacgaaaugauacagcgccucaccgacaacagcuucaugccgaaacaggucucaggugaaaaccgugucauacccuaucagcuguacuacuacgaacucaaaaccauacuuaacaaagcagccuccuaucuaccauuccuaacucaaugcggcaaggacgcaauuuccaaccaagacaagcuccuaagcaucaugaccuuccgaauccccuauuucgucggcccacuacguaaagacaacuccgaacaugcguggcuagagagaaaagccggcaaaaucuaucccuggaacuuuaacgacaaggucgacuuggacaaaucagaagaagcauucauccgacgcaugaccaauaccugcacauacuauccaggugaggauguacuuccuuuagacucccuaauauacgagaaauucaugauccuuaacgaaaucaacaacauccggauugauggcuaccccaucagcguagacgucaagcaacaagucuucggacucuucgaaaagaaacgccgcgucacagugaaagacauacagaaccuucuacucagccuuggcgcgcucgacaagcacgggaaacucaccgguaucgauacaaccauccacucgaacuauaauaccuaccaccacuucaaaucguugauggaaagaggcguccucacccgagaugacguugagcggauaguggagcgcaugacauacucggacgauacuaaacgaguccgccuaugguuaaacaacaacuacggaacucucacugccgaugaugucaaacacauaagcagacuacgcaaacacgauuucggucgccucaguaagauguuccucacugggcuaaagggcguacacaaggagaccggcgagcgagcaucaauccucgacuucauguggaacaccaacgacaaccucaugcaacuccuuagcgaaugcuacacuuucucagacgaaauaacaaaacuccaagaagcguauuacgccaaagcucaacuaucacuaaacgacuuucuagauucgauguacauaagcaacgccgugaagcguccgauauaccgcacccuagcgguuguaaacgacauccgcaaagccugcgggacagcacccaagagaaucuucauagaaauggcccgagacggagaaagcaaaaagaaacgcucggucacaagaagagaacagauuaaaaaccuauaccggucaauccgcaaagacuuccagcaggaagucgacuuccuggagaaaauccuugaaaacaaaucagacggacaacuacaauccgacgcucucuaccucuacuucgcccagcucggaagggacauguacacaggagacccaaucaagcuagaacacaucaaagaccaauccuuuuacaacauagaccauaucuacccgcagaguaugguaaaagacgacagccucgacaacaaaguccuaguucaguccgaaauuaauggcgaaaaaucaagccgguacccccuagacgccgcaauccgaaacaagaugaaaccgcuaugggacgcauacuacaaccacggacucaucagccucaaaaaguaccaaagacugacacgaucaacacccuucaccgaugacgaaaagugggacuuuaucaaucgacagcuagucgaaacucgucaaucaacaaaggcccucgccauccuccuaaaacgaaaauuuccagauacagaaauaguauacuccaaagccgggcuaagcagcgacuuccgccacgaguucggccuggugaaaucaagaaacauaaaugaucugcaccacgcaaaagacgcuuuccuagccaucgucacagggaacgucuaucacgaacgauuuaaccggcgaugguucaugguaaaccaaccguacuccgucaaaacaaaaacacucuuuacccacucaaucaaaaacgggaacuucguugcauggaacggugaagaagaucuaggccgcauagugaaaaugcuuaagcaaaacaaaaacacaauacacuucaccagauucucuuucgaucgcaaagaaggccuauucgauauacaaccucucaaagcaucaaccggccuaguaccgcgcaaagcgggccucgacguuguaaaauacggaggguacgacaaaagcacggccgccuacuaccuccucguacgauuuacccuugaagacaagaaaacgcaacauaagcucaugaugaucccggucgaagggcuuuauaaagcccgaauagaccacgacaaagaauuucuaaccgacuacgcccaaacgaccaucucggagauacuacaaaaagacaaacaaaaagucauaaauaucauguucccgaugggcacgcgccacauaaagcugaacucuaugaucucaauagauggauuuuaucuauccaucggcgguaagucgagcaagggaaagucgguacuuugucacgcgaugguaccccuuauuguaccccacaaaauagaaugcuacaucaaagcaauggagucguuugcccgaaaauucaaagaaaacaacaaacuccgcauagucgaaaaauucgacaagaucacggucgaagacaaccucaaccucuacgaacucuuccuucagaaacuacaacacaacccguacaacaaauucuucagcacccaauucgacguccucaccaacggcagauccaccuucaccaaacuuagccccgaagaacagguccaaacccugcuaaacauccucagcauauucaaaacuugccguuccagcgguugcgaccuaaaaagcauaaacggauccgcgcaagcagcacgaaucaugauauccgcagaucuaacaggacugagcaagaaguauagugacauccgacugguggaacaaagugcauccggucuauucguguccaagucccaaaaccuccuagaauaccuguga

SEQ ID NO: 6539 - RNA, 4083 nt, Artificial Sequence
  Cas9 variant
augacaaaacucggaaaacccuacggcaucggggucgacaucggcuccaauagcaucggauuugcugccguagacgaaaacucucaccucaucagacuaaaaggcaaaacugucaucggagcccgccucuucgaagaagguaaggcagccgcagaucgccgcgcgagccgcacuacccgcagacgccucucccgcaacagguggagacucaguuucuugcgcgacuucuucgaaagucauaucacccccacagauccgaacuucuucaugcgccaaaaauacagcgaaaucagccccaaagacaaagcacgcuacaaauacgaaaaacgccucuucaacgaccgcacagacgcagaguucuaccaacaguacccaaccauguaccacuuacgcacccgccuacuaaccgauccaagcaaagccgacguccgagaaauauacuuugcaauucaccauauccugaaauccaggggacauuucuuaacaagcggauacgcgaaagacuuuaacaccaacaaagucgcacucaacgaaauauuccccgcccuccaggacgccuacgcgcaaguguacccggaccuagacauaacauucgacgaaaacaaagucaacgaauuuaaaacggugcuccuagacgagaaagcaacccccagcgauacccaacgagccuuagucaaccuccuccuggcggaagacggagacaaagauauacucaaacaacaaaagcaaguccuaacggaauuugcaaaagccgugguaggacuaaagacaaaacucaacguggcacucggcacagaaguagacuccagcgaagcaaccgcauggaacuucucccucggccagcucgaugacaaaugggcagggaucgaaagugccaugaccgacgaagggacagaaauacuagaccagauccgagaccuguaccgcgcccggcuccuaaaugggaucguaccggcaggaaaaacccuaucccaggccaaaguagacgacuacgaacagcaucaugaagaccuugaauuguucaaagauuacuuaaaacagcuggaagacgacgguauggcaaaagcaauccgccagcuuuacgacagguacaucgauggcgacgacgcgaaaccauucgugagagaagacuucgucaaagcccucaccaaagaaguaaccgcacaccccaaugcaaaaucaccugagcuccuagaaaggcugguacaacccgacuucaugcucaaacaacgcaauaaagcgaacggagcgauucccguccaaaugcaacaacgggaacuugaccagaucauuaagaaccaaagcguauacuaugacuggcuagccgccccgaacccggucgagaaacacagacaauccaugcccuaccaauucgacgagcuccucaacuuccgaauccccuauuacgucggcccccugguaacggccaaagaacaaaaagccgcacaaggcggaguauucgccuggaugguacggaaggacccggacggcaacauaacacccuacaacuuugacgagaaaguggaccgugaagccucagcaaacacguucauucagcggaugaaaaccacugacacauaccugauaggggaagacgugcuaccaaaacaaucgcuccuauaucagagcuaugaggugcucaacgaacucaacaacguccgcguaaacgacaacaagcuguccuucgaucagaaacaacaggucuuaggggaacucuucgagcggcauaauaccguaacgaucaaacaauuugucgacaaccuccuugcgcacggagacuacgaccggauaccagagguccggggccucgcagaugaaaaacgcuuccucucgucccugucaaccuacaaccaacuaaagggcauccuacacgaggcaauagacgauagcgacaagcagacagacaucgagaaaaucauugcaugguccaccauauucgaagauaaagcaaucuucaagacgaagcucaaugaaaucaguuggcuuaacgccggaaugaucaacucccucgcuaacauccgcuaccgcgguuggggccaauucucgcacaagcuccucaaugaacucacguugucaaccggccgcacagucuucgaggaacuccuuaucagcucccauaaccuaaugcaaauccugaccgacgaagugcuaaagcagaaaaucgccgagcuaaacgcacacgagcuaaaagcaagcggcauauacgcagccauagacgacgccuacacgucacccucgaacaaaaaggcccugcgucaaguccucuccgugaucgacgacaucaccaacgccgcgggccaggccccgaauuggcucuacaucgaaacggccgacggggauggcgucccuggcaaacgcacgaacucccgccagaggaagauacaggaaauauaugucaaugcagcucaggaguuaaucaccggcucaguccgcggagagcuagaagacaagaucgcuucacgagccgacuucacagaccgucuaguacucuacuuuaugcaagggggucgagacauauacaccggcgaaccacucaacaucgacaaccuuagcucauacgacauagaccacaucuuaccacagagccucauaaaggacaacagccuggacaaucgcguucucguccacccgcucgucaaccgugagaaggacaccaucuucgcaagcacucgcuucgcaaagcaaaugaacggcauguggcgccaauggcacgccgcuggccuaaucuccagccgaaagcuccgcaacuuacagaugcgcccagacgagauagacaaauacgcgagcggauucgucgcgcgacaacucgucgagacccgacaaauuauaaaacucacagaacaaauagucgccgaccaauaccccgacgccaagaucaucgccgucaaggcaggccuaagcucccaacugcgcaaggaacucgacuuccccaagaaccgagaaguaaaccacuaccaccaugcuuucgacgccuuucucgcagcccgaauaggcaccuaccuccuaaaacgauaccccaaccuagagccguucuucacguacggcaaguucaagaaaaccgaagucaagaaacuaaaaucauucaacuucauccgggacaugacccacgcaaaagacaaaaucgucgccaaagagacuggcgaaaucgugugggacaaugcaucagauauaaacgaacucgaccguauauacaacuucaaacgaaugcugaucacgcaugaggugcgauucgaaaccgcgucccuuuucaaacaaacacucuacgcugccaaaaacuccaagaaccgcgggggcucccgccagcucauucccaaaaagaaaggauaccuuguagauauuuacggcggcuacacccaagaaacaggauccuaucucucaguaguucgccuaaccaagaaagcaauguaugcaguaguuaaagugucuacucgcgaugcagccaaacuagccgucgcgaaaucaauuuccgaacaaaaagagaaugaaacacucaagaaaauaauagauggaaaacucucuaagacaagcaagaaaggcaaaacuacacaccaacuuuucgaaauagugcuaccucgcgucggacagaaaacccucuucaaaaacuccaaguauaaccaauuccuagucaacuccgacaccuacaugcacaacuaccaggaacucuggaugccccgcgaauaccaacgcauguggaaggacauacuccucuccaaccacggcgaugcgcaacucgaaggacaauuagaccagaucuuuaaauucauaguaucccagguaaacuccuacuuuaaccuauacgacauaaaccaauuuagaaagaaaaucgcagacgccaccgauaaauucgcuaaacuaccaacgcacgacacagacaacgcccgggguaaaaucgccacuaucggacaacuccuuaucggccuccaagcaaacgccaugagauccgaccuccgcaauuuagauauaaaaacuccauucggccugcuccagauaggaaccggaauuacccuagaucuagacacaagcaucaucuaucagucaccaaccggucuuuucgaaagggaggugccccuaaccgaccucuga

SEQ ID NO: 6540 - RNA, 4083 nt, Artificial Sequence
  Cas9 variant
augacaaagcugaaccaacccuaugguauaggccuagacauaggcagcaguucuaucgguuucgccguugucgacgccaauagccaccuccuacgacucaagggugaaaccgcaauaggcgcacgacuauuuagagaaggcgaguccgcggccggccggcgcgcaucucguaccacccgucgcaggcuuucacacaaucgcuggcgacuucgauuucuccaggacuucuucgacccacacauaucuuccauagacccugacuucuuccuacgacaaaaguacuccgaaauaucccccaaggauaaagaaagauucaaauacgagaagagacuguucaacgaccgcacagacgcccaguucuacaaacaauacccaaccauguaccaccuacgacuucaccuaaugaacgacgcguccaaagcugacccccgggaaaucuuuuucgccauacaccacauacuaaagagccggggacacuuccucacgccaggcgacgcgaaaaacuucaacaccgacgacguagaucugaagcauaucuucccagcacucacggaagccuacgcgcaagcauacccagaccucacccucuccuucgagccaagcaaagcugagaaauucaaaagcauauuacucgacgaagacgccacaagcaaugacacucagaaagcucucguaaaacuucuucucuccgacgacggggacaaagagguccucaagcaacaaaagaaaguucuaacggaguucgccaaagccgucgccggacucaaagucaaguucaacguagcacuaggcauagaaguaacagacgccgauguagaaaaauggcacuucggaauggcccagcuagaagauaaguggucagacauugaaccgucauugacugaccaaggcauggagaucuuugaacaaauccaagaucucuaucgcgcgagacuacugaacggcaucguccccgcaggcaaaacccucucccaagccaaaguggacgacuacgaccaacacuguaaggaccuaaagcuguucaaagaguaucuaaaacaacucaaugaccacgaccucgcgaaacgcauucgacuucuguaugaucgauauaucgacggagaugacgcgaagccauuccuccgcgacgacuucgucaaggcccuuaagaaggaaguuacugcccacccgaccgaacuagcagaaucgcuccuagaacgaauggaacaagacaacuucaugcuaaaacaacggaccaaagccaauggaucgauaccgguccaaaugcaacaacgggaacuggacaaaauaaucgcgaaccaagccgaguauuacucauggcuggccgcagaaaacccaguaaaagagcaccgcgacagcaaacccuaccaacuagacgaacuccugaacuuccguaucccauacuacgugggcccgaugaucacgaagaaacaacaagagaaauccgggcagaacguauucgcauggaugguacgaaaagaccccagcggaaacaucacuccauacaauuucgacgaaaaagucgaccgagaagccuccgcaaacgcuuucauccaaaggaugaaaaccacagauaccuaucuaaucggagaagacguacugcccaaacaaagccugcuguaccagaaauacgaaguacuuaacgaacuaaacaacguacgcgucaauggcgaaucccuaucgacagaccagaaaaagcgccugauccgagagcuauucgagcgacacucauccgucacccuaaagcaauucguagaaaaucuaguagcccacggcgauguggccaaacgcccggacguccgcggccucgccgaugagaaaagauuccuaucaucucuaucaaccuaccaccagcuucgaggcauucuccacgacgcgauugacgacagaggcaagcaauccgacaucgaaaacaucaucacaugguccaccguguucgaggacgccucgauauucaaauccaaacuuggcgagauaagcugguuagacucgaagacccggacaacacugucuaacauucgauaccgcggcuggggacaguucuccagaaaacugcuggacggcuuaaaacuugggaacggucacacaauuauacaggaacucaugcuaagcaguagaaaccucaugcaaauacugaccgacgagacacuuaagaaagagauggcgacccuuaaucaagagcgacucaaaccugacagcauaaacgaagcuaucgacgccgcguauacaucccccaguaacaagaaagcaauccgccaggugcuuaaggucguagaugacauaaaacacgccgcaaaugaccaagcccccuccuggcuuuacauagaaacagccgacgggggcggucaccccgguaaaagaacccucagccgccagaaacaaauucaggccaucuacgaaaauacagcaaaggagcuaauagacagcgcgguacgcggggaacucaaggacaagauagcagacaaaacgaacuucuccgaccgccuagugcucuacuucaugcaagggggacacgacaucuacacgggcaccgcucucaacaucgaccagcucucuagcuacgacauagaccacauccuaccccaaagccuaauaaaagacgacucccucgauaaccgggucuuaguccacgcgaagauaaaccgcgagaagaacgccgaguucgccucaacacuguucgccgcuaaaauggcuucuaccuggcaccgcuggagagacgcaggucuaauaaguggccgaaagcucaagaaccuccuaaugcgccccgacgaagucgacaaauacgccaaggguuucgucgccagacaacuugucgaaacccgccaaauaauaaaacugaccgagcaaaucguugccgcccaauaucccgacacaaaaauuaucgcgguaaaggccggacucagccaccagcuacgccaggagcucgacuucccuaaaaaccgagacguaaaccauuaucaccacgccuucgacgcauuccuagccgcgcgcauugguaccuaccuccucaaaagauaucccaaccuggcccccuucuucacguacggcgaauuuaccaaaaccaaccuaaagaaacuccaguccuucaauuucauaggggcacucacccacaccgacggaaaaaucacauccaaggacaccggggaaguccucugggacaaccaacgugacaucgaggagcuagaccaaaucuacaacuucaaacguauguuaaucacccacgaaguuuauuucgaaaccgccggacuauuuaaacaaacuguauacgcggccaaagacagcaaagaacguggcggcucgcgucaacucauaccgaaaaagaaaggcuacuccacgggcauauacggaggcuauacccaagaaaccggcagcuacaacgcacugguacgccucacaaaagccggcaaagucguauaccggguuuucaaaauauccacacaaaacgccgccgaaauagcagccgcacgaagccucucagccgaagagggaaacgaacgccuaugccagauccucgaacaaucccuccugaagaccaacaaagacaaaaagaacacagucgaucucuucgacguuguuaucccacgacucggcaaggaagcccucuuccacaauuccaaguacggccucuuucuagucaacuccgacacguacuaccacaacuaccaagaauuguggcuaagcagagagaaccagaagauacugaagaaacuguucuccaccaaauacgaccaaagcgaaauggaccgcgacgcauugcaccucuucgaaacgauagcuaagcaaguugaacaauuuuucaaacuuuacgacaucaaccaauuccguacgaaaauaagcucugccuucgacgcguucgaaaaauugcccgucgaaggcgaagaaggcaaagucgaaacacuaaaacagcuccugaucggguugcaugcaaacccaguaagguccgaccucaaaaaccuuggcauaaagacaccguucggauucuugcaagccgggaagggcauucaccucgacgacgacacugagauuauccaacaauccccagccggacuauucaagcgacggguacggcuagcagacuuauga

SEQ ID NO: 6541 - RNA, 4086 nt, Artificial Sequence
  Cas9 variant
augacaaaacucggcaaaccguacggcaucgggguagacaucggcucgaacaguauaggcuucgccgcaguagacgaaaacucacaccuuauccgccugaaaggaaaaacggucaucggggccaggcuguucgaagaaggaaaggcggccgccgaccgcagggccucccgaaccacacgucgccgucucucccgcaaccgauggagacuguccuuccucagagacuucuuugaaagccacauaacaccaaccggaccaaacuucuucaugagacagaaauacuccgaaauaucacccaaagacaaggcucgcuacaaauacgaaaaacgguuauucaacgauaggacagacgcggaguucuaccaacaauaccccaccauguaccaucuccggaacagacuacuaacggaccccuccaaggcggacguccgcgaaaucuacuuugccauccaccacauauuaaaaagccgcggacacuuccucaccucgggcuaugccaaggacuucaacacgaacaaaguagcccugaacgaaauuuuuccggcccugcaggacgcauacgcccagguguacccggaccuagacauaacguucgacgaaaauaagguaaacgaguucaagaccguacuucucaacgaaaaagcaaccccauccgacacacaacgggcccucguuaaucugcuccuagccgaagacggcgacaaagacauacugaaacaacaaaaacaggugcuaacagaguucgcaaaagccgucguugggcuaaagaccaagcucaacguggcgcuagguaccgaaguagacagcucggaagccacaguauggaacuucucacuaggccagcuugacgacaaaugggccggaaucgaaagcgcaaugaccgaugaaggaaccgaaauucuggaucaaauccgcgaucucuaccgagcccgacugcucaacggcaucgugcccgccggcaaaacucucucacaagcaaaaguagacgauuacgcccaacaccacgaagaccuagaauuguucaaggacuaccucaaacaacuagaggaugacggcacggccaaagcgauccgccaacuauacgaucgcuacaucgauggugacgacgccaaaccauucguacgagaggacuucgucaaagcacucaccaaagaagucacagcacauccgaacgccaaaagccccgaacuacuagagagacucgcgcagccggacuuuaugcucaaacaacgaaacaaagcgaacggcgcaaucccgguccagaugcaacaacgugaacuagaucaaauaaucaagaaccaaagugucuacuacgauugguuagccgcacccaacccaguagaaaagcaccgcaagucaaugccauaccagcuagacgaauuguuaaacuuccggauacccuacuacgugggacccuuagucaccgcaaaagagcaaaaagcggcccaaggcggggucuucgccuggaugguaaggaaagacccagacggaaacaucaccccuuacaacuucgaugagaaaguagaccgagaagccagcgccaacacauucauacaacgaaugaaaacgaccgacacguaccuaaucggugaagacguccugcccaaacaaagccuacucuaccaacguuaugaagugcuaaaugaacucaacaacguucgcgugaacaacgaaaaauuaucgauagaacaaaaacagcaaguaauacgcgaauuauucgagagacacaacagcguaaccauaaagcaauucgcagaaaaccuucgggcccacggggacuacgcgcacaucccagagauccgaggccucgcugaugaaaagcgauuccugagcucacucuccaccuacagacaacucaagaguuuacugccagacgccaucgacgacccugcgaaacaggccgacauagaaaacaucauagccuggagcaccguauucgaagacgcagcaaucuucaaaacaaaacuuaaagaaauaaacuggcucgacucccaaaccauaacaaaguuaagcaacauccgauaccggggauggggacaauuuagccacaaauuccuaaacggccucacacucggaaacggucacacgaucauacaagaacucuuccuaucaaacaacaaccugaugcagauucugaccgaugaaacccuccagaagaaaaugaccgaacuaaacgcggacaaacugaaagccgccaacauuaacgacgcuauagacgacgcguacacaagucccagcaacaagaaagcccuacgucaaguccuuaggguaauagaagacauuaaacgggcagccgacggacaagaccccucuuggcucuacguagaaacggcugacgggggcggcacuccaggaaagagaacccgcgcccgacaacaccagcuucaagagaucuacgcgaacgcugcacacgaacuuaucgacagcgccgugcgcggugaacuggaagauaagauagccgacaaagccgacuuuaacgacaggcuaguauuauacuucaugcaaggcggcagggacauuuauacaggcacgccgcucaacauagaccaacucucaagcuacgacauagaccacauccuaccccaaucacuaauaaaagacaacucccucgauaacagaguccuaguacaugccauaaucaaccgagaaaagaacgccaccuucgcaagcacaauauacgcccagaagaugaacgcaacguggcgacaguggcacgaggccggcuuaauaucuggucgaaaacuacggaaccuccaaaugcgcccagaccaaauugauaaguacgccaguggauucgucgcgcgccagcuuguugaaacccgucaaauuauaaaacuuacagaacagaucgucgcagcucaguaccccgagaccaagauaauagcuguaaaggccggccucucccaucagcucagagaggaacuagaguuuccaaagaaccgggacguaaaccacuaucaccacgcauucgacgcauuccuugcagccagaaucggcacguaccugcuaaagcgcuuuccaaaccuacaagccuuuuucacguacggaaaauucaagaaagcagacguuaagaagcugcgaggcuucaacuucauccgagacauuacacacgccgaagauaaaaucguaguaaaggacacaggagaaguaaucugggacaagaaacgugacguagacgagcuugacagaauuuacaacuuuaaacguaugcucauaacacacgaagugcacuucgaaaaggcggaccucuucaaacaaacggucuacggagcgaaggacagcaaagaggcaggcggcaaaaagcagcucauauccaaaaagaaaggauacccaguggacaucuacgguggauacacccaggaaacuggcucauaccuaagcguuguacgccucacaaagaaagcaauguaugcaguaguaaaaguaagcacacgagaugcagcuaaacuggcagucgcaaaaucaauaagcgagcaaaaagaaaacgaaacccuaaaugacauaauagacgaaaaacucucgaagaucuccaaaaacgggaagauaacacacgagcuguucgaagucguacucccacgcguuggacagaaaacacuauucaaaaacucgaaauacaaccucuuccuugugaacagcgacaccuauaugcacaacuaccaagaguuguggaugccccgagaguaccaaaagauguggaaagacauuucgcucucaaaauacggcgaugcgcaaacugaagaccaacuggaccaaauauucggcuucaucguaagccaaguuaacagcuacuucaaccuauacgauaucaaccaauuccgcaagaaacucaacgacgcagcagacaaauucgccacacuccccaugagagacacagacgauaugcaagggaaaauagccaccauuggucagcugcuaauuggacuacaggccaacgcugccagaucagaccuacgaaauuuggacauaaaaacaccccugggacugcuccaaaucccaaacgguaucucacucgacuccgauaccagugucguauaccaaucccccacaggacuccucgagagggaaguccaccuguccgaccucuga

SEQ ID NO: 6542 - RNA, 4086 nt, Artificial Sequence
  Cas9 variant
augaagaagccauacagcauaggacuggacaucggcaccaauucaguaggguggucggucgucaccgacgacuacaaaguccccgccaagaaaaugaaaguccugggcaacacggacaaagaauacauaaagaagaaucucauaggggcucuccuauucgacucaggcgaaaccgcggaagccacucgaaugaaacguaccgcgagacgccgauacacccggaggcggaaccggauccuguaccuucaggacauauucuccccagagcucaaccaagucgaugaauccuuccugcaccggcuggacgacagcuucuuaguagccgaagacaagcgcggagaacgccacgucauauucggcaauaucgccgacgagguaaaauaccacaaagaguucccuaccaucuaccaccuacggaaacacuuagcggauagcucagaaaaggccgaccuacgccucgucuaccuagcgcucgcgcacaucauaaaauaccguggccacuuccucauagacgagccuauagacaucagaaacaugaacagccaaaaccucuucaaagaguuccuacuggccuucgacggcauccaagucgacugcuaccuggcauccaaacacacugacaucagcggcaucaucacagcaaagaucuccaaguccagaaaggucgaagcaguacuugaacaguucccagaccaaaagaaaaacagcuucuucgggaauauggugucgcuaguauucgggcugaugcccaacuuuaaaucaaacuucgaacucgacgaggaugcuaagcugcaauuuagccgcgacucguacgacgaggaccuagaaaaucuccugggaauuauuggugacgaauaugccgacgucuuuguagcugcgaagaaagucuacgacucgauauugcucagcggcauccucacaacaaacaaccauagcacgaaagcaccacugagcgcuucgaugauugaccgauacgaugaacacaauuccgacaagaaacuccugcgggauuuuauacgaacgaacauaggaaaagaaguguucaaagagguauucuacgacaccagcaaaaacggauacgcaggcuacauagacggaaaaacaaaccaagaggacuucuacaaauaccugaaaaacuuacuacaaaaagucgacggaggcgacuacuucauagagaagauugaaagagaagacuuucuccggaaacaacgcacauucgacaaugggucuaucccacaucaggugcaucucgacgaaaugaaggccauccugcgacggcagggcgaguucuaccccuuccucaaggaaaacgccgagaaaauacaacagauacugaccuucaaaaucccguacuauguugguccacuugcccgaggcaacucccgcuuugccugggccucauacaacucgaacgaaaagaugacgccuuggaacuucgacaacgucauagacaaaacgagcucagcccaagcauucaucgaacgcaugacaaacaacgaccuauaccuacccgaccaaaaaguccucccuaaacauucgcuucucuaccagaaauucgccguguacaacgaacucaccaaaaucaaauacguaaccgaaaccggcgaagcucgacuauucgacguauuccugaagaaagaaauauucgacggacucuucaagaaagaacgaaaaguaaccaagaagaaaauacucaacuuccucgacaaaaacuucgacgaguuccgcauaacagacauccaagggcuagacaaugagacaggcaacuucaacgcgucguacggaacuuaucacgaucugcuuaaaauaaucggcgauaaagaguucauggauucaucagacaacgucgaugucuuagaagauaucguacuaucacuaacccucuucgaagaucgcgaaaugaucaaacagcgccuccucaaauacgaagacauuuucagcaaaaaggucaucgcgaaucuaaccaggcgucacuacaccggguggggccggcugagugccaaauuaaucaacggcauaaaagacaagcacagccgaaaaaccauuuuggacuaccuaaucgacgacggccacagcaaccgcaacuucaugcaacucauaaacgacgacaaccuguccuucaaagacgaaaucgcgaacagccaagucaucggcgacggagacgaccuacaccagguaguacaggaacucgcaggcucgccggcgauuaagaaggggauccuacagucacuuaagauagucgaugaacuggucaaggucaugggauacaacccagagcaaauaguggucgagauggccagggaaaaccaaacgaccgcgcgcggacgcaacaacucacaacagcgccuaggcucccuaacaaaggccauccaggacuuugggagcgacauccucaaacguuacccagucgaaaacaaccagcuccaaaacgaccaacuuuaccuauacuaccuccagaacggaaaagacauguacacaggcgacacccucgacauacacaaucuaagucaauacgacauagaccacauuaucccacaauccuucauaaaggacaacagucucgacaaccgcgucuuaaccaacucgaaaucuaaccggggcaaaucagacaacgucccguccaacgagguuguaaagcgcaugaaaggauucuggcugaagcagcucgacgcaaaacucaucucgcagcggaaauucgauaaccugacgaaagccgagcgcggaggacuguccgcagaggacaaagccggauucauaaaacgccaacugguggaaaccagacaaauaaccaagcacguagcucgaauuuuggacgaacgcuucaaccgugacuucgacaaaaacgacaaacgcauaagaaauguaaaaaucgucacccugaaaagcaaccucguaagcaacuucaggaaagaguucggauucuacaaggugcgagaaauaaauaacuuccaccacgcgcaugacgcauaccugaacgcggucgucgccaaggcucuccugauaagauaucccaaacuugaaccagaguuugucuauggagaauaccccaaguacaacucguauagagagcgcaaaucagccacggagaaaauguucuucuauuccaauauuaugaacauguucaaaacaaccauaaaauuagccgacgggagagucguggaaaaacccgugaucgaagccaacgaagaaaccggcgagaucgcaugggacaagacaaaacacuucgcuaauguuaaaaagguccucucauacccccaggucuccauagucaagaaagucgaggaacaaacaggcggauucucaaaagaaagcauccucccaaaaggcggauccgacaaacuaauagcgcggaaaaccaaaaacaacuauuuaucaacacaaaaauacggagguuucgacucgccaaccguagccuacuccauaauguuugucgcagacauagagaagggcaaaagcaagcgccuuaagacaguaaaagaaaugauaggcaucacaaucauggaaaggagccgauucgagucaaacagcguaacguuccuggaggaaaagggauaccgcaacauucgggaaaauacgauaaucaaguucccuaaauacucacuauucgaacucgagaacggacgaagaaggcuccuugcaagugcaauagaacugcaaaaaggaaaugagauguuucuaccgcaacaguucguaaaccuccuguaccaugcgcagcacgccaacaaagaagacuccgucaucuaccuggagaaacaucggcacgaacuauccgaacuuuuucaucacaucaucggcgucagcgagaaaaccauacucaagccuaaagucgaaaugacuuuaaacgaggcuuucgaaaaacacuucgaguucgacgaagucagugaacucgcgcagagcuucaucagcuugcucaaauuuaccgcguucggggcacccggcggcuucaaguuccuagacgcagacauaaaacaaucaaaccucagauaccagaccgugacggaaguccucagcagcacccuaauccaucaauccguaacaggacucuaugaaacccguauagaccucagcaaacugggaggcgaauga

SEQ ID NO: 6543 - RNA, 4086 nt, Artificial Sequence
  Cas9 variant
auggggaacuauuaccucggccuugacaucggcacaaacagcgucggaugggcaguaacagacgaaaacuacaauaucgagagguucaaaaagaaaaauaugugggguauacgacucuucgaugaagcaaaaacagcugaaagccgccggauccaccgccaggcccgacgcaugcggcagagaaagauccagaggcucaaccuacuaauggaacucuucgacgucgagaucagcaaggucgacgagaguuucuucauccguaagaaagaaagcgaucuacauuaugaggacaagucccaagacucacgcuacgcccuguucaaugacaaagaauuuaacgacaaggacuaccacaacaaauacccaacaaucuuccaccucauuauggaucuaaucgaaaacgacgaaaagaaggacauccgccugcucuaucuggccugccauuaccuaaucaaaaaccgcggccauuucauauucgagggacaaaaguucgacgucaacucaucgcucaauaacaacauaaacaaacucaaaucucacuuggaccaauucuacaacaucugccuagacuucgacaacgacaaacuaaucgaaaucuuagucaaccaaaaccucaauaucuccgaaaagagcaagaaaaucaaagaacuauuacgaaaaaccaacuuggaagucggcaucgccaaucucaucgccggcggcuccauaaaacuuagcaacauguucgacgacgaugaacugaagaaccucgacuacaacucacucagcuucaaaaauuccaacuucgacgagggucgcgaacuguuugaggagguccuagaagaucgcuucgagcucgucgaaauccucaaagacauacaugaugccucaguccuagaaaccaugcuaagcuccgccuccauaagccccgacggagggaaauacauuagcuccuccaugaucaacuccuacaacaaacacaaacgggaccugaagcuccuaaagaaaaucaucaaaaaguacaagaaaagcgaauacgauaauauauuccgcgacgaaaacaucaaaaacaacuaccuuagcuacacccgcacggggaucaacaaaaacaagaaaguccaagcagaagacaacacagacucagacggcuucuacaaauacauagugaaaauccuaaaggauauuaaggaaaacgauuccgaugaagacauuaaguacauacucagcgagauugauaagaaaaacuucgucccgaaacaacgcaccaaagagaauagcgugauccccuaucagcugcgagagauagaacuaagaaaaaucauagacaaucagucgaaauaucacaaauuccugaacgaaguagacgagaaagggaucagcgugaaagaaaagauaaucucgcuacucacauuccgaauaccauacuauauaggcccacuaaauccaucauauaacgaggagaaaaacuucaccaccagcugggucaaacgacucgccaaaggcaaagugacccccuggaauuuugaagacaugguagacaucgacgccucucgcgaagccuucauugagaacaaacucaauaaauguucauuccuccuagacgagaccgugcugccaaaggacucccuucuauaccaagaauauaugguccucaacgaacugaacaaccucaagaucaacggccaguccaucaacaccgaccugaaaaaguccauauaugaagaacuguucaagaaauauaagaaagucacccggaaacgacuaauaagcuacauaaaagagaaagaaaacaugagcggcgacauagugauaacagggaucgauggggacuucaaacagggccuaaaaagcuacaucgccuucaaagauauaaucggagagaaaaucgaugacgacaucuaccgaaaggaaguagagaaaaucauccgagacauuagccuauacggggacgacaaaucguucauacaaaagaagaucaaaaacgaaaacaaacucgaccugagcgacgaccagauaagcaaaauugccaaacucaaauucaaggauuggggaagguucucgaagaaacuccuaguaggaaucaaagccuccgacaaaaacaccggcgaaaucgacaacauuaucggauucaugcggaacuacaacuacaacaucaugcaacuaauggcaaacguguucacguucaaagacgaaauugaaaaacucaacagcaaguacuacaccgacgagaaaaucaacauagacuaucuagacgaccuuuaucuaagcucaccagcaaaacgaaugcucuggcaaucauuucaaauuguugaugaaaucaaaaacaucaaaaacucggacccgaagaaaauauucaucgaaauggcccguucaaaagaggacaagccgacacgcaaaaugucgcgcaaaucccggcuggaaaaguuauacaccgacagcaaaaagcaguucaucaaacucuucggcccggaugaguaugacaaacuaaacaacgaaauaaagaacaaaucagaaagcgauuuccgcugggauaaccucuaccuguacuacacacaauucggccgcuguauguauucucuagaccccauagaccucgaagaacuuagcaauaaaaaccuauacgaccaggaccauauauacccaaagucgaagaucuacgacgacagcauagaaaacagagugcucguaaagaaacaacugaaccucgauaaaucaaaugaguaccccaucccagaccgcguacucaacaaagacaaaaauaaacuacuagcauucuggaaaaugcucaacgaaaaagaacuaaucggagacaagaaauacgcacgccugauccgcaaauccccuuucaccgaugaagaacuaggggacuuuauagcaaggcaacuggucgagacccgccaggcaaccaaagaaaccgcaaacaugcuaaaacgacucugucccgacagcaaaaucguauacgugaaagcgaagaaugucuccgacuuccgccgcaaguucgacauccucaaaugccguuccauaaaugaccugcaccacgcccacgacgcguaccuaaacaucguugucggaaacgucuucgacacgaaauucaccuccaacccccuuaacuucaucaaaaacaacagcaaaaaccgcucauacaaccuagagaagauauacgacuacgacguaauccgaaacgagaaaauagcauggcucgccgaacggaaagaagaaaaccaagacggcagcauagcaaccguccugaaaaaccuaucgaagaacgacauccgcguaacgcgccgcacauacaucaagugcgaggaccuauucgacgagaacauagugcgcaagggcaacggcaaguuccccauaaaagagaacaacaauaagagugacaccaauaaguacggcggguacucgggaaucaaaaacgcuuacuucgugcuacucgaggacgaaaaacacaacagaauauuagaggcaauacccucuuuuauauacaagaaagagaaaaacggagaaaaagggagcgugaucaacuaccuucagaacaucuuaggcaucaaaagcgccaaaauacugcgcgauaaaaucaagauugggucccuacuaaagaucgacaaauucccauacaaccucgcgggaaaauccggcaauggaauccugaucuccggcgggguccaacugauucuugacaagaacacaagcaaauacaucaagaaaaucgaaaauuacaaauauaaacucgacgagaacaaagacuaccaaauaaacaucuucgacaagcuaaguaaggaagagaacauaaaacucuuugaccuuuuugucgacaaauucgaaaauagcaucuacaagaaucgcgucaacaucaaacucaaagaaaucaagcuagcgagacccaaauucgagcaccucucgaucgaggaacaaauaaaaacgcugacacagaugcucauacucuuuggacgagaaaacaacgccguaaaccuagaauacauuggacuccccaaaaacacagguaaaacgaaaaucaacaagaaaauaaacaacaaagauauaaagauaauaaaccaguccauaacaggucuguacgagacugaagaggaccuggcaaauaucuga

SEQ ID NO: 6544 - RNA, 4086 nt, Artificial Sequence
  Cas9 variant
augacgaaacuaaaccagccauacggcauuggacucgacauaggaucgaacuccaucggcuucgcagucguugacgcaaacagccaccuccuucgccuaaaaggggagaccgcaaucggugcccgccucuuccgagaaggccaaagugccgccgaacgacgcgagucccgaacgaccagacgccgccuuucacgaacucgcuggcgucucagcuuccuccgagacuucuuugccccgcacauaacgaaaaucgacccagauuucuuccuucgucaaaaauacagcgagauuucuccaaaggacaaggacagauucaaauacgagaagcguuuguuuaacgacagaaccgacgccgaauuuuacgaggacuaccccagcauguaucaucucagacugcaccuaaugacgcacacgcacaaagccgacccccgugagaucuuucuagcaauacaucacauacugaaaucucgcggccauuuccucacacccggagccgccaaggauuucaacaccgacaaagucgaccucgaggacauauucccagcgcuaaccgaagccuacgcccaaguuuacccugaucucgagcucaccuuugacuuagccaaagccgacgacuucaaagcgaagcuccucgacgaacaagcuaccccaucggacacccaaaaggcccucguuaaccuacuccugucgagcgacggagaaaaagaaauuguaaagaaaagaaaacaaguacuaacagaguucgcaaaagcaauuaccggccucaaaacuaaauucaaccuagcgcuagggacagaagucgacgaagcagacgccagcaauuggcaguucucgauggggcagcucgacgacaaauggaguaacauagaaacuucaaugacggaccaaggcacggaaaucuucgagcaaauccaggaacucuaccgcgccaggcuacuaaacggcaucgucccggcagguaugucccucagccaggcaaagguagccgauuauggccagcacaaggaagaucuagaacucuucaagaccuaccuuaagaaacucaacgaccacgaacucgcaaaaaccauuaggggccucuacgaccguuacaucaauggcgaugacgcaaaacccuuccuccgcgaggacuucgugaaggcucugacgaaggaggucaccgcacaucccaacgaggugucggaacaacuccucaacagaauggggcaggcgaauuucaugcucaaacaacggaccaaagcuaacggugccauuccaguccaacuacaacagcgcgaacucgaccagauuauugccaaccagagcaaauacuacgacuggcuagcaaaaccaaacccagucgagaaacaucgagcaucaaagccauaccagcucgacgagcuucucacauuccggauaccauacuacgugggaccgcuaaucaccccgaaagaacaagcagaaucccgagaaaacguauucgcguggaugauccggaaagacccguccggaaacauaacaccguacaacuucgacgagaaagucgacugucccgcaucagcuaacauguucauccaacgcaugaagaacacugacaccuaccucauaggugaagacguccuuccaaagcgcucacuccucuaucaaaaauacgaaguccucaaugaauuaaacaacguuagcauagacggaagacgccugggggccgaccaaaaacagagacuaauacgcgaagucuuugagagacacagcucggucacaauaaaacaagucgcugagaaucuaguagcccauggggacuucgcaaagcgcccggaaauccguggacuagcagacgaaaaacgauuccugaguucucucuccacauaucaccagcuaaagaaaauccuccacgaagccaucgacgaccccacaaaagaacacgacaucgaaaacaucauuacgugguccaccgucuucgaggacgcagcgaucuucaaaacggaacuggccaaaauaagcuggcucgacuccgacaccaucaaggcccucagcaacauaagauaccggggguggggacaauucagucguaaacugcuagauggguuaaaacucggcaacggacacacagucauccaggaacuaaugcuaucaaaucacaaccucaugcagauacugacagacgaaacacugaaaaccacaauggccgaacucaaccaagacaaacucaaagccgaugacauugaagacguaaucaacgacgcguacaccagccccucaaacaagaaagcccuccgccaaguacugcgaguagucgaagacaucaaacacgcggcgaacgggcaggaccccucauggcucuacaucgagacagcagacggccccggaacagccggcaaaagaacccagucaagacaaaaacaaauacagaccgucuacgccaaugcggcacaagaacucaucgauuccgccguuagaggagaacuugaagacaaaauugcagacaaagcaucauuuaccgaccgccucguuuuguacuucaugcaagggggacgcgacaucuacaccggugccccucucaacauagaccaauuaagccacuacgacauagaccacauccugccacaaucgcucaucaaggacgauagccuagacaaccgaguccuaguaaacgcgaccauaaacagagagaaaaacaaugucuucgccuccacccuguucgccagcaaaauggcggcgacauggcguaaauggcacgaagcaggacuaauauccggccgcaaacuaaggaaccucauguuacggccugacgaaauagauaaguuugcucacggcuuugucgcaagacaacucgucgaaacacggcagaucauaaaacucaccgaacagauagcagcagcccaauaccccaacaccaaaaucauagcaguaaaggccggacuaucccaccaacuacgagaggaacuagacuuccccaaaaaccgagacgucaaccacuaccaccacgcauucgacgccuuccucgccgcacgcauagggacuuacuugcucaaacgcuacccaaaacucgcaccauucuucaccuacggcgaguucgccaaggucgacgucaagaaguuccgagaguucaacuucauuggagcacuaacgcacgccaaaaagaacaucgucgcaaaggacaccggcgaaauaguuugggacaaggaaagggacauucaagaacucgaucggaucuacaacuuuaaacgcaugcucauaacacaugagguguacuucgagacggcagaucucuuuaaacagaccauauacgcagcaaaagacuccaaagaaagaggcggcuccaaacaacuuauccccaaaaagcaggguuacccaacgcaagucuacggggguuacacacgugaaaacacagccuaccuagccguagucaaaacaguugaaaagaaagcagaugucuacagagucguccgcauagccacgucccaaguggccgccuugaaagaagcgcgggcccagagcacagucaaagaaagggaacuccucaaaaaguuucucaccaccaaauucacgaaaauaggcaaaaacggaaagaaagcgaucacgccauuugacauaguaauaccccgaguaccccgcgagcaacucuuccauaacaaacgcuacggauucuuuauggucaacucugacacccuaaugcacaacuaucaggaacuauggauguccagaagugaccaacagauccucuccaaauuagucaaauccgccaaaaccguggagaauggacaggugggccgucuauuugaaaacauagucgagcaaaucaacaaauauuucccacucuaugacaucaaccaguuccguaagaagcucgaccaaagcaaggauaucuucuccaaacugccacuagaaggcaacgguacuaccucaggcaaacgagaaacuauccaaaacauacucaccggcgcaggcaccggcgccaaaaacggagaucuaaagaaccuaggcauaaaaacccccuucggcuucuugcaaguuccaucuggcaucguccuagacgacgacaccacacucauauaccaaucccccaccgguaugcucaaccgcaucguccgccugagugaacucuga

SEQ ID NO: 6545 - RNA, 4086 nt, Artificial Sequence
  Cas9 variant
augaaaaacgaagaaaacaucuaccuagggcuagacaucggcaccgacucggucggguacgccgugacggaugacaaauauaaaauaaugaaauaccaugggaacgcggccugggggagcaccaucuucgacgccggagcauuaggugcagaccgacgaguauuuagauccgcacgccgccgccucgaucgacgccaggagcgcauacaguuacuacaggagaucuuugccaacgaaauagccaaaguagacgaacgcuucuucauacgacuccucgagagcggacucuggcgcgccgacgccgaggaccgauacguauucuucaacgacaaagaguacaccgauguucaguacaugcgcgacuaccccacgauccaccaccugauaugcgaacuaaucuacaaccccaacaagcacgacguacgccuggucuaccucgcaugcgcguggcugguaacgcaucgcggccacuuccugagcaacaucaacaccgagaauauagccgaccuaguugacauacacaacgucuacaacggauucaugcgauucuucgaagagaacgagaucauaugugacuggagagaagucaacguagaggaacuaggacgcguccucgcagcaaacaucggaauaaacgaaaaauaccgcaaccuauccaccguacucuucgccacacgcaaacccgacaagaaagccaaagaaggguuucccuauagcgaagaugccaucguccggcugcuugcuggcggcacgugcaaacuaaaagacguuuacauaaaagaagaauaugaugaguucggcucaaucacgcugggcauggacgacgagaaaaugacggaaaucauggccgacaucggcgacgacuucgaucucaucaaggcccugcggucccucuacgacugggguauacuggccaacauacuggucaacgaaaacaacagcccccugauuucccagaguaaagugaaggucuacgaacaacacagggaagaccucgccaaccugaaguaccuaguccacaaauauaucccccacaaauacaacgaaauauucagagaaauccgcggcgacaauuauguagcauacuccuaccacuacgaauugaagaacgacgaaaagaugggaaagaaagccgacguugaaaaauucucaaaauuccuacugaaaauacuagaaggcaucagcguagacgagcaggauaaaguagucuacgacaacaugauugaacggcuuacccuacggcuguuucuccccaaacagaaaaacaccgacaaccgaguaauuccccaccaacucuacgaauacgaacucaaaucuauccucaaaaacaccaagaacuaccuaccauuccuuaaggaaaaagacagugacggcauuagcaaugaggacaaaaucauaagcaucuuuaaauucaaaauccccuacuucgugggcccucuaaacuguaacagccaauucgcguggauacaacguaaggcggauggcaaaauauucccuuggaacuucgaagacaaaguggacuucgacgcauccgaacaggcguuuauccagcgcaugacaaaccaguguaccuaccugccugaagaaagcgugcuaccaaaacaaucauuauacuaccagaaauucaugguacucaacgagaucaacaacaucaaaaucgacggacggaaaaucuccguggcaaugaaacaggaacuauacaacgaaaucuuugagaaaaagaaacgaguccgcaaaaaggacgucauagacuuuuucgucucgaacggcuaucuugaaggaggcaaagaagcucuaaucagcggguuggacgagcagauucacacgaaucugagcuccuuccacgccuuucgacgacugcugcagaaccacauccucuccgucgaagacgucgaaucuauaaucgagcgggcgagcuacuccgaugacaaacggcgcguacuccucuucuuaaagaacaaauacuccuuccucaccgacgaagacaucaaguacaucugcaagaucaaaauuaaagacuucgguagacucagcaagaaauuccucguggacuucgaagggacaugcaaagagacuggagagaucaguacuguccugcggcucaugugggaaaccaacaauaaucuuauggaacugcucagcgacaaauacaccuuugccaacggcauaaaagaaaacaggaagaaauacuacacagaacagcagaaaacccuagaugacagacuggacgaaauguacaucagcaacagcguaaagcgaaccaucuaucgcacccugagcguugucaaagacgugaccaaagcauucgggguaccaaagaagaucuucguagagauggcccggacuaacaacccugaccuaaagggcaaacgaaccaggacccgccaacagcaagugauagaacucuacgcaaaaugcgacgaagaggacguucgcgagcucaaacaucaaauggaaucccuaggagaauaugucgacaacaaacuacagucagacaaacuauuccuuuacuucauacaauucggcaaaucagcuuacucaggaaagaugauugaccuggaaaaacucaugagcggguccaaggucuacgauaucgaacacauauacccacaagccuacguaaaagacgacucaauuauuaauaacaagguccucguguucagcgaggaaaacggagcaaagcaggacauauacccaaucaaaaccgagauccgcaaacagauguccgggaucuggaccacuuggcaccacgugggagccaucuccgaugaaaaguacaagcggcuuacgcgcagcacccccuucaacgaagaugaaaaauacggauuuauaaaccgacaacuaaccgaaacaagccagucgacaaaagccaucgcccaaauccuaaacgaaaaguacccggagaccgagaucguguacguaaaggcgggacucguuagcgacuuccgacacgaguucggccucugcaaaugccggucguacaacgaccugcaccaugccaucgacgcauaucucaacgugguaguugggaacguguacaacaugaaguucaaucgaaagugguucaguguagacuccaaauacucgauaaaaacuaaaacuauauucagucauagccuaguaugcaacggaaagaucauaugggacaaagagaaaaugcucccuaugguccucaaaaaugcaaagaagaacaacgcacacuucacgaaauaucaguucaugaagacggguggguucuucgaccaaaugccaugcaagaaagccucagggcucguaccccgcaagaaaggacuggacacggaacguuacggaggguacaacaaaucaggaauaauguuccucacccccaugagguauaaaauagggaagaaauccgauaucauuauccuaagcaucgaacuccuauauggaaaacuauuccucaaagacgaaguguucgcaaagaaauacgccgaagagagacuacagaaaauaaucgggaagaaagcagacgaggucuccuuccccaugggcaugaaaccauggaaaauaaacaccguauugagccuagacgguuucaacguguguaucacgggaaucgggggcggcgggaaaugccuaagugcacaaccaaucaugcaacuaucccuacccuacgagcucgcgaaauaccuuaagaaaaucgaaaaguucgucgaaaagaacaaaaacaacgccaauuauauauaugacgagcaguaugacagcgucuccguagacgagaacaucaaguuauacgacguuuaccuggacaaacucgaaaacuccaucuacaacaaaagaaucaacucaccagaagcaauccugaaaaacgggcgagagaaauucuguaaacucaacgugcuggaacaagccgugacucucaucaacauccaaagcauauucggaagaaugacaggcggcugcgaucuagaaaacauugggggaaagaaacacagcgcagccacggucaacuucagcuccaauguauccaacuggaagaaauacuacaacgacgugcgcguuguguaccagucacccagcggaaucugggaacgcaggucccaaaacauccucgaacuccuauga

SEQ ID NO: 6546 - RNA, 4086 nt, Artificial Sequence
  Cas9 variant
augaaugaacccuacggcgucggacuugacauaggaacgaauagcguagguuggaccgugguagacaugaacgguagaguaaggaaaguaaaaggaaaaacagcccucggcgcacgccuauucaaagaaggagccaccgcagaagaccgucgcggcuuucguacgacccgccgaagacuuaaaagggugaaguggcgacucagacugcuacgagaguucuucgaccagcccauaaguaaaauagaucccaacuucuucgcccgccgcaaauacucagacauuagcccacgggacccaaacuacaacggccucgcgaagacccuuuucaacgaccgcaccgacaaagaauuuuacgacgacuacgcaaccaucuaccaucuccgcgauaaacuaaugaccuccaaccgaaaauucgauauccgcgaaaucuaccucgcaauccaucacauaguaaaguaccgcggcaacuuccuucgcaccggcccggcaucccaauacggcucggccucccuccaccuggcaacguccuuccagaaacuaaacgaucucuuugcacaaucugaggaaacccucaaccucaagcucgugaccgacgaagcgcuccugcaacagauacagcaaauacucguaagaaccgaccucucgagaucggaacaacaacgccagauauggccacuaauggcgguccuaacgggggcaucugcagcagaaaagaaaagacagaaaaacguggucguagaguuaagcaaggcgcugguagggcucaaagcgaagaugaacgucgucacccuaaccgaggucgacgcagccguggucaaagacuggaccuucacgauggaggagucccaagauaaacuacccgagauagaagaacaacucucagaggugggccaacaaaucauggacgaagugauucaacuguacgcaucgguaaaccucgcccaacuaaucccagccggcaagcgcuucagccaacacaugguggagaaauacaaacaccacgagaagaaccuagaacuacucaaggcuuacauacacucccaauccgacagcaaacgggggagagaaauacgggccaccuacgaucgguacaucgauggcgucgacuccaaacccgucacacaggaaauguuuuacaaggaccucaugaaguacgucgaagccgacgccacuagcaaccacuuagccgcagagaucaaagacgagauagacucagaacaauucaugcccaaacuucgcacuaaacaaaacggcuccauacccuaucaagugcagcaauacgagcucgaucaaauaauuagccaccagaaaaaguacuacccauggcuaggagaagaaaacccaguagcagaacgacgcggcaaguuccccuacaaauuggacgaguuggugggcuuccgagucccauacuacgucggcccacucaucaccaaagaagaccaacaagcaacgagcggcgccggauucgcuuggaugguacguaaagccgauggacccaucaccccguggaacuucgaccaaaaaguugaccgcauagccuccgcgacagccuucauccagcgcaugcaaacgacagacacguaucucaucggagaagauguccuaccggcaagaucgcucaucuaccagagguucauggucuugaacgaacuaaauaacaugcgcgucgaagaccggaaacuagccccucagcaaaaacaacgccucuacaaccaagucuucaaacagcaccaacacgucagugucaaaaacauccagcagaaccuaauggacgccggcgaauacagaaagaccccacaaauaacaggccuggccgacccaaagggcuucaacagcucacucucaacuuaccacgacuucaagaagauccugcucgaagccaucgcagacgaacacaaacgagccgauauugagaaaauaauccuaugguccacaacguucgaagacucagcuauuuuuaaacaaaaacucgaagaaguagccuggcucaccgacgcacaaagaaagcagcucucgggccuacgguacagagguuggggccaacucucacacaaacugcuaaccgccuucaaggacgacaaagggagauccauuauggacggccugugggaaaccucagacaacuucaugcaacuacgaaaacagcccgccaucgaaacgcagauuaaagaagccaaucaagcaaaucucacagacgccgacauccaagacaccauaaacgaacucuacaccagcccacagaacaaaaaggcaauccgcgaaguaaugcucguccucgacgacauuaaaaacgccaugcacggacagacacccuccuggaucuucgucgaagcagcccgaggcggcggcgucgcaggccgacgcacacagucacgcucgucccagauuguagaggcuuacaaagguaccgcuaaagaaauaguaucagaaaaaguccaacacgaacugaacgagaaaauaaaagccaaagccgacuucaauacccgacucguucuguacuuucuacagaacgggcgagaccucuacaccaacgaagcaaucaacauagacagacucagugaauacgauauagaccacauccugccccagucgcuuguaaaagacgacucacucgacaaucgugugcucacguccgcacguauaaaccgcgagaaaaacgacaccuucgcgagcgaaaaauucggcagaaaaaugggagcacaguggcgcgaacuacaccgaaauggacucaugacccagcgcaaacuuaagcaccuccuaaugcgaccagacgaaauaagcaagcacgcaaccgacuucaucaacagacagcuagucgagacucgccaaguuauaaagcuagucgaagaacuaauuagcagcgaguaccccgcagccucaaucgucgcuguaaaagcgaaucugacccaccaauuucgccagaccuucaauuuccccaaacugcgagaaguuaacgacuaucaccacgcauuugaugcaucucucaccgcauucaucgguauguaccuuuugaaacaauaccccaagcucgaacgcuucuuuguauauggaaaguucgcaaaacaacccaucaaccucacacgauucaacaucauccgaaaacuugccguagcagaaaagccaauagcaaauauagaaaccggcgagauccuaugggacaaaaccgcagacauaaaauacuucgagaaacucuauaacuacaaacgccugcucgucacacacgaaguucgcgagaacuacggcgccauguucaaacagacgcuguucaaagcaagcuacaauaaaagcaaaacacuuguccccaagaaaaaccacauggagacgagcgucuacggaggguauagcaaccaagagacagcguacuuagccaucguacgcauccccuucaaaucaggguucaaauucauugucgucggaauacccacgcgcaugguagccaaaaucaagcacuaccaaucccucggcgcaacgcuaaaccaggcuacgcacaaggucauagagcccaaauucaccaaaaucucccgcaaaacaaagcaaacgguaauaagcgacuaugagguagugcuccccaaggucuaccucgaccaagucgugcgcgaucaagucaaaggccagauguaccgauucucacugggauccgacaaagaauaccacaacguccaagaacucuacuuaccucuauccauccagcaggcauucguagggcacuacgacgaauccgacgaccaaagauccaacgaccucguuaaagucuacgacgccgcacucaagcaacuucaacgcuacuucccucuacaccucucccggaacuuugaucaaguugcaucccaagcccaccaauccuucgaaggccuaaagaacaauguccagaccuccgacaaacaauuaggcaagaaggaaguccucaauuccuuauucgucggacuccacgccaacgcaacuaggucaaacuuauccguccucggaaugucgaaagacuucggccgaauaaaaucgaacgggaucacacucacggaucaagccgaaaucauuuaccaaagcccuaccggccuuuucgaacgcaaaguggcccuaaaggaucucuga

SEQ ID NO: 6547 - RNA, 4086 nt, Artificial Sequence
  Cas9 variant
auggggaacuauuaucucggccucgacaucggcaccaacucuguuggcugggcagugacagaugagaacuacaacauagaacgcuucaaaaagaaaaacauguggggcauccgacuguucgacgaggcgaaaacagcggagucccgcagaauccaccggcaagcccgucggaugcgccagcgcaaaauccagcgccucaaucuccucauggagcuguucgacgucgaaauuuccaaggucgacgagucguucuucauucgcaagaaagaauccgaccuccacuacgaggacaaaucccaagacagccgguacgcccuguucaacgacaaagaguucaacgauaaagacuaucacaacaaauauccaacgauauuccaccuuauaauggaccucauagagaacgacgaaaagaaggacauucgacuacuguaccuugccugucacuaccucauaaagaaccgcgggcauuucauauucgagggccaaaaauucgacguaaacagcagccucaacaacaacaucaacaaacugaaaucacaccuagaccaguucuacaauaucugucucgacuuugacaacgacaagcugauugagauccuagucaaccaaaaucugaacaucuccgagaaaagcaagaaaauaaaagaacugcuacgcaaaaccaauuuagaagucggcaucgcuaaccucaucgcgggugggucuauaaaacucagcaacauguucgacgacgacgaacucaaaaacuucgacuacaacucacuguccuucaaaaacucgaacuucgacgaaggccgagaauuguuugaagagguccuagaagaccgcuucgagcuagucgaaauccugaaagacauacacgacgccagcguccuggaaacaaugcucuccagugccuccauauccccagacggaggaaaauacaucagcuccaguaugauaaacuccuacaacaaacacaaacgggacuuaaagcugcuaaagaagauuaucaagaaauacaagaaaagcgaauacgauaacaucuucagagacgaaaacaucaagaacaacuaccucucguacacacggacgggcauuaacaagaacaagaaagugcaggcaaaagacaauaccgacagcgacggcuucuacaaauauaucgucaaaauacugaaagacaucaaagagaacgacucagacgaagacaucaaauauauacucucggagaucgacaagaaaaacuuuguuccaaaacaacgcaccaaagagaacagcgugauacccuaccaacuccgcgagaucgaauuacgaaaaaucauugacaaccagucaaaauaccacaaauuccugaacgaaguugacgaaaaggguaucucgguuaaggaaaagaucauagcccuccucaccuucagaaucccauauuacaucggcccacuuaacccauccuacaacgaagaaaagaacuucacaaccucuugggucaaacgccucgcaaaaggcaaaguaaccccauggaacuucgaggacaugguugacaucgacgccagucgcgaggccuucauagagaacaaacugaacaaaugcagcuuccuacuggacgagacaguccucccaaaggacagccuacuguaccaagaauauaugguacuuaaugagcucaacaaccucaagauaaacgggcaaucgaucaauacagaccuaaagaaaucgaucuacgaggaacuauucaaaaaguacaagaaaguuacccgaaaacggcuaaucuccuauauaaaagaaaaagagaacacauccggugacaucguaauuacaggcauagauggggacuuuaaacaaggccugaaaucauacauagcguucaaagagauaauaggcgagaaaaucgauaacgacauauacagaaaagaagucgaaaagaucauacgcgacauuagccucuacggcgaugacaagagcuuuauucaaaagaaaaucaaaaacgaaaacaaacuagaccugagugauaaccagaucagcaaaaucgcaaaacucaaauuuaaagacuggggucgcuuuagcaagaaacugcuagugggcauaaaagccuccgacaaaaacacgggcgagauugauaacaucaucggcuucaugaggaacuacaacuacaacauaaugcaacuaauggcaaacguauucaccuucaaagacgaaauagaaaagcucaauagcaaauacuacaccuacgagaaaaucaacgucgauuaccuagacgaccuauacuuguccgcccccgcaaaacgcaugcuuuggcagagcuuccaaauaguagaugagaucaaaaacauuaaaaacagcgcccccaagaaaauauucaucgaaauggcacggagcaaggaagacaaaccaacgcgcaaaaugagccgcaagagucggcuagagaaauuguauacagacagcaagaaacaauucaucaagcuauuugggcccgacgaauacgacaaacucaacaacgagaucaaaaacaaaucggaaagcgacuucagaugggacaaucuuuaccucuacuacacacaguucggccggugcauguacucucuugacccuauagaccuagaggaacucuccaacaaaaaccuauaugaccaagaccacauuuacccgaaaucuaaaauauacgacgacucaauagagaaccgcguccuggucaaaaagcaacucaaccucgacaagucaaacgaguaccccauccccgaucgggugcuaaacaaggacaagaacaaacuccucgcauucuggaaaaugcugaacgaaaaggaacucaucggcgacaagaaauacgcccgccuaauccggaaaaguccguucacggaugaggaacuaggcgacuuuauagcucgucagcucguagaaacccgacaagccaccaaagaaacugcaaacaugcuacgcagacugugcccggacagcaaaauagucuacgucaaggcuaaaaaugucagcgacuuccgucgcaaauucgacauccuaaaaugccgcuccauaaaugaucuccaccacgcucaugacgcauaccucaacaucgugguaggcaaugucuuugacacgaaauucaccagcaacccccuaaacuucauuaaaaacaacucgaaaaaccggucauacaaucucgagaaaaucuacgauuacgacgugauccguaacgagaaaaucgcguggcucgcagaacgaaaagaagaaaaccaagacggaucuaucgccaccguacucaaaaacuuaagcaagaaugacaucagggugacacggagaacuuacaucaaaugcgaagaccuguucgacgaaaacaucgugcggaaaggaaacggaaaguucccgcugaaagaaaacaacaauaaauccgacacgaacaaauacgggggauacuccggcaucaaaaaugccuauuucguacuacuagaagaugagaaacacaaccggauaaucgaagcgaucccauccuucauauacaagaaagagaaaaacggagaaaaagggagcgucauaaacuaccuccaaaacauacuggggaucaaaucagccaaaauucugcgugacaaaauuaaaauagggucacuacuaaagauagacaaguucccauacaaccucgccgguaaaucgggcaacggaaucuugaucucuggcggaguccagcugauauuggacaaaaacacaucaaaauacaucaagaaaauugaaaacuacaaauacaaacuggacgaaaacaaagacuaccaaauuaacauauuugacaagcucuccaaagaagagaacaucaagcuauucgaccucuucguggauaaauucgagaacucgauauacaaaaacagaguaaacauaaaacucaaagaaauaaaacucgcuagauccaaauucgaacaccuuagcaucgaagaacagaucaagacccugacccaaaugcucauccucuucgggagagaaaacaacgcggucaaccuagaauacaucggccucccgaaaaauacuggcaagaccaagauaaacaagaaaaucaauaauaaagauaucaaaaucaucaaucaaagcaucacgggccuauaugagaccgaagaagaccucgcaaacauauga

SEQ ID NO: 6548 - RNA, 4089 nt, Artificial Sequence
  Cas9 variant
augaagaaaccauacagcauuggacuggacaucggcacaaacucuguuggaugggccguuaucaccgaggacuacaaaguacccgcgaagaaaaugaaaguacugggaaacacaucgcgcgacuuuaucaagaaaaaccuacucggagcccuccucuucgacagcggagaaaccgcugaagcacguagacuuaaacggacagccaggcgaagguauacucgcagacgcaaccgccuucgauaccuccaagagaucuuccuagacgaaaugaacaaacuggacagcggcuucuuccaccgccucgacgauuccuuccuaguacccgaggagaaacgcggcucacgcuacccaauauucggaacccugcaggaagaagucaauuaccacgagaacuucccaacgauauaccaccuccggaagaaacuggccgacucuaaagaaaaagcagaucuccgccuaauauaucuagcccuugcgcacaugaucaaauaccguggucacuuccuuuaugaggaguccuucgacagcaacaacaacagcauacaagagaucuucaaugaguuuaccgcggaguaccacaacaccauagaaggcagcugccuuagugggcagauagaacaggucgaagccauccuaaccgacaaaaucuccaagagcgccaaacgagagcgcauccucaaacuuuucccagcggagaaaucaacuggccucuucagcgaguuccuaaagcucaucguugggaaccaagccgacuucaaaaagcacuucgaccuagaagagaaaaccccgcugcaauucagcaaagacaccuacgaagaagaccucgaaaaccuccuagaacagaucggggaugaguucgcggaccucuuucuacucgccaagaaacuuuaugaugcgacgcuacuggccggaauccucaccgccacagacguaucaacuaaagcgccgcucucggccuccaugaucaaccgauacgaaacucaccagcaggaccuagccgcacuaaagcaauucaucaagaacaaacucccugaaaaauacuccgaagucuuuuccgaccucucuaaagacggcuacgcuggcuacaucaacggaaagacgacucaggaagccuucuacaaauacaucaagaacuuacugauaaaguucgaaggcgccguagacuuccucgagaagaucgagcgcgaagacuuccuucguaagcaaagaacauucgacaacggauccauaccacaccaacuacaccuacaggaaaugaaugcaauacuacgccgccaaggugaccacuacccuuuccucaaagaaaaccgggaaaagaucgaaaagauacucacguuccggauccccuacuacgucggcccgcuagcuagaggaaacagggacuucgccuggcucacgaggaacucugaccaagcaauacggcccuggaauuucgaagaagucguugacaagaccucgagcgcggaggacuucaucaacaagaugacuaacuacgaccucuaccucccagaagagaaaguacucccaaagcacucaauacucuacgaaacauucgcggucuacaacgagcugacaaaaguaaaguucauagcagagggacucagggauuaccaauuccucgacuccggacagaagaaacagaucauaaaccuccuuuucaaagauaaacgcaaagucaccgagaaagacaucauccauuaccuacacacggucgacggguacgacgguaucgaacucaaaggcaucgacaaacaauucaacgcaagccuguccaccuaccacgaucucuugaaaauaauaaaggacaaggacuucauggaugacgcggacaacgaggccauccuggagaauaucguucacacacucacaauauuugaagaccaagaaaugaucaagcaaucgcuggcucaauacgacgccaucuuugaccggaaagucaugaaggcccugaccaggcgacacuacaccggcuggggcgagcucagugcaaaacucauuaacgggauccgggacaaacaaaccggaaagaugauccuggaauaccucaaagacgacggcgaaauaaaucgcaacuucaugcaacucaucaacgacgacucccucagcuucaaagaaacuauucaaaaagcucaaguuauuggcgaaaccgagaauaucaaacaaaucguacaagaacucccggggaguccagcuauuaagaaaggaauccugcagucuaucaaaauuguugacgagcuagucgaaauaauggguuacaacccggaauccauagucguagaaauggcucgagaaaaucaauucaccaaccaaggucgccgaaacagccagcaacgccuaaagaaacucacugacuccauuaauaagcucggcucgagcauccucgaagaacacccagucgacaacucacaacuucagaaugaccgccucuuccucuacuaccuucagaacggcaaggacauguacacuggagaagcccucgagcucuccaaacuaagcuccuaugacguagaccacaucaucccacaagcauucaucaaagacgacagccuggacaacaggguccuugugucauacgcaaagaaccgagggaaaucggacgauguuccaucucucgaaauaguacaaaagagaaaagccuucuggcgccaauugcucgacucccaacuaaucuccgagagaaaauucaacaaccugacaaaggcagaacgcggagggcuaacugaagacgacaaggcgggcuucaucaaacgacaauuaguagaaacccgccagaucacaaagcacguagcccaaauccuagacgcgagguuuaacacggaggugaccgaaaaaggaaagaagaaacgagcagucaaaauuauuacccucaaaucaaacuuaguaaguaacuuccgaaaagauuucgagcucuacaaaguaagagagaucaacgacuaccaccacgcacacgaugccuaccucaacgcgguagugggaacggcacuucucaagaaauacccuaaacuagaacccgaguucguguacggagacuaccccaaauacaauucauaccgggaaagaaaaaccgccacagaaaaagucuacuucuacaguaauaucaugaacuucuucaaaaccacaguaaaauuggccgacggcagcgagaagaaaaggcaccaaauugagacaaacgaggaaacgggggaaauaguaugggacaaaacuaaacacuucgagaucguacgaaaaguccucagcuacccccaggucaauaucgugaagaaaacagaagaacaaacuguaggacagaacggagggcuuuucgacaauaauaucgucuccaaaaacaaaguaguagacgcuucaaaacugaucccuaucaaaagcggacugucuccagaaaaauacggaggcuacgcgcgucccaccauagccuacuccguccuaguaauagcagacaucgaaaagggcaaggccaagaaacugaaacgaauaaaagagaugguaggcaucacaauacaagacaaaaagaaauucgaggcaaacccgaucgcauaccuagaagaaugcggguucaaaaacauaaacuccaaccacauaaucaaacugccgaaauauucacucuucgaauuugacgacggucaaagacgccuacuggcuagcucgauagagcuacaaaagggaaacgaacucauccugcccuaccacuuaacagcccuccuauaccacgcgcaacgcaucaacaagauuuccgaacccauccacaagcaauaugucgaggcucaccaaaacgaguucgaagaacuccugacgaccauuauuucacucagcaagaaguacauucaaaaaccaaacguagaaucgcuccuccagcaagccuucgaccaaaccgacgaagacauauaucaacuauccgaauccuucauaucacuccucaaacuuaucuccuuuggggcgccaggcgccuucaaauuccucggggucgacauaucccaauccaacguccgauaccaaucggucagcuccugcuucaacgccacccuaauacaccagucuaucaccggucucuacgaaaccagaaucgaucuaucaaaacuaggcgaggacuga

SEQ ID NO: 6549 - RNA, 4089 nt, Artificial Sequence
  Cas9 variant
augaacgagccauacggugucggccuugacaucggcaccaacucuguugguuggacagucguagacaugaacggucgcguaagaaaaguaaagggaaaaaccgcgcucggggcacgguuauucaaagagggcgccaccgcagaagaccgccgaggcuuuagaaccaccagacgccgacuaaaacgggucaaauggcgacuacgccuccugcgcgaauuuuucgaccagccaaucuccaaaauagacccaaacuucuucgccagacgcaaguauagugacaucucgccccgagaccccaacuacaacggccuugcgaagacacucuucaacgaucgcacagacaaagaguucuacgacgauuacgcuacgaucuaccacuugcgagacaaacucaugacguccaaccgcaaauucgacauaagagagauauaccuugcaauccaccauaucguuaaauacagaggcaacuuccuucgaaccggccccgccagccaauauggcuccgcaucacuccaccucgcgaccagcuuccagaaauuaaaugaucucuucgcccaauccgaagaaacccuaaaccuaaaacuggugacagacgaggcguuacuccagcagauccaacaaauacucguucguaccgaccucagcagauccgaacagcaacgccagauauggccacucauggcaguacucaccggggcgagcgccgcggagaagaaaaggcagaaaaauguagucguugaacucucaaaagcgcucgucggacuaaaagcaaaaaugaacgucguaacguuaacagaaguggacgcagcaguaguaaaagacuggacauucacgauggaagaaagccaagacaaacugccggaaaucgaggaacagcucagcgagguaggccagcaaaucauggacgaagucauucaacucuaugccuccguaaaccucgcucaacucauccccgccggcaagagauucagccaacacaugguagagaaauacaaacaccacgagaaaaaccucgaacuccuaaaaacauacauacacagccaguccgacagcaaacgcggaagagaaauccgcgccaccuacgaccgauacaucgauggggucgacucgaaaccggugacucaggaaauguucuauaaggaccucaugaaguacguagaggcagacgccaccagcaaccaccucgcagccgagauaaaagacgaaaucgacucggaacaauucaugcccaagcugcguacgaaacaaaacggcucaauaccguaccagguccagcaauacgagcuagaccagauaauaagccaucaaaagaaguacuaccccuggcuaggagaggaaaacccggucgcagagcgacgaggcaaauuccccuacaaacuagacgaguugguugguuuccgagugcccuacuacguaggaccacuaaucaccaaagaagaccaacaagcaacaucgggagcaggcuucgcguggaugguaagaaaagcagacggcccaaucacacccuggaacuucgaccaaaaagucgaucgaaucgccagcgcaacugcauucauucagagaaugcaaacgaccgacacauaccugauuggggaagacguccuccccgcacgcucgcuaaucuaccagcgcuucaugguccuaaaugaacucaacaacaugagaguggaagaccgcaagcuggccccacaacaaaaacaacgccucuacaaucaagucuucaaacaacaucaacacgucuccguuaagaacauccaacaaaaucucauggacgcaggagaguaccgggaagcacccaagauaacugggcucgcggauccaaaaggguucaacucuucgcuaagcacguaccacgacuucaagaaaaucuuacccgaagccauagcggacgaacauaagagggccgauauagagaaaaucauccucugguccacaacguucgaagacagcgccaucuucaaacaaaaacuugaggaggucgccuggcucaccgacgcccaacggaaacaacucagcggccuaagguaccguggaugggggcaacucagccacaaacucuugaucgccuuuaaagacgacaacggacgcuccaucauggacggccuaugggaaacuucagacaauuuuaugcaacucagaaaacagcccgcaauagagacacaaauaaaggaagcgaaccaagcaaaccuaacggacgcagacauacaagauacaauaaaugaacucuacaccucaccccaaaacaaaaaggcgauccgagaaguaaugcuaguccucgacgacauaaagaacgcaaugcacgggcaaacccccuccuggaucuucguagaagcggccagagggggaggcgucgcuggccguagaacccaauccagauccagccaaauagucgaagcauacaaaggcacggcaaaggagaucgugucagagaaaguccagcacgaacuaaacgagaaaaucaaagcuaaggcggauuucaacacgcgccugguacuauacuuccuacagaacgggagagaccucuauacaaacgaagccauaaacaucgacagacuaagcgaauacgacauagaccacauccugccgcaaagccuaguaaaagacgacucacuagacaaccgaguccuaacaucugcacggaucaaccgagagaaaaacgauaccuuugccagcgaaaaauucggccgcaagaugggagcacaauggcgagaauugcauagaaacggucuuaugacccaacgaaaacuaaaacaccuacucaugcgacccgacgaaaucagcaaacacgcgaccgacuucauuaauagacaguuaguagaaacacgccaagugauaaaacuggucgaggaacugauaucauccgaauaccccgccgcaucuaucgucgccgucaaagcaaacuuaacacaccaguuccgacagaccuucaacuucccaaaacuccgcgaaguaaacgacuaccaccacgcauucgacgccucccuaacagccuucauuggcauguaccuccucaagcaauacccuaaacucgaacgauucuucgucuacggcaaauuugccaaacaaccaauaaaccugacccguuucaauaucauaagaaagcucgcggucgccgaaaagccgaucgccaacaucgaaacuggagaaauccuaugggacaaaacagcugacauuaaguacuucgaaaaguuauacaacuacaaacgacuucucgucacacaugagguccgagaaaacuacggcgcaauguucaagcaaacacucuucaaggcuucagacaacaaaucuaaaacacucguccccaaaaagaaccauauggaaacauccguguacggcggcuacucaaaccaagaaacagcauaccuagcgaucguccgcauacccuucaaauccggcuuuaaauuuaucgucgucggcauacccacgaggauggucgcaaaaauaaaacacuaccagagccuuggcgccacccuaaaacaagccacgcacaaagucaucgaaccgaaauucaccaaaaucagccgcaagaccaaacaaaccgugaucagcgacuacgaggucguacugccgaagguauacuuagaucaagucgugagggaucaggucaaaggccagauguaccgcuucuccuuggggagcgacaaggaauaccauaacguccaagaacucuaccucccgcucagcauacagcaagcauucgucggacauuacgacgagucagacgaccaaagaucaaacgaccuaguuaaaguauacgaugccgcccuaaaacagcuccagcgauacuucccacuacaccuaucccguaacuucgaccaaguagcaaaucaagcgcaccagaguuucgagggacucaaaaacaacguccagaaaucagacaagcaacugggcaagaaagaaguacucaacagucucuucguagggcuacacgcaacggcuacccgaagcaaccuaagcguacugggaaugucaaaggacuucggaagacuacagucccgaucagguaucacccuaacggaccaagcagaaaucaucuaucaaucccccacaggauuauucgaacgaaaaguggcccuaaaagaccucuga

SEQ ID NO: 6550 - RNA, 4089 nt, Artificial Sequence
  Cas9 variant
augaccaagcucggcaaaccauacggcauaggggucgacauaggcagcaacucgauaggauucgcggcugucgacgaaaacucacaccucauacgacugaaaggcaaaacugucaucggcgccaggcuauucgaggaagggaaagcugccgccaaacgccgcgccggacguaccacacgacgccgucucucgcgcaaccgguggcgccugucauuccugagagacuucuuugagucacacauaacuccaaccgacccaaacuucuucaugaggcagaaguacagcgagauaucuccgaaagacaaagcccgauauaaauaugagaaacgccuuuucaacgacagaacagacgcagaguucuaccaacaauacaguaccauguaucaccuccgaaacagacuuaugaccgaucccagcagagcugacgugcgagaaaucuacuucgcuauccaccacauacucaagucccgugggcauuuccuaacccccggcgacgccaaagacuucaauacaaacgacguagccuuggacgaaauauucccagcgcuccaggacgccuacgcgcaaguauacccagaccucgggauaacuuuugacgaagacaaagcgaacgaauuuaaaacuauacuacuaaacgaaaucgcaaccagcaucgacacacaaagagcccuaguaaaacuucugcuagcggaagaagacgacaaagacauacucaaacaacaaaaacaaguccucacggaguucgcaaaggccgucgucggacuaaaaacaaaacuuaacuuagcgcugggcacugaagucgacagcucagaagcaacugcauggaacuucagcuuagggcaacuagacgauaaaugggcggguauagaauccgcuaugacagacgaaggcacugaaauacuugaucaaaucagggaccuauacagagcccgguugcucaacggcauagucccaaccgguaagacgcucucccaagcaaaaguggacgacuauacccagcaccacgaagaccuccaacuauucaaagcauaccucaaacagcucgaagacgacggaaccgcaaaagccauccgccagcucuacgauagguacaucgacggcgacgacgccgcgccguuccuccgggaaaacuucgucaaagcucucaccaaggacgucacugcccacccaaacacgaaaucacccgaacuacuagaacgccuagcccaaccggauuuuaugcugaaacaacgcaacaaagcgaacggcgccauccccguccaaaugcaacaaagagagcucgaccagaucaucaaaaaccaagcgguauacuacgacuggcucgcagcaccaaacccagucgaaaaacauagaaaguccaugcccuaccaacuggacgaauuacucaacuuccgaauacccuacuaugucgggccgcuugugacggcaaaagaacaaaaggcugcccaaggagggguauucgcauggauggucagaaaagaucccgaaggaaacaucacccccuacaacuuugaugagaaagucgaccgcgaagccuccgcgaacaccuucauccagcggaugaagaccaccgacaccuaucuaaucggggaggacguccuacccaaacagucccuacucuaccaacgauacgaagugcucaacgaacuaaauaacguacgggucaacaacgaaaaacuuagcaucgaacaaaagcaacaaguaauccgggagcuguucgaaagacacaauuccgugacaauaaaacaguucgcagaaaaucuccgcgcacacggugacuacgcccacaucccagaaauacgcggacucgccgacgaaaagagguuucucagcagccugucgacauaccgccaacucaaaucccuacuccccgaggccaucgacgauccggcaaaacaagccgacauagaaaacaucauagccuggucaaccgucuucgaagaugccgcgauauucaaaacgaaauuaaaagaaaucucauggcucggcucagaagcgauaaccaaacuuuccaacauucgguaccgcggcuggggucaauucagccgaaaguuccucaacggacucacccucggcaacggccacacuaucauucaagaacugcuguugucgaccaacaaccuaaugcagauucucacugacgaaacgcuacaaaagaaaaugaccgaacucaacgcggacaaguuaaaaacugccaacaucaaugacgcgaucgacaacgcauacacaagcccauccaacaagaaagcacuccgccaaguacuccgggucguagacgacaucaagcgcgcagccgacggccaggaccccuccuggcuauacguggagacagccgauggcggcgggaccccaggaaagcgcacuagagcacgacaacaccagcuccaggaaaucuaugcgaaugccgcacacgagcucaucgacaccgccguccguggagaacucgaagacaaaauuagcgacaaggcggacuuuaaugaucgucugguccuuuacuucaugcaaggcgggcgcgacaucuacacaggcgcuccacuaaauauagaccaacucagcuccuacgacauugaccacauccugccccaaucccuaauaaaagacaacucauuagacaaccguguccucguccacgcaaucauaaaccgggagaaaaacgcaaccuuugccuccaccaucuacgcccagaaaaugaacgcuacguggagacaauggcacgaagcgggacuaaucucaggccgaaagcugcgcaaucuccaaaugcgcccagaccaaauagacaaauacgccuccggauucguugcccgccaacucguugaaacccgccagaucaucaaauuaacagagcaaaucgucgccgcccaauaccccgauacaaagauaauagccgugaaggccggacucucccaucaguugcgugaagaacuagaguucccaaagaacagggacgucaaccacuaccaccaugccuuugaugcguuccuggcagcacgcaucggaacauaccugcucaaacguuuuccgaaccuccaagcguuuuucacguacggcaaauuuaccaaagccgacguaaagaagcuaagaggauucaacuucauacgcgacaucacgcacgccgaagacaaaauaguggcaaaagacacuggggaggucguaugggacaaacaaagagacgucgaugaacucgaccgcauauacaacuuuaaaagaaugcuaauaacucacgaaguccgcuucgaaacagccgaccuauucaagcaaaccgucuacggagcccgcgacaguaaagaagccggaggcagcaagcaacucauaccaaagaaaaaggguuauccagucgacaucuacggaggcuauuuccgggaaaauaccgcguaccucgcaguuguaaaggucacaaagaaaaccgaaacaauuuucaaaguuguaaagauagcgaccucacaagucgcggcccucaacaaggcccgcagccggagcacagccgaagaacuaucggugcucaccgaacuauuaaagccuaaauuuuccaaggucggcaaaaacggaaagaucacagacaccccauucgaagucguacucccacgagugccucgagaacaacuguucuacaacgccaaauacggcuuuuucaugguaaacucagacacaauguuccauaacuuccaagagauauggguaucccgcagcgaccagaaaauacuccaacagauucgaaaagcaaaaaucgacuacccaaacgucgaccaggaccuugacaaccuauuccacaaccucgccgaccaaauaguuaaguauuucgaucucuacuccaucgcaggcuucaaggagaaaauaagccaaucccaaaacacauucaacgacuuagccguugacgauaccgaccagucgguaggcaaaaucacaguaauaaacgaacuacucaaaggagcccaggccaacgggaugacuggcucccuuaagguccucaaaauauccaccccauucggguuuacacaggacaaaagcggaguccucaccaaggacagcuccaucaucuaccaauccccaacuggccuauucgaacguuccgucaggcucaccgaccuauga

SEQ ID NO: 6551 - RNA, 4089 nt, Artificial Sequence
  Cas9 variant
augaccaaguuaggaaaacccuacgguaucggggucgacaucggcagcaacucaauagguuucgccgcagucgacgaaaacucacaccucauucgccucaaaggaaaaaccguaaucggagcccgccucuucgaagaagggaaagcagccgccaagcgccgggcggggcguacgacgcgccgaagacuaucccgaaacagguggcgccuauccuuccuccgcgacuucuucgaaucacacauaacucccacggaccccaacuucuucaugcgucaaaaauacucagaaaucuccccgaaagacaaggcccgauacaaguaugagaaacggcucuuuaacgacagaacagacgccgaauuuuaucaacaauacucaaccauguaccaccuacgaaaccggcuaaugacagacccaucacgcgccgacguccgagaaauauauuucgcaauccaccacauccucaaaucacgcggccauuuccugacccccggcgaugcuaaagacuucaacacaaacgacguagcuuuggaugaaaucuuucccgcccuccaagacgccuacgcacaagucuacccggaccucggcauaaccuucgacgaagacaaggaaaaugaguucaagaccauccuccugaacgagauagccaccuccaucgacacccaaagggcucucguaaaacuacuacuggccgaggaggacgauaaagacauacuaaaacagcaaaaacaaguacuaaccgaguucgcgaaagcagucguaggccucaagaccaaacugaaucuggcccuaggcaccgaaguagacaguucagaagcaaccgccuggaacuucagccucggccagcuagacgacaaaugggccgggaucgaaucagccaugacagacgaagguacagaaauccucgaccaaaucagggaccuauacagagcacgacuccuuaacggaaucgucccaaccggcaaaacacuaucacaagccaaaguagacgacuacacgcaacaccacgaagaucuccaacucuuuaaggcuuacuuaaaacaacuagaagacgacgguaccgccaaagccaucagacaacuuuacgacagguacaucgacggcgacgacgcggccccauucuuacgagaaaauuucgucaaggcacucacuaaagacgucaccgcacauccaaauaccaagagcccagaacuacucgaaaggcucgcgcaacccgauuucaugcucaaacagcgcaacaaagccaacggcgccauucccguccaaaugcaacagcgagagcuggaucaaaucaucaaaaaccaagcaguguacuacgacuggcucgccgcccccaaccccguagaaaaacacagaaaaucaaugccauaccagcuugacgaacugcuaaacuuccgcaucccauacuauguagguccccuugucaccgcgaaagaacaaaaagccgcucaaggagggguauucgcauggauggucagaaaagauccagagggcaacaucaccccauauaauuucgacgaaaaaguagacagagaggcuagcgccaacacuuuuauccagagaaugaaaacaaccgacaccuacuuaaucggcgaggacgugcugcccaagcaaucguuacuguaucagcgguacgaagugcuaaacgaacucaacaacgucaggguaaacaacgaaaaacuaagcauagaacaaaaacaacagguaaucagagaacucuucgagcgacacaacuccgucacuauaaaacaguucgcggaaaaucuccgugcccacggcgauuaugcgcacauacccgagauaagaggacuugccgacgagaaacgguuccucagcucacuuagcacauaccgucaacugaaaagccuucuacccgaagccaucgacgaccccgccaaacaagcugacaucgaaaacaucaucgccuggucaacaguauucgaggacgccgccaucuucaaaacaaaacuaaaggagaucuccuggcuaggauccgaagccaucacgaaacuaagcaauauacgcuaccguggcuggggccaauucucgcgaaaguuccugaacgggcuaacucucggcaacgggcauacuauaauccaagaacuccuccugucaaccaacaaccucaugcaaauccucacagacgaaacgcuccagaagaaaaugaccgagcucaaugccgacaaacuaaagacagccaacauaaacgacgcgaucgauaacgccuacaccaguccaucaaacaagaaagcccuacgccagguccucagagugguagacgacauuaagcgcgcggccgacggacaggaccccucauggcuauacguugaaacugcagauggaggcggcacgccgggcaaacgcacccgugcccgucaacaccaacuccaggaaaucuacgcaaacgcagcucaugaauuaaucgacaccgcggucagaggugaacucgaagacaaaaucagcgacaaagcggauuucaacgacaggcugguauuauacuucaugcaaggcggacgggacaucuauacaggagcgccccucaacaucgaccaacucuccagcuacgauaucgaccacauccucccccaaagccuaauaaaagacaacucccuggacaacaggguccucgugcacgcgaucaucaaccgcgagaaaaacgcgacguucgcaaguaccauauacgcgcagaaaaugaaugccacuuggcgccaguggcacgaagccggucucauauccgguaggaaacuccgcaaccuccaaaugcgcccggaccaaauagacaaauacgcaaguggcuucguagcacgacaacuuguagaaacccgccaaauuaucaaacucacagaacagaucguagcugcccaguacccggacacaaagauaauagcagucaaagcugggcuaucccaccagcuccgcgaagaacucgaguuucccaagaauagggaugugaaccacuaccaccacgcauucgacgcguuccucgccgcccgcauuggcacauaccucuuaaaacgauuuccgaaccuccaagcguucuucacguauggcaaauucacaaaggccgacgucaaaaagcuacgcggauucaacuucauccgagacaucacccacgcggaggacaagauaguugcaaaagacaccggcgaggucgucugggacaaacaacgcgaugucgacgagcuagaccgaauuuacaacuucaaacggaugcuaauaacgcaugaaguacgauuugagaccgcugaucuauuuaaacagaccgucuacggagcacgggacagcaaggaagcuggcgguucaaagcagcuaauucccaagaaaaagggcuaccccguagacaucuacggaggcuacuuccgcgagaacacggccuaccuggcaguagucaaaguaacaaagaagacagagacaauauuuaagguaguaaagauagcaacgucccaaguagccgccuuaaacaaagcgagaucaagaucaaccgccgaggaacuuucagugcugacagaacuccugaaacccaaauuuuccaaagucggaaagaacggaaaaaucaccgacaccccuuuugaaguggugcucccacgagucccccgcgaacaacuguucuacaacgccaaguacggcuucuucaugguaaacucagacacaauguuucauaacuuccaggaaauauggguaagccgcuccgaccagaaaauucuccaacagauccgcaaagccaaaauagacuacccaaacgucgaccaagaccuugacaaccucuuccacaaccucgccgaccagaucgugaaauacuuugaucuguacagcaucgcaggauucaaagagaagauaucccaaucacaaaacaccuucaacgaccuagcgguagacgacacagaccagucugugggaaaaauaaccgugaucaacgaacuacucaaaggcgcccaagcaaacggaaugacgggaucucucaaagucuugaagaucagcacaccauucggauucacacaagauaaguccggaguccuuacaaaagacuccuccaucaucuaccaaagcccaacaggccuauuugaacgauccguacgccucacagaccucuga

SEQ ID NO: 6552 - RNA, 4089 nt, Artificial Sequence
  Cas9 variant
augacaaaacucgggaaaccauauggcauaggcgucgacauagggucaaauuccauaggcuucgccgcuguagacgaaaacagccaccucauacgccuuaaaggaaagacagucaucggagcgcgauuauuugaagaaggaaaagcagccgcugaccggagagcaagccgaaccacaagacgcagacuuagccggaauagguggcgccucuccuuccucagagacuucuucgaaucacacaucacccccacagacccgaacuucuuuaugcgacaaaaauacagcgagauaagcccuaaagacaaaagccgauacaaauacgaaaagcgacucuucaacgaccguacugacgccgaguucuauaaauacgaaaacugcccuacgauguaccaccuccgcaaccgauuaaugacagaucccucaaaagccgauguacgcgaaauauacuucgcuauacaucauauacuaaaaucccgcggccacuuccuuacacccggcgacgcaaaagacuucaacacaaauaaaguugccgucaacaaaauauuucccgcgcugcaagacgccuaugcccaagucuaccccgaucuagauauaaccuuugacgaaaacaagguaaacgaauuuaaaacaguacuucuaaacgaaaaagccaccccaucggacacacaacgcgccuuaguaaaccuucuccuagccaaggaaggugaccgugauauacugaaacaacaaaaacaagcccucacagaguucgcaaaggccguaguuggacugaaaacaaagcuaaacgucgcccuugggaccgaaguggacuccuccgaagccaccgccuggaacuucucauuagggcaacucgacgauaaauggaccggcauagaauccgcuaugacggacgagggaacagaaauacuugaccagauccgggaccuauaccgagcacgacuacucaacggcaucguaccggcaggcaaaacacuaucccaagcgaaagucgaugacuacgcgcagcaccacgaagaccucgaacucuucaaagacuaccucaaacagcuggaagacgacggcacagccaaggccauuaggcaauuguacgaccgguauaucgacggggacgacgccaaacccuucguacgagaagacuucgucaaggcgcucacaaaagaagucacggcacaucccaacgcgaaaagcccugaauuacuagaaagacuagcccaacccgacuuuaugcugaagcaacggaacaaagcaaacggcgccauacccguacaaaugcaacagcgcgaauuagaccagauuaucaaaaaccaaagcguauacuacgacuggcucgcggccccgaacccgguagagaaacaccgcaagucaaugcccuaccaacuagacgaacuucuaaauuucagaauaccauacuacgucggcccccuuguaaccgccaaagagcagaaggccgcccaagguggaguauucgccuggauggucagaaaagaccccgacggcaacaucacgccguacaauuucgacgaaaaagucgaucgcgaggccuccgcuaacacauuuauucagcgaaugaaaacgaccgacacauaccucaucggagaagacgugcugcccaaacaaucacuacuuuaccaaucuuacgaaguacucaacgagcuuaacaauguucgaguaaacgacaacaaauuauccuucgaccaaaaacagcaaguccugggugaacucuucgagaggcacaacacuguuaccaucaagcaauucgucgacaaccuccuugcccacggugacuaugaccgcaucccagaaguacgaggccuagcggaugagaaaagguuccucuccagccuaagcacauacaaccagcucaaaggcauccuacacgaagcaauagacgacagcgacaaacaaacagacauagaaaacauuaucgcguggagcacaauauucgaagacaaggcuaucuucaaaacgaaacucaacgagaucucguggcuaaacgccgggaugauaaacagccuagccaacauacgguacagaggcuggggacaguuuucccacaaacuacucaacgaacuaacacucucaacgggaagaaccgucuucgaggaacugcuuaucucaucucacaaccuaaugcaaauccucacagacgaaguacucaaacagaaaauagcagagcucaacgcccacgaacucaaagccuccggaaucuacgccgcaauagacgacgcuuacacaucccccucgaacaagaaggcccuacgccaaguacuauccguaauagacgacaucacgaaugccgcgggacaagcaccgaacuggcucuacaucgagacggcagacggcgauggcguccccggcaagagaaccaauagccgucagcgcaaaauucaagaaaucuacgccaacgcugcccaagagcugaucacaggcucgguacgcggggaacuagaggacaaaauagcaucaagagcagacuucaccgaccgacugguucucuacuuuaugcagggcggacgggacaucuacaccggaaaaccccuaaacauagacaaccucucauccuacgacauugaucacauucucccccagucacuaaucaaagacaauucgcuggacaaccgcguccucguacacccccugguaaaucgagaaaaagacacuauauucgcaagcacacgcuucgccaaacaaaugaauggaauguggagacaauggcacgcggcagggcucauaucuucccgcaaacuccgcaaccuccaaaugagacccgacgaaaucgacaaauacgccagcggguucguggcgcgucaacugguagaaacaagacagauaaucaagcuaacagaacaaaucguggcggaccaauauccagacaccaagauaaucgcagucaaagcaggacugagcucccaacuaagaaaagagcuggacuuccccaagaaccgagaagugaaccacuaucaccacgccuucgacgcauuccuggcagcacgcauaggcacuuaccuccugaaaagguacccaaaccucgaacccuucuucaccuauggaaaauucaagaaaacugaagucaagaaacuaaagagcuucaacuucauccgagacaugacccaugcuaaagacaaaauugucgccaaagagacaggcgagaucgucugggacaacgcguccgauauaaacgagcuagaccggauauacaacuuuaagaggaugcucaucacacacgaaguccgauucgaaacagccucacucuucaaacaaacgcucuacgcggcgaaaaacuccaaaaacaggggcgggagccgacagcucauccccaaaaagaagggguaccucguugacauauacgggggcuacacacaggagaccgggagcuaccucucgguaguacgccugacgaagaaagcaauguacgccguugucaaagucucgacccgugacgcggcaaaacucgccguagcgaaaucaauaagcgaacaaaaggaaaaugagacacuaaagaaaauuauugacggaaaacucucaaaaaccuccaagaaaggcaaaaccacgcaccaacucuucgaaaucguccucccacgaguaggccagaaaacccuuuucaaaaauucuaaauacaaccaguuccucguaaacucagacacauacaugcacaacuaucaagaacucuggaugccacgugaauaccagcgcauguggaaagacauccuucuauccaaccacggcgacgcacaauuagaaggacaacuagaccaaaucuucaaauucaucgucagccaggucaacuccuauuucaaccuauacgacaucaaccaguuccgaaagaaaauagccgacgcgacagacaaauucgcaaaacucccaacacacgauacggacaacgcacgagggaaaauugccacaaucggccagcugcucaucggcuugcaagcaaaugccaugcguuccgaccuacgcaaucucgacaucaaaacaccauucggacuacuccagaucggaaccggaaucacauuagaccuagacaccucuauaauauaucaaagccccacuggacuauuugaacgcgagguuccacuuacagaucuauga

SEQ ID NO: 6553 - RNA, 4089 nt, Artificial Sequence
  Cas9 variant
augaaccaagaacccuacgcaauagggcucgauauagggacauccucccuggggugggccaacgcugacauggacggcuacaucgccagagucaaaggccagacaggacuugggguccgacucuucgaagaaggacaaccugccgcagaccggcgcagcuuucggaccacacguagacgccuaucacgcaggcgguggcgccuccgauugcugagagaaauauucgacgaacccaucucuagcaucgacccuaacuucuucgcccgacaaaaagcaucgucaaucagcccaaaggacgaccgguuugaaaccaccuaccaacuauucaacgacaaaaccgaucaagaguucuacagcaaauacccgaccauauaccacuuaagaugggcucuaaugaccgaacaccgcaaauucgauuugcgagaaauauaccuggcggugcaccacauaguaaaguacagaggaaacuuccuccggucaggcaacccuaaaucguucaaaccuagcgaacuagacuucucccagcgcuucaaggaggucaacgggcuauggcaucucauauucgacgaagucgcaccccagcuccccaccgacaaccuggaggagauuacuaaacuuguccucgacacgacccgcacccgagccgaccgccaacgcgaauccguaaaauugcuaauggcagcaacagauaaccacaaagauuggaaaccauaucuaacagaauuuaccaaagcuauccuaggccucaaaacgaaguuauaccugcugacggggguagaugucgcgaaagccgaccagaaaacauggacauucucgcuggaagacauagaagaccaccgggccgaccucgagacagccuuugacgaccgcucacucgaacuuaucgaaaagcucguagaucuccaagccgccauacagcugaccgagauaaugccaucaggacaguacuucucacaaaguaugauuuacagauaugaccaacacaaagaacaccuacgauggcucaaagauuacgccgagcaacaaacagacgcaaauaagaggaaagccgugcggcuggcguacgaccacuacauugaaggagacgccaaagguaaacccgaaauagccgaugacuucuacaaagagcucaacagaauccuaaaaggcgauacaagcgaauuagccaagaaaauuaaccacgaaaucgcccuagaacauuucaugccaaagcaaaggaccaaagagaacggcgucauucccuaccaaauccaccaacaagaacucgacucgaucaucgacaaccagaaaaaguacuaccaauuccuuggcgaggacaacccggucgucucccaccaugggagccaaccguacaagaucgacgaacucgucucauuccgcguacccuacuacgugggccccaugaucacagcagaccaacaaaagaaaaccgcggccggucaauucgcauggauggugagaaaagacuccggcgacaucacccccuggaacuucgacgacaaaguagaucgaacagccuccgcuaccaacuucauucaacgaaugaagacaaccgacaccuaccuuaucggggaagacguucuaccgcuccaaucgcucaccuaccaaaaauucauggugcuaaacgaguuaaacaacauucguauaaacggcgaacuccucacccgagaacaaaaacaacgcacuuauaaugacguguucaaaggucauggaaccgucaaugucaagagucuaaucaaaagccuugagugccacuccgaaguaacgggcgcgauuaaagucgaaggucuagcagacccaaaaagauucaacagcgcucucacaaccuaccgugacuucaaaaagauccuucccguagccaucgaccaaccccaacgccaagccgacaucgaacgcauuauuaacugguccacgaucuucgaagacgcggacauauucaaagccaaacuccaagaaauagacuggcuaacugacacacagagagauagacucaguacuaaacgguaccgaggcugggggagacuauccgccaagcuccuucucaauauaaaggacacccaaggacuauccaucauggaccaacucuggaacacacaacacaacuucaugcaaauaguccacgaacccgauuacgcagagaaaaucgaaaagacuaacgcaaagggacuaaaacaacaagauauuuucgaaaccaucaaugaaauguacaccuccccacaaaacaagaaagccuuacgccagauacuugcuguaguccgugacauacagaaagcgcaccacggccaagccccaucgagaauauucaucgaagcagcgagaggagccgaacaaaacccccagaggacacgacaacgccagaaacaacuagcagaucucuucgcugaucaagcgaaagaaauaguaaacgaaacagucgcacaggagcuaaaugacgaaaccgacaacaaagcacgauuuacagaccggcucaugcuauacuuccuacaaaacgggcaagacauguacacgggcgagaaacuuaacauagauaaacucucaaccuacgauaucgaccacaucuugccccaaucauuagucaaggacgacucccuugauaaccgagugcuaguaucaaaaguagaaaaccuaaagaaaaacgaccacuucgccucagaacuuuacgcacgcaaaaugcaaggcacaugggagcucuggcgcucggcagggcuaauaucggcacggaaacuaaaacaucugcucaugcgccccgacgaaaucaacaaauacgccacagguuucauccgccgccaacugguagaaacccgucaggucaucaaacuggucacagauguucuaucgaacgaguacgacucagauaaaacgaaaauaaucuccgucaaggcaggccuuucccaccagcuacgcauggagcuugauuugccaaagguucgggaacucaacgacuaccaccaugccuucgacgccuuccuagccguccgaaucggaacauacuuacuuaaaagauauccaaaacucgaacgguucuucgucuauggccaauaccaaguggccccacagcuagaucuaagacgcuucaacuucauccacgaucuagucagcggcaagcaagagaagauaguagccgaagagaccggcgaaaucguguggaaccgagaaaaagacguaagcuacaugaaacaucugcucucacucaaacaccuccuagucacucacgaggucaaagaggaccacggggcccucuucaaccagaccauauacaaggcaaagaaagauaacggcaacguuggcggcaaaaugaaacuccuaccaacaaaaagcaaccgcccaacugaaaucuacggcggacacaguucccaagcgaucgccuaucuggcgauuguccgagugaacggcaaagaaccguccuacagggucaugggaguaccaauacggaucuuagaccaguuaaagcaagcaaagaaacagggagaguacgccgaaagacuggcccuuaaacaauucuucaccccggacuucacuaaaggcaaaggcaaaaucgucuccgacuucgauguagucauaccucacaucccacugcuacaacccgucauagacgaaaucuccggccagucacaccgauucgcguuaggaacaaacacauacuacaggaaccuacaacaacugauccucacccucgccgaccagaaaguacucaucagcaaggaaacgggcgucgacgaagaaaagaaacuugucgaaguuuacagucacaucugccaacaagucaugaaauuuuucccgcucuacgaccgcaacaaauuccgcgaacuauuaguagacucacgcucccacuucgaacaacucccaaucguuaacagguacucagacgcuggcaaacuagaaauagcaggaaaacgcggaauccuacaacagaucauggucggccuccacgccaacgccacgccuggcgaucuaaaagagcucggcgucaaaaccccuuucggcaagcuccaaguuccgggcgggaucaaacuuaccgagaacgcaaaacuaauauacgaaagcccaacuggccucuucaaacgggaagugaaaaucacaaccgaauga

SEQ ID NO: 6554 - RNA, 4089 nt, Artificial Sequence
  Cas9 variant
augaagaagaaagcagagaagauauaccugggacucaacguaggaaccaacucaaucggauacgcagucacagacgagcaguaccgccuccuaaaauucaacggcaacgaugccuggggcucgauaguauucgacgcagccucuuccaacgaagaccgccgcaaccaccggcucgccaggcggaaccuugaccgccgccaacaacgcaucguauggcuccaggagaucuucgcgaaggagaucucaaaagucgacgacagauucuucaucagacugucggaauccuuccgcuggcgcgaggacguccaagaccgauacguguucuucaacgacaaagaguacaccgauguacaauacaugaaagaauacccgaccauccaucaccuaaucugcgagcugauggacaacaaaacaccacacgauguccgccucgucuaccuagccugugcuuggcucauaacgcaccggggccauuuccucaacaaucugaacgucgagaaacucgacgagauaauggacuucaguagcguauaucagaacuucauaaacuacuucacagagaacggcuacaaacgcccauggggcgaaaucgacguauccgcccugagugaaguccuaaaacaaaagaccgguaucacggugaaaaauaaagaacuacagaacauccuucuugaggguaagaaacccgagaaaucgggcacagaggaguucccauucucacaagauucaauaauccgguuacuggcaggaggacaaugcaagcuaaaagacguauucugcaaagaagaauaccuggacuuaggguccgucagccucggcauggacgaggagaaauuugacgaaauaagcggauccaucggcgaagacuacgaccuccucaucgcucugcgaggguuauacgacuggagcgugcuagcaaaccuccucaacggccauagugaaaccauauccauggcaaagguccagauguacgaacaacacggaaaagaccuccaaauacuaaaauacuucguccgcaaauacgucccagacaaauacaacgaaguauuccgcaaagccaaagccgacaacuauguugccuacacgggccacauggacaaagauaccgcgucccaaaucaaaaagaaagcaaaagcugaagaguucucgaaauacguccucaaacucaugagccccaucaagcccgaaaagacggaucugcaguccuacgaagacaugugcgaacgcuuaaagcuaaaccgcuuccugcccaagcaaaagaacacagacaaccgaguaaucccccaccagcucuacgaauacgaacuuauucaaauccugaaaaacgcguccgucuaccuaccauuccuaaacgacacaaauaacggcauaucggaagcagacaaaguacucagcgucuuccgguacaaaauacccuacuacgucggcccacugaacgaggaaagcagcuucgccuggauaucgcgaaaacaggguaaaaucacgccguggaacuucaaggaaauggucgaugaagacgcaucggagaacgcguucauuaggcggaugacaaacaaaugcacguacuugccuaccgaagacguccuccccaaagacagccuuugcuaccaaaaguuuaugguccucaacgaaaucaacaaccuccagaucgacggccucaagauuccaguaaaggcaaaacaagggauauaccacgaacuauucgagaaaaauaagaaagugaaacgaaaagacaucgaagaauaucucauccgcaacaacuaccuagacaaagacuccaccgaauuaaucucagggauagacgagcagauccauucaggucucagcagcuacugcgccuuuuucaaccuccuaaauaagaaaauucucagcgaagacgacguugagcguauaaucgagcgcgccuccuacgccgaggacaaaucuagagucauuaaauggcuacgcaaagaguaucccggacucucggaagacgauauacgcuacaucgcacgaauaaaaauacgcgauuucgggcggcuaucaaaaacuuuccucacuggccucaaagggugcgacgucagcaaaggcuucgauggacaggacgucgaaaugaucucaauacuacaaacaaugugggaaacaaacgacaaccucauggagauccucucagacaaauacacauuucucgaagcgcucgaagcguucacccaggaguacuauacagggaaaaagaaaagccucaaagagcgacuggacgaaaugcguguaucaaacucugugcgccgaccaguuuaccgcacacucgcagucgucaaagacauagaaaaagcauucgggaaacccaacaaaaucuucgucgaaaugacuaggggcggccaagcggaucagaaaggcaaacgaaucaaaucgcgcaaacaacaaauucuggaccuauacgacaaaugcaaagacgacguacacgaccugauguggcaacucgaaucccugggcgaguacgccgacagcagacuccagagcgaucgccuguaccucuacuucaugcaauucggcaaaugcgcauacaguggagcacacauaggcuucgagcaacuaauggcaggguccguagaauacgacaucgaccauaucuacccgcaaaguuaugucaaagacgauagccuuaacaacaaaguccugguacuauccgaccuaaauggcaccaaagacaacauauaucccgucucccccgaaaucaggggcaaaaugcaaggacuauggucgugguggaaccaugugggcgccauauccgacgaaaaauauaaacgacuuaucaggagcgccccguucacggaugaggagaaaauggguuucauaaaucgccaacucaccgaaaccucacaguccacgaaauucauagccgaccugcucaaagaacgguucccggacgcggaaguagucuaugucaaagcuggccucguaagcgacuuccgucacgaguucgaccuccccaaaucucgaucguacaacgaccuacacaacgcugccgacgccuuccuaagcguagucgcgggcaacgucuacgacaugcgcuuuagcaagaaaugguuccgaauagacgaaaaauacucagucaaaguaaaaaccaucuucacgcacgaagugaaaugccgcggagauauaauaugggacgguaugccuaugcucgaaaaagucgaggauaccgcucgcaaaaacacugcacauuucgucaaauacgcagcuuucaaaacgggcggccucuucgaccagaacccggucaagaaaggaacaggccuaaucccgcugaaagcagggcuacccaccgaaaaauauggcggcuacaacaaggccgggaucauguuccucauacccguaagauacaacauaggaaagaaaagcgaaauauuaauccuaccggucgaacuaaugcacggaaaacacuuccuagaagacaaaguuuuugcacgcaacuauacauucacacgccuagaaaauauucuaggcaagaaagugggcgaagugucauuucccaugggaaugcgacccuggaaaauaaacaccaugcucuccuucgacggauuccgcgugugccucacgggcaccucaggccgaggcaaaugccuaguagcgcaaccggucaugcaauucagcgcggacgagcacuggagauucuaugucaaacgccuggagagauucguagagaaaaucggcauaaauccagacuuacucuacgacaaggaccacgacaaagucuccaaagacgaaaaccugaaacuuuacgaacucuacguagacaaacuacaaaacaccauauacaagaagagagucaacucacccguccaaacccugcuaaaaggcaaggaagaguucaagaagcucaguaucgaagaacagugccaaguccuccucaacauccaaagcguauucggcaggaugacaggcggcugcgaccuaacccugauagguggcagcgcccacagcgcggcgaccggaagccuuucgacuacaaucagcaauuggaagaagaaguacucaaccguucguaucaucgaccagagcccgagcgggaugugggagaaaucgucagaaaaucugcucgacuucuuauga

SEQ ID NO: 6555 - RNA, 4092 nt, Artificial Sequence
  Cas9 variant
augaccaaacucgguaaaccauacggcauaggcguugacaucggcagcaacuccauaggcuucgcggccguugacgagaacucccauuugauccggcucaaagggaaaacagucaucggggcccgauuguucgaagaggggaaagccgcugccgaucggagagcaucccgcaccacgcgccgcagacugagccgaaaccgcuggcggcuuuccuuccucagggacuuuuucgaaucccacaucacacccaccgacccuaacuucuucaugcgccaaaaauacucagaaaucuccccaaaagauaaagcaagguacaaauacgaaaagcgccucuucaacgacaggaccgacgccgaguucuaccaacaguacccaaccauguaccaccuccgaaacagacuccucaccgacccaucaaaggccgacguaagagaaaucuacuucgcaauucaccacauacuaaaaucccgcggccacuuccucaccagcggguacgccaaagauuucaacacuaacaaagucgcacucaaugaaaucuucccagcccuccaggacgcauacgcucaaguguaucccgaccucgacaucacauucgacgaaaauaaagucaacgaauuuaagaccgugcuucucgaugaaaaagccacaccuuccgacacacaacgagcccuagucaaucuccuacuggcagaagacggcgacaaagacauccucaaacaacaaaaacagguccucaccgaguucgcaaaagccgucgucggacuuaagaugaagcugaacgucgcccucggcacagaagucgacucgucagaagccacggcauggaacuucucacucggacagcuugaugacaagugggcagguauagaaucugccaugaccgacgaagguaccgaaauccuugaccaaauacgcgaccuguaccgcgcccgacuccucaacggaaucguucccgcaggcaagacgcucucgcaagcaaaaguagacgacuacgaacaacaccaugaagaccucgaacucuucaaagauuacuugaaacagcucgaagacgacggcauggcaaagguaauccgucaauuauaugaccgguauaucgacggagacgacgcgaaacccuucguccgcgaagacuucgugaaagcacuaacuaaagaagugacggcgcaccccaaugccaaauccccugaacuccuagaacgccuaguccaacccgacuucaugcuaaaacagcgaaacaaagcgaacggcgccauucccgugcaaaugcagcagcgagaacuagaccaaauaaucaagaaccagagcguuuauuaugacuggcuggccgcacccaaccccgucgaaaaacacaggcagagcaugccauaccaacuggacgaacuacuaaacuuccgcauuccauauuacgucggcccacucgucaccgccaaggaacaaaaggcagcgcaaggcggaguuuucgccuggaugguucgaaaagacccagacggaaacauuacgccguacaacuucgaugaaaaaguugaccgcgaagcauccgcaaauaccuuuauccaaaggaugaaaacaacggacaccuaucuaauuggggaagacgugcugcccaagcaaucccuccucuaccaaagcuacgaaguccuaaacgagcucaacaacguccgcgucaacgacaacaaacuauccuucgaccagaagcagcagguccuaggggaacucuucgaacggcacaauacggucacaauaaaacaguucguagacaaccuacucgcacacggagacuaugacagaauccccgaaguacgcggucucgccgaugagaaaagguuccuuuccucucucuccacguacaaccaacucaaaggaauacuacacgaagccauagacgacuccgacaaacaaaccgacaucgagaaaauaaucgccuggagcacaaucuuugaagacaaagccauauucaaaacgaaacugaacgaaauaucuuggcuaaccgcaggaaugaucaacucccucgccaacaucagauaucgcggcuggggacaauucucccacaaauuacuaaacgaacucacccuguccaccggacgcaccgucuuugaggaacuccugauauccucgcacaaccucaugcaaauccucacagacgaaguacugaaacaaaagaucgcagaacucaacgcgcacgaguuaaaggccucaggcaucuacgccgccauugacgacgccuacacaucaccgucgaauaagaaggcacuacgucaaguacuaucuguaaucgacgacauuacaaaugccgccggccaagccccgaauuggcucuacaucgaaacagcagacggcgacggcguccccggcaaacgcaccaacagccgccaaagaaaaauccaggaaauauacgcaaacgcugcccaagagcucaucaccgggucagugcguggggaacuagaggacaaaauugccagcagggcagacuucacagaccgcuuaguacuauauuucaugcaaggcgggcgagauaucuacacaggugaaccacucaauauagacaaucucucaagcuacgauauagaccacauccucccccagucccugaucaaagacaauucgcuagacaacagaguccugguacacccauuagugaaccgagagaaagacacuaucuucgcgagcacacgauucgccaaacaaaugaaugggauguggagacaguggcacgcggcaggacugauaagcagccgcaaacuccgcaaucuacaaaugcgccccgacgaaaucgauaaauacgccaguggauuugucgcccgccagcuaguggagacgcgccaaauaauaaaacucaccgaacaaauuguagcagaucaauaccccgacgccaagauaaucgcagucaaggcaggacucagcucucaacuacgcaaagaacucgacuucccgaaaaaucgcgaggucaaccauuaccaucacgcauucgacgccuuccucgcagcacgcaucggcaccuaccuccucaagcguuaccccaaccuggaaccauucuucaccuacggaaaguucaagaaaaccgagguaaagaaacuuaaaucucugaaaucuuucaacuucauccgggacaugacacacgccaaagacaaaauuguggccaaagagacaggcgaaauuguaugggacaaugcgagcgacaucaacgaacuagaccgaauauacaacuucaaacguauguuaaucacgcacgaagugcgauucgaaacagcgucacuauucaaacaaacacuauacgcagccaaaaacucuaaaaaccgcggaggaaguagacaacuaauucccaaaaagaaaggcuaccuuguagacauauacggagguuacacccaagaaacaggaucauaccuaagugucguacgacuuacuaagaaagccauguacgccguagucaaagucaguacccgcgacgcagcaaaauuagcuguagcuaaauccaucagugaacagaaagaaaaugagacccugaagaaaauaaucgacggaaaacucucaaaaaccuccaagaaagguaaaaccacacaccaacuguucgagaucguucugccccgaguaggccagaaaacucuguucaaaaacuccaaauacaaccaguuccuggucaacucagacaccuacaugcauaacuaccaagaacuauggaugccaagggaauaucaaaggauguggaaagacauucuacucucaaaccacggcgaugcacagcuagaaggacagcucgaccagaucuucaaauuuauagucucccaaguuaauucauacuucaaccucuaugacaucaaucaauucagaaagaaaauagccgacgccaccgacaaauucgccaaacuccccacucacgacaccgauaacgcccgaggcaaaaucgcuaccauaggucaacuccucaucggauugcaagcaaaugcaaugcgauccgaccuccgcaaccuugacaucaaaacccccuucggucugcuccaaaucggaacaggcaucacccuggaucuugacaccucgaucauauaccaaucccccacaggacuuuucgaaagagaggugccacuaaccgaccucuga

SEQ ID NO: 6556 - RNA, 4092 nt, Artificial Sequence
  Cas9 variant
augcggggcaacuaccauauaggccuggacaucggaaccaguagcauaggaugggccgugauagacgacaacgcgaaagugaugcgcgcgaaaggcaagacugcaaucggcgcaaggcuuuacaacgaaggccagacagccgcagaccggcgacuauuccgcacgacucggaggcgccugaaccgacgcaaauggaggcucaaacuucuugaugaaaucuucgacccauacauaacaccgguugacgcagcuuucuucgcgcgccuaaagcagagcaaccucagucccaaagaccagaacagagacuggaccggauccaugcuuuuccccgaccgaaccgauaggaaguuccacaaagacuacccgacgauauaccaccuccgacacaaacucaugacggaagaccaccaauucgacauccgcgaaauauaucuagccauacaucacaucgucaaauaccgcgggaacuuccuuaacaccacaccagucagcucauuuucaguaucggacgugaaauuugacgaacaauucgacagacucaaugaacucuacgccgccguaucucccgaugaaccauucgcaaucaacggcgacaacuccaaggccauugagacuuuacuccugagcgaugaaacgaagaaauucgacaagcaaaaacagucagcaaagcucauccuaagcgagacaggggacaaggcacuagacaaggaaaacacaaaaguagcgacgcagauaucgaaagcgauacugggcuacaagacccaacuagacguccuacuaaaauacgacgcaauaaauuccuccgccuggaaaaucgaauuagaugacgaaaacaucgaugacacccuaccgggucugcugagucaacuagacgaaaacaggcaagaaauggucucgauaauucaaaaccuauacgcccaaguaacccugaaccaaauugugccaaacgguaugucccuaagcgaaagcaugaucgagaaauauaaugcacacagagaccaccuaaagcuacuaaaacagcuagaagacaaaauagacgacccaaagaaaaagaagggccuagaggccgcauacgacgcauacguaggcaagaacaugaaaguagccaaccaagacguguucuaugccuccguuaagaagaaccucgacgacagcgaccuugcuaaacagauagcagaccucauagaagcccaaaaauucaugcccaaacaacgaaccucgcaaaacggcguaauuccgcaucaacuacaucaacuggaacucgaccaaauaaucgaaaaucaaagcaaauacuacccauggcuaacagcugcaaacccuaacccaaaacgcauacaccaggcgaaguacaaacucgacgagcuaguggcguuccgaauaccuuacuacguuggcccccucguaacacccgaagaacaggaaaaauccgcaaaccaaguauucgccuggaugaaacgaaagcagccaggaacgauaacgccguggaacuuugaucagaaaguagaccgaauggcaucagccaaucgcuucauacgccggaugacuacaaaagacaccuaccucauuggagaagacgucuuacccgacgcgagccucauauacgaacgcuucaagguguuaaacgaacuaaaccuagugaaagcgaacuaccaccgccuggcgccugcccaaaaacaagccgccuaucgcgaccucuucgaaaaccaaaaauccaucagcacaaagaaacuccaaaacuaccuugucgaccagggcuauuucacagcaaaaccuaaaaucacaggauugucagacccugaaagauucaacuccagcuuaggaacauacauagacuucaaagaaauauucggagaccaaguggacaacccagaccgccaagacgacuacgagaaaauaaucgaauggagcaccgucuucgaagaccgccaaaucuacgaagccaagcuacggacacuggacuggcugaccgaagaccaaauacaagcacugaaaacaaaaagauacaacgggugggggcgacuauccaagaaacuacucacgggcaucguagaugaaaacggcgaacgcaucauagacguucuuuggaauaccaaucagaacuucaugcaaguccaaagccaagagagcuucgccaaacgaauccacgaagccaacgcaaaacagaugaaaguaacaggggucgaggauaucuuagcagacgccuacacaucgccgcaaaacaagaaagcaauaagacagguaauacggguuguggacgacauccaaaaagccaugggcggagucgccccaacauccgucuccaucgaguucacccgaagcgaagaucaaaacccacgaagaacacaaagccgugaaucacaacuucaaaacacauucaaaguagacgcaaaggaaaucgucgacucagaucuggucaccgaacuggaaaccgugucgaaaucgaagaaaggccucaccgaccgccuguaccuauacuucacccaauugggcaaagacauguacacgggcgauccccugaacauugaugaacucuccaccuaugacauugaccacauucuaccacaagcguucaucaaagaugacucucucgacaaccgcguacuugucagcaaagccgucaacaacggcaaaagcaacaacguccccgucaaacucuucggcggcaaaaugggcggauucuggaaggaacuagcggaccaccgacucaucucaaagcgcaaacucaagcaccuucuaacagauccugacaccauagacaaauacacaaugagaggauucauccgccgccaacugguugaaacgagucagguaauaaaacucgucgcccaaauacuuggagacaaauaccaaaacgacgauacuaaaaucaucgaggucacagccaagaugaaccaucagaugcgcgaaaacuucaagcuaaucaaaaaucgcgaagugaacgauuaccaccacgccgucgacgcuuaccuaaccgccuucguaggccaauaccucuacaaacgauaccccaaacuacgaccuuacuucguauacggcaauuucaagaaauucaacgaggaccauguaucauuccgcuauuucaacuuccuccacgaacucauggacgagaacaauaaacguaucguagagccagaaacgggcgaagucguacucgaacgagaacccgccauagccuacaugaaaagggucuaccacuucaaauucaugcucaucucccaagaaguauacacacgacgcgacgccauguucaaccaaaccaucuauccagcaaaagaagcaaacagaagaaaacuaaucgcgaucaagcauggcaaacccguugacguauacgggggcuacuccggcuccgucgaugccuacauggcgauagugaggauacacgacaagaagggcgacaaauauaaggucgucggaguaccaaugagagcacuagaaauacucaacgcgacacacgauaagaaggacuacgacgcgaaacucaaacaaauauuaguaccgaaauuuaccaaagucaagaaaagccgcaagacaggagaaaucacgaagaaaguagaggacuucgaaauaguacucggaaaaguaauguaccggcagcuagucauagauggcgacaagaaauuuaugguagggagcagcaccuaccuauacaacgcccgucagcuaguguuauccgacagcagccuugacacacuagcaaguaaaggcacccuagacucagacgcagauagcaaaaggcuagucgcgguauacgacgaaauagucgagaaggucgacaaauacuuuccccucuacgacaagaacgcauucagaagcggccuccacaaaggacgagacaaguaccugcugcugcccaauagaagcacguucaacggagcgaaaaagguccacuccggaaaacgcgaaauacuaaacgagauccucaacgggcuccacgcuaacgcgacccugggcggacucaaagaccugaaaauauccacgcccuucggcaagaugcaaggccaaagcggcauaccucucuccagcaacacgaucaucugcuaccaaucaccaacaggccucuucgaacauagagucagccuaaaagaucucuga

SEQ ID NO: 6557 - RNA, 4092 nt, Artificial Sequence
  Cas9 variant
auggaaaacaaccgcuacaacguaggacuugacauaggcacaaguagcauaggguucgccguaacagacgagcaagaugaacucguccagguuaaggggaaaaacuauauaggaguccgacuauucaaagagggacaaacagcuuccgagcgacgaucguuccgcacaacgcgccgucgccugaaacgucgcaaauggcgauugggauugcucgaggagauauucgcccccuaccuugcccaaggcgacccguacuuccucgcgcgcaugaaagaaucaaauaucuccccacgcgacgaacguaagaaauacuacggcagccuccucuucuccgacgacaccgucuucuaugacaaauaccccacaguauaccaccuccgccacgcucuaaugaccgaagaccgcaaauucgacaucagagaaaucuacuuagcuguacaccauaucauaaaguacagaggaaacuuccuuaucaacacccuaaucaacgaguucagcucgaaagccgucgacuucaagaaagacgcagacauccuaaacgaucucuucgaacaauucuacaucagcgacauaaaugacucguuccagcucaacaccgccgacaugaacgagauuucagaacuucugcucgacaacucaaaaacgcggcucgacagacaaagagaaucucuaaagaaacuagcaaagaaaguugacgacauauccguggcaaagaaacaccagaaaaucgccaccgaauuuuccaaagcaauccuaggaaacaaagcuaaauucgacgucauauuaaacguaacaaccgacucauccaacgacuggucguuuaaacucgaagacgaggacgcggacgagaaaauagucgugcuccucgaagaguuaaauaccccgcaacaagaagcccucaacauaauccaccaaugguacagccaaauaagccuuaacggaaucguaccagauggcaaaucaaucagcgaggccaugauaagcucuuacgaacuacacaaagagcaccuggcccugcuaaaacaacaaauuaacaacacaaaagacaagaagaaggcgcauggucuccacgaagccuacaacgaauacguucauggaaacaacaacaagaaacucaaccaagcagauuucuacuccaaagucaaacaaaaccucgagagcagccuaaucaccgacgaaauccucgaacuaaucaacgcggaaaauuucaugcccaaacagcgaacaagcgcaaacggggugauaccccaccaacuccaucaacaagagcucgaccgaaucauccaaaaccaggcuaaauacuacccauucuuggcggaaaccaacccaaacgaaaaacgcagcaaaguagccaaauacaaguuggacgaacuuguggccuuccgcgucccguacuacgucggcccccuuauuaccgcaacggaccagaagaaaaccuccgggaaagaguucgccuggaugguccgcaaacaaccaggacgaauuacaccuuggaacuucgacgaaaaaguaaacaagauggaaagcgcgaauaccuucauuagacggaugacgacgaaagacucauaccugauagcggaggauguucuacccgacgaaagccuccuguaccagaaauucaaaguacucaacgaacuaaacaaucugcgcgccgacggucgcaagcuaaagguaagcguuaagcaaaaaguguucaaagaacucuuccaacaacagaagacuaucaccauaguaaagcuccaaaacuaccuaaaagcggaaugcuccuuccuaacaacaccugagaucagcggucucagcaaaccagaacacuucgugucaagccucgccacauacauugaccuaaagaaaaucuucggagaagacaucgacaacccagcccgccaaaacgacuucgagcggaugauagaaugggcuaccaucuucgaggacaaaaacauauacucggagaaauuaaacgaaauaaaguggcugaaugaccgccaaaagaaagaguugaaaaacaagaacuaccaugguugggguaagcuauccgccaagcuccucaaaggccugagggacuccgacgaaugcuccauaaucgaacacauguggaacacccagcaaaacuucaugcaaguacaggccgaggaagacuucgcccaaagaauccaagaagagaacaaccaacaccucaaaggcaacacacuagaagaaguccuugcagaugcauacacaagcccccaaaacaagaaggcaauacgccaaguaguaaaggucauugaagacauccaaaaagcaaugggcggcauagcaccccagaaaaucuccaucgaguucacccgagccccggaagaaaaaccacgaagauccgucgagcgccaacaacaaaucgagaaaaucuacaaguccgucgccaaugaagucgaaaacgccggugucaaagacgaacuccaaagguucagcgaccgcaaacaaacccuaacggauaaauacuuccucuacuucacacaacucggcaaagacauguacaccggaaaaucgaucaauaucgaucaaauaggcaacuaccaaauagaccauauacuuccgcaagcauucauaaaggacgauagcuuagacaauagaguccucguaagcgccgccguaaauaacgguaagagcgacaacguucccacgaaaaacgaccgauacaagguccgcgagcacgggcaacgacucuacgaccagggccuaaucaguaagagaaaauucaacaaucuaauaacagaccccgauucaaucaacaaauucaccgcccgaggauuugucaaacgacaacucgucgagaccucccaaguaaucaggcuggucgcggaguuccuguacaauaaauaccaguccaaaagcgaaaucauugaagugcgagccaagaugaacucccaauugcgcaaagacuucgggcucaucaaaaaucguaacguaaacgacuaccaccacgcccucgacgcguaccucacuaccuucaucggcaacuaccuauaccgaagauaccccaaacuccgcgccuacuucaccuacggcugcuucaagaaaguggacgacagccaacuaaaauacuucaacuuccugcacgacauagaagacgacaagaagaaaauaauaaaggacaacgacaccggcgaaauccucuggcacagggacgaaggcaucgcgcguuucaaacguauuuacaacuucaaauacaugcuaguuacacacgagguccucacgcgccagggugccauguucaaacagacgguauacuccgccgcaguugcgggcagcaagaaacucauccccguaaaagaagaccgacccaucgacaucuacggaggauacaccaacaacaacgacgcguuccuagcuauaguaaaagucaccaagaagaaacaauacaugguagucggaaucccucaacgugccgucgucaaacucaacgacgcggcgaagcagggaagcaaagcauaucaaaaggugcuauauaacgucaucaaaccccaauucauaaagaagaagaaggaccgaaaaaccggaaaaauuacacaaaagcucgaaaacuucgaaauugucguaucgaaaacccuauaucgacaacucauuaucgacggggaccaaaaauacauguuaggcuccucagcuuacaaguacaacgcgaagcaacugguccuauccgaauacgccuuggaagugcuagaucgcuccauauucgagaaaaaggaauacacgacggucgaccuagacaacguguacgaugaaauacucgcccagguagacaaauacuucucccucuacgacaaaaacaaauuccgacaaaaacuacacgaaucccgcaagaucuucaccgagcucccgaucaacaaccucuucuccgguacgaaauugcucaaauccggaaagagggaaacacucaacgaaauccucgaaggccuccacgccaacgcgacgaagaaagaucuaaaaucacugaaauucagcacaccccugggcaugauccaguacccgucgggcauuauacuaucagaaaaugcaauucucugcuaccaaucuccaaccggaauuuucgagcgccgagucacccuuaaagaccucuga

SEQ ID NO: 6558 - RNA, 4092 nt, Artificial Sequence
  Cas9 variant
augaccaaauuagggaaaccuuacggcauaggcguugacaucggauccaauuccauagguuucgccgccguagacgagaacucacaccuuaucaggcuuaaagggaaaacagucaucggggccagguuauucgaagaaggcaaagcagcagcugaccggagagccucccgaacaacccgaagacgacuaagcagaaaccguuggcgacucagcuuccuccgagauuucuuugaaucacacaucacgccaaccgacccuaacuucuuuaugagacaaaaguacuccgaaauaucucccaaggacaagagccgauacaaauacgaaaagcgccuauuuaacgaccgcaccgaugccgaguucuacaaauacgaaaacugccccaccauguaccaccuucgaaaccgacucaugaccgacccaagcaaggcagacguccgcgaaaucuacuucgccauccaccacauacugaaaucccgcgggcacuuccucacaccaggcgacgccaaagauuucaauaccaacaaagucgccgucaacaaaaucuuccccgcauuacaggaugcauacgcacaaguguaucccgaccucgacaucacauucgacgaaaacaaaguuaacgaguucaaaaccguccuucuaaaugaaaaagcaacucccucggacacacaacgcgcccucguaaaccuacuccuagcaaaagagggagaccgugacauccucaagcaacaaaaacaggcccuaaccgaguucgcaaaagcagucgucggccugaaaaccaaacucaacgucgcucuaggaacugaaguagacucgucugaagccaccgccuggaacuucagccucggccagcuggacgacaaauggacggggauagaguccgccaugaccgacgaggggacggaaauccucgaccagauacgagauuuauaccgagcccggcuucugaauggcaucgucccagccggaaaaacccucagccaagccaaggucgacgacuacgcccaacaucacgaagaucuagagcucuuuaaagacuaccucaagcaacuagaggacgacgguaccgcaaaagcgauccgccaacucuacgaccgcuacauugauggcgacgacgccaagccauucguaagagaagacuucgucaaagcacuaacaaaagaagugacggcucaccccaacgcgaaaaguccugagcuccucgaaagacucgcccaaccagacuucaugcuuaaacaacgaaacaaggccaacggggcuaucccaguacaaaugcaacaacgggaacucgaccaaaucauuaaaaaccaguccguguacuacgacuggcuagccgcccccaacccggucgagaaacaccgaaaauccaugccauaccaauuggacgaacuccuuaacuuccgaauccccuauuacgugggcccucucguaacggcuaaagagcaaaaggccgcccaagguggaguguucgccuggaugguaagaaaggacccagaugguaacaucaccccauacaacuucgacgaaaaggucgacagagaagcauccgccaauaccuucauacaacgaaugaagaccacagacaccuaccucaucggcgaagacguccuccccaaacaaagccuccuauaccaacgauacgaaguguuaaacgaacuuaacaauguucgcguuaauaacgaaaagcuguccauagagcagaaacaacaagucauccgagaacuguucgagagacacaacucaguaacaauuaagcaauucgccgagaaccuccgcgcacacggagacuacgcccacaugccagaaauacgggggcucgcagacgaaaaacgcuuccucuccucccuaucaacuuaucgccaacucaagucacuacuacccgaggcaauagacgacccggccaagcaagccgacaucgaaaacaucaucgccuggaguacggucuuugaagaugccgccauuuucaagaccaaacuuaaagaaaucaacuggcucgacucacaaacaauaaccaaacucuccaacauuagauacagaggauggggacaauucucacacaaauuccucaacggccuaacccucggcaacggccacacuaucauccaagaacuauuucucucaaacaacaaccuuaugcaaauacuaaccgacgagacucuccagaaaaagaugaccgagcuuaacgcugauaaacugaaagcggcgaacauaaacgacgccaucgacgacguauacaccucacccucgaacaaaaaggcccuucgccaaguccuccggguaaucgaagacauaaagcgugccgcugacggccaagacccauccuggcuuuacguagagaccgcagauggaggcggaacgccaggaaagaggacccgcgcgcgucaacaucaacuccaagaaauauaugcaaaugcggcgcacgaacugaucgacagcgccguccggggagaacuagaagacaagauagccgacaaagccgacuucaaugaccggcucguucuauacuucaugcaagggggcagagauaucuacacgggcacuccauuaaacauagaccagcuaucuagcuacgauaucgaccacauacucccucagucguugauaaaagacaauucacucgacaaccggguacuuguacacgcgaucaucaaccgggagaaaaaugcaaccuucgccucgaccauauacgcgcagaaaaugaaugccaccuggcgccaauggcaugaagcuggccuaauuuccggccgcaaacuccgcaaccuacaaaugagacccgaccaaaucgacaaguaugcaucgggauucgucgcacgccagcucguggaaacacgacaaaucaucaaauuaaccgaacaaaucguagcagcccaguacccugaaacgaagauaaucgcagugaaagcaggccucucucaccaacuccgggaggagcuugaguucccaaagaacagagacguaaaccauuaccaccacgccuucgacgcauuccucgcagcccgaauaggcaccuaucugcuaaaacgcuuucccaaccuacaagcguucuucacauacggaaaguucaaaaaggcugacguaaagaaacucagaggauucaacuuuauacgagacaucacccacgcggaagacaaaaucguagucaaagacaccggagaaguaaucugggacaagaaacgcgacguagacgaacuggaccgaaucuacaacuucaaacggauguuaaucacccacgagguccacuucgaaaaagccgaucuguucaaacagaccguauacggagcgaaagacuccaaagaagcaggcggcaagaaacaacucaucagcaaaaagaaaggcuauccaguggacaucuacggaggcuacacgcaagagaccggcaguuaccuguccguagucagacucacgaagaaagcuauguacgcggucguaaaagucucaacccgcgacgccgcaaaacuugcuguggcuaaauccauaagugaacaaaaggagaacgaaacgcuaaacgauaucauagacgagaaacucagcaagauaucuaaaaacggaaaaaucacgcacgaacucuucgaggucguccuccccagagucggacaaaagacucucuucaaaaacuccaaguauaaccucuuucuagugaacagcgacacuuacaugcacaacuaccaagaacucuggaugccacgcgaauaucagaaaauguggaaagacaucagccuaucaaaauacggcgacgcccaaaccgaagaucaacucgaccaaaucuuuggguuuaucgucucccaagucaacucguacuucaaccuauaugacaucaaccaauuucgcaagaaauuaaacgacgcagccgauaaauucgcaacucuaccuaugcgcgacacugacgacaugcaaggaaaaaucgcaaccauaggacaacuucucauaggucuccaagcaaacgcagcucgaagcgaucucagaaaccucgauauaaaaacuccccuaggccuacuccaaauccccaacgguaucucccuagacucugauacaucaguggucuaccaguccccaacugggcuccuagaaagagaaguacaccuaucagaccuguga

SEQ ID NO: 6559 - RNA, 4092 nt, Artificial Sequence
  Cas9 variant
augacuaaacucaaccagccauacggaauaggacuagacauaggcuccaacuccaucggcuuugcuguuguggacgccaacagccaccuccuccgauuaaaaggggaaacugccauuggagcaagacuauucagggaaggccagucggccgccgaccgacgggagucccguaccacccgacggcgacuaucacgaacucgauggcgucucucauuccugcgugacuucuucgcaccccauauuaccaaaauagacccagacuucuuccucaggcaaaaauacucagaaaucucacccaaagacaaggacagauucaaauacgaaaaacgccucuucaacgaucgcacagacgcagaguucuacgaagcguaccccagcauguaccaccuuaggcugcgauuaaugaccgacgccagccaggcagauccccgagaaauauuucuggcaauacaccacauccucaagagccgaggccacuuucucaccccaggcgcagccaaagacuucaacaccgaugaaguagaucugaaacauauuuuucccgcacucgccgaagcauaugcacaaguuuacccagaccucgaacuaaacuucgacucagcccuagcggaugacuucaaagccaaacuucucgacgaagacgccaagcccucagauauacaaaaagcccucgucaaccuccugcucucaucugacggagaaaaagaaaucguaaagaaacgaaaacaaguucuaaccgaguucgccaaagccaucacaggccucaaaacuaaguucaaccuggcccucggcaccgaagucgacgaagccgacgcguccaacuggcaauucucgaugggccaacuagaugacaaauggaguaauaucgaaaccuccaugacugaccaggguacagaaaucuucgaacaaauccaggagcuauaccgcgcccgacugcuaaacggcaucgucccggcagggaugucccuaucccaggcgaaagucgccgacuacggccaacacaaagaggaccucgagcuguucaaaaccuacaucaagaagcuaaaugaccaugaacuagcaaaaaccauucgaggacucuacgaccgauacaucaauggcgacgacgcgaaaccauuccugcgcgaggacuuuguuaaggcccucacaaaggaggugaccgcacacccaaacgagguaucggagcagcuccugaacagaaugggacaagcaaacuucaugcuaaagcaacggacaaaagccaacggggccauaccaguccaacuucaacaacgagaacucgaccaaauaaucgcaaaccagucaaaguacuaugacugguuagcuaaaccgaaccccguggaaaagcaccgcgcaaguaaacccuaccaacuagacgaacuccuaacauuccggauacccuacuacgucggcccacucaucacaccuaaacagcaagccgaguccggugagaaugucuucgcauggaugguucgaaagaacccuucaggaaacaucacacccuauaauuuugacgaaaaggucgaccgagaagccucagcaaacacuuucauccagcguaugaaaacaacugauaccuaccugaucgacgaagacguacucccuaaacagucgcuauuauaccagaaauacgaaguacucaacgaacucaacaacguccgcauaaacaacgaggcccucuccacagaucagaagcaacgccucauccgugaaguauucgagaggcacagcuccgucacaaucaagcaagucgccgacaaucucguagcacacggagacuucgcucaacgccccgaaauccgaggccuagccgacgagaaaagguuccucucgagccuaucaacauaccaccaacuuaaagaaauccuccacggagcaauugacgauccuaccaagcuacacgacauagaaaauauaaucaccuggucuacgguuuucgaagacgccgcaaucuuuaagacgaaacuagccgaaaucgacuggcucgaccccgccacaaucaagaaacuuucgaacauacgcuaccgcggguggggucaauucucccgcaaacuccucgacggccucaaacuuggaaacggccacaccguaauacaggaacucaugcuuuccaaccacaaccuaaugcaaauacuggcggacgaaacacucaaggaaaccaugaccgagcucaaccaagacaaacucaaaacugacgacaucgaagacguaaucaacgacgccuacaccagucccuccaacaaaaaggcacucagacaaguacuccgcguagucgaagacauaaaacacgcagcuaauggccaagauccaagcuggcucuacaucgagaccgccgacggacccggcacagccggcaaacgaacccagucgaggcaaaagcagauucaaaccgucuaugcaaaugccgcacaagaacuaauagacuccgcaguccgcggggagcuggaagacaaaauagcugacaaagccuccuuuacggaucgucucguccucuacuucaugcaaggcggccgugacaucuacacuggcgcaccccugaacauagaucaacucagccacuaugacaucgaccacaucuugccacaaucacugaucaaagacgacucacucgacaaccgugugcuaguaaacgccacgauaaauagggagaaaaauaacguauucgcuuccacacucuucgcaggcaaaaugaaggcaacguggcguaaguggcaugaagcagggcuaauaagcggccggaaacuucgcaacuuaaugcugcggccagacgaaauagacaaguuugccaaaggauucguugcacgccagcucguagaaacacgccaaaucauaaaauugaccgaacaaauugccgcggcccaauaccccaacacaaaaauaaucgccgucaaggcgggacucagccaccagcuacgggaagaacucgacuuccccaaaaaucgcgacguaaaccacuaccaccaugccuuugacgccuuccuggccgcucgcaucggcaccuaccuucucaaacgauacccaaaacuaacgccauucuucacauacggugaguucgccaaaguggacgucaaaaaguuccgagaguucaacuucauaggcgcauugacacacgccaaaaagaauauaauagccaaagacaccggugaaauaguaugggacaaagaacgagacauccaagaacuagaccgaaucuacaacuucaagcggaugcucauaacacacgaaguacacuuugacauggcagaccucuucgaccaaaccaucuacgcagcaaaagauucaaaggagagaggcggcaguaaaaaccucauacaaaagaagcaaggauaccucacuggcauuuacggugguuacuccacugagagaggaucguacgucuccauaauacgcacguucaaaaagggagcaccaauuuacaauauagucaacauaagcacagcugacgucagccuauugagcgacaaacaacgagucucagaagccucagccgacguacuacucaaagaacugaucaagaagaaacucgccaaacggaaaucuggagaaaacaccaaaucgggcgcuuucgaaauugugcucccgcgaguagggaaaaacacccucuucaagaacaagaaguacggccucuuccucguggaauccacgaccgaauuucauaacuaccaggaacuauggcugccccgcaacgaucagaugcucaucaaauccauacaaucgcacaaaauugaagagagcaaagccgacuacgaacuaacacgaauguaccgcaacaucgcaucacaagucgaccacuacuucggacuguacacaauccggaaauuuagcgagaaacucaccgcuagcauaaacgauuauggcgcccuaccagucuacaaaagcgaaaccacugacgggaaauacgaaguacucuccaaucuguucgaaggucucggcuccggcaccaguacagggaaccucaccgccgucaaacugcaacccaacuucggccguguauaccuaacuucgggaaucguccuggaagacgacacauccaucaucuaccaguccccgacgggacucuucgagcgcucgguaaagcuagcugaccuauga

SEQ ID NO: 6560 - RNA, 4092 nt, Artificial Sequence
  Cas9 variant
augacaaagcuaaaucagcccuacggcaucggccuagacauaggcucaaacuccauuggauuugccgucguggaugccaauagccaccuacugcgcuugaaaggggagaccgccaucggagccagauuauuccgagaaggacaaucagcagccgaccgccgagggucccggaccacgagacgccgccugucucgaaccagauggaggcugaguuuccuccgcgacuucuucgcaccccacauaacgaaaauagaccccgacuucuuucuacgccagaaauacucggaaaucucaccgaaagauaaagacagguucaaauaugaaaagcgauuguucaacgacagaaccgacgccgaauuuuacgaagauuaccccagcauguaccaccuccgccugcaccugaugacccacacccacaaagccgacccacgggaaaucuuccucgccauacaucacauccuaaaaagucgaggacacuuccugacgcccggcgcugcaaaagacuucaacacagacaaggucgaccuagaagacaucuuuccagcacuaaccgaagccuacgcacaaguguaccccgaccucgaacucacauucgaucucgccaaagcagacgacuuuaaagccaaacuucucgacgagcaagcaaccccaagcgacacgcagaaagcucugguuaaccuacuacuauccuccgacggagaaaaagagaucgugaagaagagaaaacaagugcucacggaguucgccaaggcuaucacaggacucaagaccaaauucaaccucgcgcuaggaacagaaguagacgaggcagacgccuccaauuggcaauucuccaugggacaacucgacgauaaauggagcaauaucgaaaccagcaugacagaucaaggcaccgaaaucuuugaacaaauucaagaacuauaccgcgcacgucuucuuaacggcauaguucccgcaggcaugucccuuucacaggccaaaguagcagauuacggacaacacaaagaggaccuggaacucuucaaaaccuaucuaaagaaacucaacgaccacgagcuggcgaaaacgauacggggacucuacgaccgcuauauuaauggcgacgacgccaagccuuuccuacgagaagacuucgucaaggcccugaccaaagaggucacugcccacccaaacgaagugucggaacagcuacuaaaccgaaugggccaggccaacuucaugcucaagcagagaaccaaagccaacggcgcaaucccuauacaacuacaacagcgcgaacuugaccagaucaucgccaaucagucgaaauauuacgacuggcuggcugcaccuaacccagucgaggcccacagauggaaaaugccauaccagcuagacgaacuacugaacuuccacauaccauacuacgucggcccccucauaacgcccaagcagcaagccgaauccggcgaaaacgucuucgcuuggauggucagaaaagacccgagcggaaacauaaccccauacaacuucgacgaaaaagucgaccgcgaagccucagccaacacuuuuauacagcgcaugaagacaacagacaccuaccuaaucggugaggacguccuacccaaacagagccuccuauaucaaaaauacgaaguccucaaugaacuuaacaacgugcggauaaacaacgaaugccucggaaccgaccaaaagcaaagacugauccgagaaguauucgaaagacacagcuccguuacuaucaagcaagucgccgauaaccuagucgcacauggcgacuucgccagacggcccgaaauccgcggacuagccgacgagaaacgguuccuguccucccucagcaccuaccaccaacugaaagaaauccugcaugaggcaaucgacgaccccacaaaauuacuugacauugagaacauaaucacauggagcaccguguucgaagaccauaccaucuuugaaaccaaacuagcagagauagaauggcucgaccccaagaaaaucaacgaacucuccggcauccgcuaccgcggauggggacaauuuagccgaaaacugcuagacggacucaaacuuggaaacggacacaccgucauccaagagcugaugcucucaaaccacaaccuuaugcaaauucucgcagacgaaacacucaaggagacaaugaccgaacucaaccaagacaaacucaaaaccgacgacauagaagacgugaucaacgacgcguacaccuccccaucgaacaagaaagcgcuucgccaagugcuaagggucguggaagacauuaaacacgcugcaaacggccaggaccccucauggcuuuucauagagacagcagacggcaccggcacagccgggaaacggacacagucaagacagaaacagauacaaacaguauaugccaacgcggcccaggaacucaucgacucggccguccgcggcgaacuagaagacaaaaucgcagacaaagcuagcuucaccgaccgauuaguucucuacuucaugcaaggcggccgagacaucuacacaggggcaccccugaacaucgaccaacugucccacuaugacauagaucacauauugccccaaucacuaauaaaggacgacucacucgauaaucgaguccucgucaacgccacaaucaaucgcgaaaagaacaacgucuucgccagcacccucuucgcagguaaaaugaaagcgacguggcggaaguggcaugaggcuggacucauaagcggccguaagcuccgcaacuugauguuacguccagacgaaauagacaaguuugccaaaggcuucguugcacgccagcuaguugaaacaagacaaaucaucaaacuuacagagcaaauagccgccgcacaauaccccaacacaaaaaucauagccguaaaagccggccuaucccaucaacuucgcgaagaacuagacuuuccuaaaaaccgcgacgucaaccacuaccaccaugcauucgacgccuuccuggccgcccgcaucggaaccuauuuacucaaacgguacccaaaacuugcuccauucuucaccuacggagaguucgcaaagguagacgucaagaaguucagagaguucaacuuuaucggcgcccucacccacgcgaagaaaaacauaauugcuaaagacaccggagaaaucguaugggauaaagaacgcgacauccgagaacucgaucgaaucuauaacuucaaacgaauguuaaucacgcacgaagucuacuuugagacagccgaucucuucaagcaaacaaucuacgccgcaaaagacaguaaagaaaggggcgguagcaagcaacucauccccaagaaacaaggcuacccgacccagguauauggcggcuacacccaagagucgggguccuacaacgcccucgugcgaguagcagaggccgacaccaccgcauaccaagucaucaaaaucagcgcccagaacgcaaguaaaaucgccagcgcaaaccuaaaaagccgugaaaaaggcaaacaauuauuaaacgagaucguggucaaacaacuagcaaaacgacgcaaaaacuggaaaccauccgccaacaguuucaaaauugucauaccaagauuuggaaugggcacgcuauuccaaaaugcaaaauauggccucuucauggugaacucugacaccuacuacaggaacuaucaggagcuguggcucagccgggaaaaccagaaacugcucaagaaacucuucuccaucaaauacgagaaaacgcaaaugaaccaugacgcacuccaagucuacaaagccaucauagaccaagucgaaaaauuuuucaaacuguacgacauaaaucaauuccgcgcgaaacuguccgaugcaauagaacgcuucgaaaaacuccccaucaacacagacgggaacaagaucggcaaaaccgaaacucuccgucaaauacucauuggucuccaagcaaauggcacccgcuccaaugugaaaaaccucggcauaaaaaccgaccuaggacuccuacagguaggcuccggcauaaaacucgacaaagacacgcaaaucgucuaccaaucccccucgggacuuuucaagcgacgcaucccacuagcggaccuauga

SEQ ID NO: 6561 - RNA, 4095 nt, Artificial Sequence
  Cas9 variant
augggcgaccgcaaauacaaccuuggccucgacaucggcacaucuagcauaggcuucgcggcaguggacgaaaacaaccagccaauacgcguaaaaggcaaaacagcgauuggaguuagacuuuuugaggagggcaaaaccgccgccgaucgccgcggcuuucgcaccacacgccgucgguuaagcagacgccgauggcgcaucaacuuacucaacgaaaucuucgacgcccacuuagcagaaguggaccccacguuccucgcgcgccucaaggaguccaaccgcucgaaccuagaccccaagaaauccuuucagggcagucuacucuucccagaacgcaaagacuaccaauucuaugaggaauauccgaccauauaccaccuccgcaaggcgcucauggaaaaagaucgcaaauucgacuuccgagagauauauuuagccguccaccauaucaucaaauaccgcggaaacuuuuuaaacggaacgccaaugcgaucguucaaggucgaaaacauagagcucgauacccuguucgaccaacuaaaccaacuuuaugccgaaauaguacccgacaacgaacucgcauucgaccucgcccaggucgccgacguaaaagacguccuaagcucaaccacaauauacaaaauggauaagaaaaagcaguuaguaaaaaugaugcuacuaccagcuagcaacaaggcucuccagucggaaaacaaaaagauugucacgcaauuuguaaacgccauacucaacuauaaguucaagcuagauguccuccuacagguggaaacagacgcagauuggucccugaaacucaacgacgaaggcgccgacgacaaacucgaggaguucacaggagaccucgacgaaaauagacuagaaaucaucgaucuccuccagcgucuccacaacugguucucccuuaacgaaaucacaaaagacggcaacagucuaagcgcggcaaugguagaaaaauacgaaaaccaccaccaccaccugggccuccucaagaaagucaucgaaaaccauccugacgcgaagaaagccaaagccuugaaagaaacguacacugcauacguagguaaaacugacgacaaaacgcaaaaccaagacgacuuuuacaaagccgucgagaaaaaccuggacgacucuccagacgccaaagagaucaaacggcuuauucaacuagaccaauucaugccgaagcagcgcacaggacaaaacggugcuaucccccaccagcuccaccagcaagagcuugaccaaauaaucgaaaaacagucuaaauauuacccguuccucgccgagccaaaccccaacgucaaacgccgcaaagacgccccauacaaacuggacgaacuaaucgcauucaaaauacccuacuacgucgguccgcuggucacccccgaagaacaagcacaaaacggcgaaaacgucuucgcguggaugaagcggaaggcagcugguccgaucacacccuggaacuuugacgaaaagguagaccgcauggaauccgccaaccgguucauaaggcgcaugaccacaaaagauacauaucucuucggagaggacguccucccggccgagucaaugaucuaccagaaauuuguaguccuaaaugaacucaacaaccucaagauaaauggacgacaccuaucacuaaaggacaaacaggacguuuacaacgaccucuucaagcaacagaagacggugucaauuaaggcgcuccagaacuacuacgucaccaaaaagaaagcagcuacggcaccuaccgucgggggccucgccgaccccaagaaauuccuauccucgcuaucuaccuacauagauuucaaaaacauguuuggagaaagagucaaugauccccaguuccaagaggaccucgaacaaauagucgagugguccaccaucuucgaggaucggggcaucuucaaagccaaacuccaggcccugggguggcuauccgaaaaacaaauacaacaacucgucgccaagcgcuacaaaggguggggucgacuauccaagaaauuacuaacaggccucaaaaacgcugagggcuacagcauuuuagacgagauguggcguuccacgggcaacuucaugcaaauacaaagucguccagaguuugccgcacuuauacagcaggccaacgaaaaacaguucgaagggaacgaccccgacaacgucugggagaacauugaaaacauccucggcgaugccuacaccucgccucaaaacaaaaaggcaaucagacaagucguaaaggucguccaagacaucgaaaaagcagucggaaacccgccggagaaaauagcaaucgaguucacaagagaagcggccgccaauccccaaagaacccaaucucgccuccgcacccuggaaaaacucuacgaauccgccgaagaagucgucgacgcgggccuaaccgccgaacucgccgaguucaaagaaaacaaacacguacuauccgacaaauacuaccuguacuucacucagcuaggcagggacguguauacaggcgauaccauaucauuggacaaacuaaacgacuacgacguagaccacauacuuccccaauccuucauaaaggaugacucccuagacaaucgagugcugaccauacgcgcagucaauaacggcaaaagcgacaauguuccugcaaagauguucggcaaaaagaugggcuccuucuggcgauaccuacucgacaacggaaugaucagcaagcgcaaauauaacaaccuuaucacagaccccgacaacaucuccaaguacgcccaaaaaggcuucaucaaccgucagcuagucgaaaccucgcagguaauuaaacuaacggccaacauccugaacggcauauacgacaaagacacggagaucaucgaaguaccagccaaaaugaacagccaaaugcggaaaauguucgacuuagucaaagugcgagaagugaaugacuaccaccacgccuucgaugccuaucugacgaucuucauuggcaacuaucuguacaagugcuaccccaagcuccagcccuacuucguauacgacaacuucaagaaauucgggaacaaagaagacaucggacacaaacgcuucaacuuccucggaaaaaucgaacgcgaaaagaaaguaguagccccagagaccggagaaauccucuggucuaacgucgcccccaaugagacaauaaaacagaucaagaaaguauacgacuauaaauucaugaucgucucacgugaaauuacaacucgacgcgcagaacuguucaaccagaccguauacccuaaaaacuaccacggaaaacugauaccaaucaaagaagacagaccaaccgaccuguauggcggcuacagcggaaacacagacgcuuaccucgcgaucgucgcgcuugaggacaaaaagaaaggaaaauacuuuaaagucguaggaauccccaccagaguugcagccaagcuagaaaaacuaaagcagcaggacagucaacaauaccuccaagcccuccauaaagugauugcgccacaguucaccaagagcaccaagaaagggaucaagaaaacagaguucgaaaucguguuagacaagguacacuaccgacagcuggugcaggauggacccgucaaaaugaugcuaggaucgagcaccuacaaauacaacgccaaacagcuaguacuuagcgaaaaagcucuccaagucauagccgacgaccggaaauucgaugaaacacaaaaggacgacaaucucaucgccguauacgacgaaauccucucgauugugaaccagucauucgaccuguacgacauaaacggauuccgaaagaaacuuaacgacaaccgagaccaauucauugaccuccccgccgagacgaaauacgagggccgaaaaguuguggcgcacggcaaacgcgaaaugauacuagaaauacucaaaggacuccacgcaaacgccgcauucggaaaccucaaacccaucgguuucuccacggcauuuggacaacuccaaguccccaacggcaucauccuguccaaaaacgcaauccuaauccaccaauccccaucaggccucuucgaacgcaaaauaaaacucuccgaccuauga

SEQ ID NO: 6562 - RNA, 4095 nt, Artificial Sequence
  Cas9 variant
auggaaaaacaagaguacuaccuaggccuagacauggggaucagcaguguggggugggccgugacgaacgacaaguacgaguuguuacgaaagaaagggaaagacauguggggcauucgcgaauuugaagaggcagacagcucggcagaacggaggacgcaccgggugaaccgacgacgacgacaaagacagguggcacgcaugggccugcucaaagaguacuuuuccgacgcaauagaaaaaguugacuccaacuuuuucauacgcaucgaaaauucgaaauauuucuucgaggacaaggacggccgucucucauccaaaaacggaauuuucgacgacgcugacuacaaagacgucgacuacuacaccgaguaccccacgauauuccaccuccgcaaagcccuacuagacaucgaagacacaggcaaagaguacgauguccgccuaguauacuuggcccugguaaacauguucaagcaucgcgggcacuuccugcucaacaccgagggggacgccuuaucaagcgaacagguaaauaccacauaccaagaacuccucgagauccuagaaaacaacuacgacauuucccucgaaucccgagacauaaaggacguaaucgacauaauaucauccagugacaacggacguaaaaagaagcacgagcagauauuagaacuauucgggguaaagaaauccgacaaaagagcgaacgaacuacucaaaugccucugugggcucuccguuaacgcaaaacugauauucgacgaaaacuacgaggaaaaggucgaccuaugcuuccacgacuucagcuacacagauaaaaucccagaccuaauggagaaacuaucagaggaagaauacuauguaguugaacaacucaaguccaucuacgacuacucaauccucgcaggcacccugaagggcuaugacuacuuaucaugcgcccgugucgaacuguacgaaaaacacagggaagaccucaaacugcucaaggcgcucuaccgccguuauaaaacaaacgaggaguacaacgacauguucaagucggacaaagagggaacauacagcgccuacguaaacucuuucaacuccagcgacagcuccguaaagauuaagaaauaucgcuggaacaugaaggggcgaaccauagacaaccuuuacggcacaauuaagaaagcauucaaagacaacacagacgacaaggacgugcaaucaaugauggagucaauagacaaggagcaguuccugcccaaacaacuaacaggcgcaaaugggguaauuccaaaccaggugcacaagaaagaaauggaacggauacucaaaaaggcacaaaacuaccuccccuuccuuaaagaaaaagacgaguccgagcuaaccgucagcgaacgaauccuacgccuuuucacauuccagaucccguacuacgucgggccccugggcgagaacagcaagaccggcugggucguccgacgggaagggggacgaguccuccccuggaacaucgacgaaaagaucgacaugucugcuacgucggaggcauucaucggcaaccucauccgcaaaugcacguacuuaucagacgaaaaaguaaugccuaaagcaagccucuccuacgaacgcuacugcguccugaacgaaaucaacaacauauguauagacggagagagacuagacaccgaauugaaacagaaaaucuacacagaaugcuucaugaagggcaaacgcgucacacgcaaacaaauaugcaacuaccuggucgcccaaggauguaucaaaagugacgaacaagucacuggcauugacaucaacguaaacucuagccucagcagcuaugguaaaauguucgcaauuuucggagagcaccucaaggaggacgccauaagaaaagucgcagaggagauaauauacuggggcacaauuuucuccgacucaaagaagauguuccggaaacaccugacgaaauacgucgaacaagguauacucggcgaaagccaggucaaaagaauccuuggauacaaauucaaggacugggggagguucaguaaggcccuccuaacccugcaaggaaucgacaaaaguaccggggaacuccucagucucgaaaaugccaugugggaauauagcuuaaacuucauggaacucauaaacagugacgacuucacauucaaagaugagcuagccaaucgccgaaccuccgcgaucaagucccucagcgaguucaccuacgaagaccucgaggacacguacuucagcguaccagucaaacgaaugauuuggcaaacaauucucguaguacgagaaaucgaacaaaucaugggauacgcccccaagaaggucuucgucgagauggcccgauccgaggaagaaaaaggcgacaagggcaggaaagacagucgcggcacccaacuccucgaacucuacaagaauaucaaaaacacggaaaaccacgacuggaagaaagagauaagcgaggcgaacgagagcggaaagcuacgaagcaagaaacucuaccuguacuacacucaaaugggacgagauauguacaccggcgaagagauaaacaucgacaugcucuacgacgacucuauguacgacaucgaccacaucuaucccagacacuacgucaaggacgacagcauagucaacaaccucgugcucgucaaccggcgcgccaaccaagacaucaaaaaggaccucuaccccauccccgacaaaaucauaagcaacccgaaggugcaagaacucuggaaaaugcuccacaaacagaaccucauaacagacgaaaaauacaagcgucucaugucacgcagccccuucaccgagaaacaacuuggagauuucauagcccgacaacucguagaaacccggcaaggcacuaaaggcauagccgagcuucucgggcaacuguucaaagacacggagaucgucuacgccaaggccaccaacgugucugacuuccgccgugacaacgguuucguuaaauccaggcucgucaacgacuuccaccacgcacaagacgccuaccuaaauauaguggucggaaacgucuacuacacaaaauucaccaaaaaccccuggaacuucaucaagaaagacuucgacaaagaucggaauaaaaacggcuacaaccucgcaaagauguucgaccgagacgucguccggggcgacgacacagcguggaucgccagcaaaaaggacacccaaggcacgauagagacagucagaaagaugaugaggaaaaacaccccacucaugacccgaaugucauucgagcaacacggaggcaucgccaacgccacccuuuauuccgcaaagaaagcaaagguugaaaacuacauaccccucaaaaguucagacauuagacugucggacgucaaaaaguacggcggcuuuacgagcgccaccguagccuacuacuucaucgugcaccacaaggaaggcaaaaaggaaaacacgacuauagaagcucucccucuauacugcaaacggaaaguugaaaacgaagaaaacgggcuccuaaaauauugcgaagagguacuaggcuacggcgaugucaaaauccucuuuaauaaacuaaagauccaaucccuucuagacaucaacggcuaccaagcgcaccugagcgggaaaaccggaaaccagcugacccuccgaaacgcaaugaaccucugcguccccgaaaaauggaccgcguacaucaaaaagcuagaaaaacucgugguaggccauguaaaggaacaagaaauauccuccgaggccaacauugaacuauacgaccuucucacagacaaacaucucaacagcguuuacgccaaacgaccaaaugcuuacgggcaaaaacuaaucgacaacagaagucgcuucguaaaccucaagcccgagucacaaugcgaagcaaucuuacagauccuuaagcugacaaaaaucggcaacaacgaaaccaaccuaaaacucauuggagaaagcgagcacagcggcaagaugcugauaagcaaaaaucucaaagacacggacaagcccgccaucaucugccagucagugacaggccucuacgaacguaaaauauauaucuucgacgagcaauuagacaaguga

SEQ ID NO: 6563 - RNA, 4095 nt, Artificial Sequence
  Cas9 variant
augaacaagcgcuacaacaucggccuggauauugggaccaacuccaucggauggucgguaguuaacgaccaaucucagcugguccgaaucaaaggaaagcuaggcuauggaguacgacuguacgacgaaggacagacagcagaggaccgacgacucuuccgcacgacgcgccgacgacuaaaacgacgaaaauggcgauuggggcuacuacgagaaauauucgaacccuacaucacaccccaagacgccacauucuuucuccgccaaaagcaaagcaaccuaucgcccaaagaccuacagaagcaacaaccgcaaauuggacuauucaacgaccgacucgacagcgacuuccacuaucaguacccuacaaucuaccaccuaagauacgcacuaaugaccgagaaacgacaguuugaccuccgcgaaaucuaccucgcaaugcaccauaucgucaaauaccggggccacuuucucaacgcugccgccgcaagcucauucaaaagcggagaaauugaccuagcaaaggauuuugcggcgcuaaaccagauuuucggcacgauauuuagcgaagucggcuucagccuuuccgaaagcaaccuagacgaaaucaaaucaaucuuauuagacaacaaccuguccgcguccguaagacagagaaaagccuuaccacucauuuaccagacugcagccucgaaagacuccgagaaacaguacaaagcaaucgccaccgaacuacuaaaggccaucuugggacucaaagcaaaauuuaaccucaucacaggcaucgagguggaggacgucaaggcguggacccuaucauuuaacgccgaagauuucgacgccaaacuauccgaucuaaauauagccgacaacgacgacgccgugcaaaucaucgaaauacuacgggcgcuauacagcggggugcuccuaacggguaucgucccagagggacaaagcaucucccaagcgaugaucgacaaauaugaggcacacaaagcccaccucaucaugcuccgcucgauaagggaacagcuaagcgacaaagagaacaaggcccuugagaaagccuaugacgauuacaucgaccacccggaagacaaacaacacggaucucgugaagacuucuacgccgccauaaccaaaguccuaaagaaagacucagaagacacaaauaucaucgagauucugaaacuaauagaacucgaccaauucaugcccaaacaacgaaccaaagacaacggcgccauaccacaccaacuccaccagcaggagcucgaucagauaaucgaaaaucaaaagcaauacuaccccuggcucgccgacaucaaccccaacgaacagcgccagaagauggcucccuauaaacucgaugaacucgucaccuucagagugcccuacuacgucggccccaugauuaccgcagaagaacaauuucaaacgagcaacaagaaauucgcauggaugauccguaaagaaccuggcgccauuacgccauggaacuucgaucaaaaagucgaccggcaagcauccgccaacgaguucaucaaacgaaugacgacaaccgacacguaccuauuagcagaagauguacucccaaaacaaucccuccucuaccagcgcuucgaaguccucaacgaauugaacgggauaaaaaucgacgaccaaccaauaacaguggaacaaaaacaggcgauauucaacgacaaauucaugcaacaggcccacgugacagucaaaaacauucaagcauaccuagucagcgagggacaauacgccucgcgcccaaacaucacagggcucuccgacggagaaaaguucaacagcucccucuccacauaucacgaucucaaaaagaucuucggcgacaugaucgacgaccccaacaaacaaacagacuucgaaaagaugaucgaguggagcacgauauucgaagacggcaaaaucuucgccgacaaacuuagggaaauaaacuggcuaaccgacgaacaacgucagaggcucuccaacaaacgauacagaggcuggggccagcuaagcacaaaauuacuaacaaagaucguagaccagaacggucaacgcauaauagacauucucuggaacacgaacgauaacuucaugcguaucauccacuccgaugacuucgaucaagcuguaacucaagccaaccagaugcuacuagcagacaaugacacccaggacguaaucaacgaacucuacaccagccccucaaauaagaaagcacuccgucaaaucuuacucgugguagcggacauacaaaaagccaugaaaggccaagcaccggcacgcauacucaucgaguucgccagggaaaaacaagcaaacccccgacuuuccacacaacgccgaaggcaaguggaacaagucuaccaagagcucaacaacgaccaacugaacaaggaacuggccgacccccaauacgcaaaucucuccaaggaccggcucuuuuuauacuuuaugcaaggagggagagacauguacacgggcgaaucccuaaacaucgaccgucucucagaauacgauaucgaccacauacucccccaagccuucaucaaagacaacucuuuagacaaccgcguccuggucucggccaaaaugaaucguuccaaaucggaccacgucccacuagauuucacagaggaacgcuuuggccagaaaaugcgaucgcaaugggaacaaaugcucagagccggccuccucacgcgacgaaaauacaacaaucugacacucaaucccgacucccuaaacaaguauacaaugagcggcuuuauaaacagacaacucguggagacaagacagguaaucaaacucgccacaaaccuacucguagaccaauacgcagacgaagacguccaacucguaacaguaaaauccgggcugacacaccagaugcgcgaggacuucgacuuccccaaaaaccgcaaccucaauaacuaccaccacgccuucgacgcauaccugacagcauucgucggacuuuaccuucuaaagaaauaccccaaacuagcccacuauuucgucuacggucaguaccaacaaggcuucaaagccaacgaccaauggcgcaacuucaacuuccugaacggccuaagacaagaacagcaaguagacgccgaaacgggcgaacucauauggcagaaagaccacgaccuggccuacaugaauaaaaucuacgauuuuaagaaaauccuaguuacgcgagaaguacacacuaaccacggagcgcucuacaaccaaacccuuuacaaagcaaaagacgacaaagcaagcgggcaaggaggucggcaacucaucgcggccaaagaaaacagacccaccgccauauacgggggcuauucuggaaaaaccgucgccuacaugugccucguaagaauaaccgagaagaaaggagacuucuaccgcaucugcggaguccaaaccgccuggguagacgaacucgaacacauagaagaugccacaauaaaacuccaacgccucaccgcacuccucacaccccaguucagugcgaccaagaaacaaaaagacgaagucgucaccguaguuaaaccauucgaaguacuacugccgaaaauccuuauaaaccaacgauucuaugauggaggacaagaacucacccucgcauccgccacguacaaaaacaacgcacaagaauuaguccuagacaagaaagccgugcagguacucaacggacaacuaccgaaagccgagcucgaagcacaagcgacaguaguauaugaccaaauacuugaacgcguucaaaaauauuucccccucuacgacaugaauagcuuccgugagaaacucuucguaggccgggacaaauucaacgaacugcccuggcaagaucagugggaaaaccauaaacucauccaagucggccagaaaaccaucuuagaccggauucuaaucggacuacacgccaacgcagcaaugggggaucucaaagcacuaaauaugagcacgccauucggcaaacuccagaaaagcaacggaaucucacucuccccagaaacccaaauaauauaccaaucacccaccggacuguucgagcgcaggguggcacuaaaagaccuauga

SEQ ID NO: 6564 - RNA, 4095 nt, Artificial Sequence
  Cas9 variant
augaaaaaccuaaaagaguauuauaucggccucgacaucggaacggcaucgguagggugggccguuaccgacgaauccuacaacauccccaaguuuaacggaaaaaagauguggggcguacgccucuucgacgacgcgaaaacagcugaagagcgcaggacccagcgcggcucgcgccgccgccucaauagacgaaaagaacgaaucaaccugcuccaagaccuauuugcaacggaaauaagcaagguagacccgaacuucuuucuccgacucgauaacucagaccuguaccgcgaagacaaagacgagaagcucaaaagcaaauacacccuauuuaacgacaaggacuucaaggaccgcgauuaccacaagaaauacccaacaauacaccaccuaaucauggaccucaucgaagacgagggcaagaaagacauccgacuucucuaccuggcgugccauuaccuccucaaaaaucggggccauuucaucuucgaggggcaaaaguucgacacaaaaaacagcuucgacaaaucaauaaaugaccucaaaauacaccuacgcgacgaguacaacauagaccuggaguucaauaacgaggaccucaucgaaaucauaacggacacaacccucaacaaaaccaauaaaaaaaaagaacucaaaaacaucgucggcgacaccaaauucuugaaggcuauauccgcaauuaugauaggcaguagccagaaacuagucgaccuguucgaggacggggaauucgaagaaaccacugugaaaaguguagacuucucgaccacagcauucgacgacaaguacagcgaauacgaagaggcgcugggcgacaccauaagccugcuaaauauccuaaaauccauauacgacucaagcauacucgaaaaccugcugaaagacgcggacaaaagcaaagacggcaacaaauacauaagcaaagccuucguaaagaaauucaacaagcauggcaaagaccucaagacacugaagcgcauaauuaaaaaguaccugcccuccgaauacgcaaacaucuuccgaaacaaauccaucaacgacaacuacgucgccuacacaaaauccaacauuacaagcaauaagcgcaccaaagccagcaaauucaccaagcaagaggacuucuacaaguucaucaagaagcaccuugacaccauaaaggaaacaaagcugaacagcagugaaaaugaggaccucaaacugaucgacgaaaugcugacagacauagaauuuaaaacauucaucccgaaacucaaguccucagacaauggcgugauuccguaccagcugaaacuaauggagcugaaaaaaauccuggauaaucagucaaaguacuacgacuuccucaaugagucagacgaguacggcaccgugaaagacaaaguugaguccauaauggaguucagaauacccuauuaugucgguccccucaaccccgacuccaaauacgcauggaucaagcgagagaacaccaagauaaccccauggaauuucaaagacaucguagaccuagacucgucacgugaggaauucaucgaucgccucauaggacgaugcacauaccucaaagaggagaaaguccuccccaaagcaucacuaauauacaacgaauucaugguucuaaaugagcucaacaaccugaaacucaacgaauuccucauaacagaagagaugaagaaggcgaucuucgaggagcuauucaaaacgaagaagaaaguaacccuaaaagcagucucaaaucuacuaaaaaaagaguucaaccuuacgggcgacauccuccuauccggcacugacggcgacuucaaacaggggcucaauuccuacaucgacuucaaaaauauaaucggugacaaagucgaccgagacgacuacaggaucaaaauagaggaaauaaucaaacuuaucguacuauacgaagacgacaaaacauaccuaaaaaagaaaauaaaaucggcguacaaaaacgacuucacagacgacgaaaucaagaagauagccgcacugaauuacaaggacuggggaaggcugagcaaacgauuccuaaccgguaucgaaggcguggauaaaaccacaggcgagaaaggaagcauaauauacuucaugagagaauacaaccucaaccuuauggagcugaugagcggucauuacaccuucacagaggagguagagaaacucaacccggucgaaaaccgcgagcucugcuaugagaugguagacgagcuguacuugucuccgagcgugaaaaggaugcuuuggcaaaguuugcgcguugucgacgaaaucaagcguaucaucggcaaagacccaaaaaaaauauucaucgaaauggccagagcgaaagaagcaaagaauagccgcaaggaaagccgaaaaaauaaacuacuagaguucuacaaauucggaaagaaggcguucauaaacgaaaucggcgaggaaagauauaauuaucugcucaacgaaauaaacagugaggaggaauccaaguuccgaugggauaaccuauaccucuacuacacgcagcuaggccggugcauguacagccuugaaccuauagaccucgccgaccucaaauccaacaacaucuaugaccaggaucauaucuaccccaagagcaagauuuacgacgacucguuagaaaaucgaguccuagucaaaaagaaccucaaccacgaaaaaggcaaccaauauccgauacccgagaagguucugaacaaaaacgcauacggauucuggaaaauccucuucgacaagggccuuaucggccaaaaaaaauacacccgacugacaagacggacacccuuugaagagagagagcucgcggaauucaucgaacgccagauuguagaaaccaggcaagcaaccaaagagaccgccaaccuccugaaaaacauaugccaagacagcgaaaucguguacucgaaagccgaaaacgcgagccgauucagacaagaguuugacauaauaaagugccgcaccgucaacgaccuacaccacaugcacgacgccuaccuaaacauagucguaggcaacguguacaacaccaaguucacgaagaauccccugaacuucauuaaagacaaggacaacguacgaaguuacaaccucgagaauauguuuaaauacgacgucguaagaggcagcuauacggcguggaucgcugacgacuccgagggcaacguaaaggcggccaccaucaaaaaaguaaaacgcgaacuagaaggcaagaauuaccgcuucacgcgaaugucguacauaggaacgggagggcuguacgaccagaaccugaugcgcaaggguaaaggccaaauaccacagaaagaaaacacaaacaaaucaaauaucgaaaaauacggggguuauaacaaggccucgagcgcguacuucgcccuaauagaaucagacgggaaggcuggccgagaacgaacccuggagacaauaccgaucauggucuacaaccaggagaaguacgguaauacagaggcagucgacaaauaccucaaagauaaccucgagcuacaggacccaaaaauccuaaaagauaagaucaaaauaaacagccuaauuaagcuagacggcuuccuguacaacaucaaggguaaaaccggcgauagccuuaguaucgcgggcagcgugcagcucauaguaaacaaggaggagcagaagcucauaaagaaaauggacaaauuucugguaaagaagaaagacaacaaagacauaaaaguaacaagcuucgacaacaucaaagaggaggaacuaauuaaacuguauaagacccuaagcgauaagcugaacaacgggauauacuccaacaaacgaaacaaccaggccaaaaacauauccgaagcccuugacaaauucaaagagaucaguauagaggaaaagaucgacguucucaaccaaauaauccuacuguuccaaaguuacaacaacgggugcaaccuuaaaucgaucggauuauccgccaaaacggggguagucuucauacccaaaaaacucaacuacaaagaaugcaagcuuaucaaccagaguauaacaggccuuuucgaaaacgaaguagaccuccuaaaccuguga

SEQ ID NO: 6565 - RNA, 4098 nt, Artificial Sequence
  Cas9 variant
auguacaagaaagauuacaccgucggccuagacaucggauccacuuccgugggauuugcugcuaucgacgacgacuaccaaccaauacgacuuaaaggaaaacgugugaucggaguucgacucuucgaagagggcaaaacagccgcagagagacgcaacuucagaaccacacgccgccgccuuaaccgucgaaaguggcgucuaagccuccuggaggaaaucuucgauccguacauggccaaagucgauccgacauucuucgcccgacugaaacagagcaaccucuuccccaaagacaaaaauaagaaauucacagguucacuccuguuccccaaaacaaccgacucgaaauucuacgacgaauacccaaccauauaccaucucagauaccaccucaugaacgacucccguaaguucgaccuccgcgaaauauuccuggcgauccaccacauugucaaauaccggggcaacuuucucaacuccgcucccauagcaucuuucagcaccgacaaaauaaaccuuguagacgacuucgagaccgugaacgcagccuaccuucagaucaauagcagcaaccccguccaacucgacacagaccaagccgaucaaguaucgcgaauacuccucgacaacaaacucagcaaccucgacaaacaaaaacaagccgccaaggcccuagcacagaaaagcggagacaagaaacaagacaaaauaaacaacacgacaauaaaacaaaucuguaaagcgcuauuaggcuacaaguucgaucuagcugucguacugaacauugacucggacgaccauaacaaauggaagcuacagcuauccgacgaaaacaucgacagccgccucgcagagcugaccggagaacuaaaugaagcacaacuagacauccuaaacguccucagccgauuauacucgcaaauaacccuaaacgacaucguccccuccgguaugacccuuuccgaagcaaugauagaaaaguauaaagcacacaagaaacaccugaaaaugcuaaaagacuucgcccgcucucuaucgaagaaagacuacggacaaguuauggaggcguacgccgaauacauagggaacauaccagaauccgccagcagcaaagcccaaaagaagaucucccaggacgacuucuauaaaaagauaaaacgcuaccucgaugacucgaaacuaggccagaaaaucgcagagcuaauagccaagaacgaguucaugcccaaacaacgcaccaaucaaaacgguguaauaccauaucagcugcaccucaaggagcugaaccagauaauugagaaccaaucaaaguauuacccauggcuggccgaacucaaccccaacgagaaacgcagaggaaaggccaaauacaaacucuccgaacuggucgcuuuucggaucccuuacuacgucggcccccucauaacucaggaggaacaacagaaaaccucaaacgcuaacuucgccuggaugauacgcaaaucugaaggcaggauaacgcccuggaacuucgaugaaaaagucgaccgcaucgcgaccgccaaccgauucaucaagcggaugacaaccaaggacacauaccuaaucggagaagacguacugcccgcccacucacuccuauacgagcgauucaagguacuaaacgaacucaacaugauccgggucaacaaccaccgccucuccguaggccaaaagcaagacguauucgagaaacucuuccaaaaacacaagacggugaagacccgcgaacugaucaagcaauuaauggcaagcggccuaccuacacaaccacgaaucacaggccuguccgaccccgcaaaauucaacacuagccucggcaccuacaacaacuucgccaaaaucuuaggggacgaaaucaaucagccagauagacaggaagacuucgagaaaauaauugaauggaucaccauuuucgaugacaaggacauccugaaaacgaaacuauccgaauuaagcuggcucgacgagaagcaaaucaacgccuuaaucaacaagaacuauuccggauggggacgccucagcagaaagcuccuaacugagcugaccaacaagaaaggacaaagcaucaucgaccgaauguggaacacccaaaaauccuuuauagaaaucaucaacgagcccguauucgcagagcaaaucaaagacgcaaaccaagaccaacuagacgaagacgauuaugaaacgguucuacacgacgcauacaccucaccacagaacaagaaagccauacggcagguaaucaaaguagucgacgacauaguacgcgcagccggacgggccccuaaauucauaucucuggaguuugcccgcgaagaccaagaaucccggagaacccaaagccggcuaucgcgaauuaagaaaaucuacgaaaccacaacaaaagaacucguagcaaaugaccaaauacgagaggagcugggcaacgucaaagaccuaaacgacagauuauuucuauacuucacacaacucggccgagacgccuacacgggagaaaggaucaacaucgacgacaucucaacaaaauacgacaucgaccacaucuucccuagagccuucauaaaggacgauagccucgacaacaaaguccuaguaaaacgcgcggucaacaauggaaaauccaacaaugucccccuuaaacuuuucggagcaaagaugaaaccaaucuggaaaauguggaaagaccaccaacuaaucucaaaaagaaaauacgaacaccuuaugacaaaccccgaugcaauagauaaauacaaggccaacggauucauaaaccgccagcuuauagaaacccgccaaauaaucaaacucgcagcgaauaucuuagcuaaccguuacagcaccgaggacacaaagauaaucgaggucaaagccaaccugaaccaccagcuacgacagucacuacaucuguauaaaaaucggcaagucaacgacuaccaucacgccgucgacggauaucucuccgcauucguaggccaguaccuguaccaccgcuacccaucgcuccagucauacuucgucuacggccaauaccaacguuucuucgacaagcaaguacaagaaaacaugaaauucaaccgcuucaacuuucucuacgaucucaccgaccgcgacaacgaccagauugucguaaagaguacgggcgagaucguaggggaaaaauccaaacuaaucgagcagauaaaaugggucuacagguacaaauucaugcugguuagccaagagguauucaccaaaacuggcccacucuucgaccaaacgaucuaccccgcgggaagcaauaaaagccgucucaucccuaucaagaaagaccggcccacagacauauacggcggauacucuuccuccacagacgcguacaugucacuaauccgaguacccgacaagaaagaagacaaauacaaagugguaggcgugccgucccgcucacucgcgagcuuaaaccgagcagagaaacgaggccacgaugcauaccucgaucaacucagacaagucaucgccaagagucaaaagaaggaguuccaaaucaucauucccaaauuaagauaucgacagcucaucaucgaugggggucuaaaguacacccucgggucgucagccuaccaauacaacgcacgacagcuaguacuuagcgaaaagagcauggaaguucucguaacagauuuuuccaagguaacgacagaccucgacaaacagaaccagaaacuaaucgccguuuacgacgacauccuagacaaagugaaucguugccucccacuauacgacaagaaccaauuccgcaaagcucugaauggagcacgggacaaauucguccaacuccccauccuaccgaaauucaacgguaauaaaaaggaagaagcgggcaaggucgagauacucaacgagauccuguuaggacuccaugacgacgcaagcacaggaaaucuaaaaccacugggaaucaagacgcccuucggcauguuacaaacccaauccggcaucaccauguccuccaaugcagucaucguaaaccaaagccccaccggccuauucgaacaccgcauuuaccuaaaagcauuacuaaacaaacucaauaaauga

SEQ ID NO: 6566 - RNA, 4098 nt, Artificial Sequence
  Cas9 variant
augaccaaauugaaccagcccuacggcauaggccuagacaucgggaguaacucuaucggcuucgcaguagucgaugcuaacucacaccuccucagacucaagggggaaacggcaauaggugccagacucuuccgcgaaggucaauccgccgccgaccgucgcgguucacgaacuacaaggcgccgcuugagccgaacacgcuggcgucuaucuuuccuacgcgacuuuuucgccccacacauaacuaaaauagaccccgacuuuuuccugcggcaaaaauauucugaaaucagcccaaaggacaaggaccgcuucaaauacgaaaaacggcuuuucaacgaccgaaccgacgcagaguucuacgaggacuacccuaguauguaccaccuccgacuucaccucaugacacacacccacaaagcagauccccgcgagauauuccucgcuauccaccauauccucaaguccagaggacacuuccuuacccccggggcagcaaaggacuucaacacggacaaaguggaccucgaagacauuuuccccgcacucacggaagccuaugcccaaguuuauccagaccuagaacugaccuucgaccuagcaaaagccgacgacuucaaagcgaaacuguuggaugagcaagcgacccccuccgacacacaaaaggcccuaguaaagcuacuccuaucaucagauggcgaaaaagagauaguaaagaaacgcaaacagguccuaacggaguucgcaaaggcuauaaccggccuaaaaaccaaguuuaaccucgcacucggaaccgaggucgacgaagcagaugcguccaacuggcaauucucgaugggccagcuugacgacaaguggucaaauauagaaacguccaugacagaccaaggaacggaaaucuucgaacaaauacaagaacuguaccgcgcccgacuacucaacggcauaguccccgccgguaugucccuaucccaagcaaaaguagccgacuauggccaacacaaagaagaccucgaacucuucaaaacauaccuuaagaaacuuaacgaccacgaauuagccaaaaccauuagaggccuauaugaucgcuacaucaauggggaugacgcaaagcccuuccuccgcgaagacuuugugaaagcccuaacaaaggaagugacagcccacccuaacgaaguauccgaacaacuccucaaccgcaugggccaagccaacuuuaugcuaaagcagcgcacaaaagccaauggagcaauaccggugcagcuccaacaacgggaacucgaccaaaucauagcaaaccaaucgaaauacuaugauugguuagcaaaaccaaacccgguagaaaaacaucgcgccaguaaaccguaccaacuagaugagcuccucacuuucagaauccccuacuacgucggcccccuaaucacucccaaacaacaagccgagagcggagagaacgucuucgcauggaugguacgcaagaacccaaguggcaacauuaccccguacaacuucgacgaaaaaguagacagggaagcgagcgccaacaccuucauacagcguaugaaaacaacagacaccuaccuaaucgacgaagacguccuuccaaaacagagccugcucuaccaaaaauaugaaguccugaacgaacucaacaacguucgcauaaacaacgaagcccucucgacggaucaaaaacaacggcucauucacgaaguauucgaacgacacuccagcguuaccauuaaacaaguagucgauaaccucguugcacacggcgacuucgcccaacgccccgagauacgcggccucgccgacgaaaaacgcuuccuaagcucccucuccacguaccaccaacucaaggaaauacuccauggcgcaauagaugacuccacaaaacuccaugacaucgagaacaucaucacauggucaacugucuuugaagacgcugccaucuuuaaaaccaaauuagcagagaucgacuggcuagacccugccacgaucaagaaacuuagcaacauucgcuaucguggcuggggccaauuuucccgcaaacuccucgacggccuaaaacucggaaacggccauaccgugauacaggaacuaaugcuaucuaaccacaaucucaugcaaauccuagcagacgaaacguugaaagaaaccaugacugaacugaaccaagauaagcucaaaaccgacgacauagaggacgucaucaacgacgccuacacaagccccucaaacaaaaaggcccuacgccaaguacuacgcgucgucgaagacauaaaacaugccgccaacggacaagacccaagcuggcuguacaucgaaacugcagacggaacgggcacugcgggcaagagaacucaauccagacagaaacaaauccaaaccguauacgccaaugccgcccaagaacuaauagauagugccguacggggagagcucgaagacaaaaucgccgacaaagccucauuuacagaucgacucguccuuuacuuuaugcaagggggaagagauauuuacacgggcgcgcccuugaacauagaucaacuuucacacuacgacaucgaccacauucucccucagucccucauaaaggacgacuccuuggacaaccgcguccuuguaaaugcaacgaucaaccgcgagaaaaacaacgucuuugcaagcacccuguuugcaagcaaaauggccgcaaccuggcggaaauggcacgaagccggacuaauauccggccgaaaacuccgaaaccuaaugcuuagaccggacgaaaccgacaaauucgcccacggauucguagccaggcaacuuguugaaacaaggcaaauuaucaagcucacagaacaaauagccgcggcucaauaccccaacacaaaaaucaucgccgucaaggcgggucucagccaccagcuacgcgaggaacuggacuuccccaagaacagagacgucaaucacuaccaccacgccuucgacgcguuccucgccgcccgcauaggaaccuaccuacuaaaacgcuauccuaaacuagcgcccuucuucacguacggagaguucgccaaagucgacguaaagaaauuccgggaguucaacuucauaggcgcacucacccaugccaagaaaaacaucaucgcgaaggacacuggggaaaucguuugggacaaggaacgcgacauacaagaacucgacaggaucuauaacuuuaaacggaugcuaauaacccacgaaguccauuucgaaacagccgaccucuucgaccagaccaucuacgcugcaaaagacucgaaagaacgcggaggaagaaugucccuaauaccuaagaaacuaggauaccuaacaggcaucuauggcgguuaccaaaccgaacggggguccuacguaucaauaauccgcacauucaagaaaggcgagacaaucuauaaaguaguaaacauacucacugccgacgugucacuccuuucugaaaaggaaaagguguccaaaacacucgccgacaucuaccuaaaagagcucaucgccaagaaacucucaaaaggaaagagcgguaaaaacaucgcuuccgaaccguuugaaaucguccuaccccgaguugggaaggauagccuguuuaagaacaagaaauacgggcucuuucuaauagagucagccaccgaacuccacaacuaucaagaacucuggcuaccgcgcaaugaucaacuacuuaucaaacguauacaagcgcgccagauagaagagagcaaagcagacuaugaacuuacucggauguaccguaacaucgccuggcagguagaccacuacuuccgucucuacaagauacguaaauucgcugaaaaacugcaggcuucggucgaagacuucgcgggacucccagucuacaaaaacgaaaccagcgacggaaaagucgaaguucuggcguccguccuaaaacgccucaacggagccgccgacaaaggcagaaccaaucccaccaccgucaaacuccaauccgacuucggccggacacuccuaacuaacggaauuguccucgaagacgacucaaguaucgucuaccaauccccuacaggccuauucaaacgaucagucaaacuugucgaccuauga

SEQ ID NO: 6567 - RNA, 4098 nt, Artificial Sequence
  Cas9 variant
augaccaaagaguacuaccugggccuugacguaggaacgaacuccgugggaugggcggucacggacucgcaguacaaccugugcaaauucaagaagaaagacaugugggggauaagacucuucgaauccgcuaacacagcaaaagaccggaggcugcagcgcgggaaccggagacgccuagagcguaaaaagcaacgaauagaccuccuacaagaaaucuuuagcccagaaaucugcaaaauagaccccacauucuuuauaaggcucaaugagucgcgacuccaccuggaagacaaaucgaacgacuucaaauacccgcuauucaucgagaaagacuacagcgacaucgaauacuauaaggaguucccaacgaucuuucaccuccgaaagcaccuaauagaguccgaggaaaaacaagacauccgccuaauauaccucgcccugcauaacauuauuaagacccgcggccacuuccucaucgacggagaucuacagucagcgaagcagcuccgcccgauacuggauacauuccugcuuagcuugcaagaggagcaaaaccuuagcgucagcuuaagcgaaaaucagaaagacgaauacgaggagauccucaagaacagaucgaucgccaagucagagaaagugaagaaacucaaaaacuuauucgaaaucuccgacgaguuagaaaaggaggaaaagaaagcccagucggccgucauagaaaacuucugcaaguucaucgucgggaacaagggcgacgugugcaaguuucuacggguaucaaaagaggaacuggaaaucgacaguuucagcuucuccgaggggaaguacgaggacgacauagucaaaaacuuggaggaaaaaguacccgagaaagucuaccuguucgaacaaaugaaggcaauguacgacuggaacauccuagucgacauccucgaaacagaagaauacaucagcuucgcgaaagucaagcaauacgagaaacacaagaccaaccuacggcuccuccgagauauaauacuaaaguacugcacaaaagacgaguacaaccgaauguucaacgacgaaaaggaagcuggaucauacaccgcauauguagggaaacuuaaaaagaacaacaagaaauauuggauagaaaagaaacgcaacccagaagaguucuacaagagcuuggggaagcuccuggacaagaucgaaccccugaaggaggaucuggaagucuuaaccaugaugauagaagagugcaaaaaccacacgcuccuacccauacagaaaaacaaagauaacggggucaucccacaccaaguacaugaaguagaacucaagaaaauccuggagaacgccaagaaauauuacaguuuucuaacggagaccgacaaggacggcuacucggugguccagaagaucgagucaauuuuccgguuccgaauaccauacuaugugggcccauuaagcacgcgccaccaggaaaagggcagcaacguguggaugguaagaaagcccggucgugaagacagaauuuacccauggaacauggaggaaauaaucgacuucgaaaaguccaacgaaaacuucaucacccgcaugaccaacaaaugcacauaccuaaucggagaggacguucugcccaaacacagccuccucuauagcaaguacaugguccucaacgaauuaaauaacguaaagguacgaggcaagaaacuacccacuucucugaaacaaaaagucuucgaggaucuuuucgagaacaaaucgaaagucaccggcaaaaaccuccucgaauacuugcagauccaagacaaggacauucagauagacgaccugagcggguucgacaaggacuucaaaaccagucuaaaauccuaccuggacuucaagaaacagauuuuuggcgaggaaaucgagaaagagucaauacagaacaugaucgaagacauuaucaaauggauaaccauuuacggcaacgacaaggaaaugcuuaagcgaguaauccgagcgaauuacuccaaccagcugacagaggaacaaaugaaaaagaucacaggguuccaguauagcggcuggggaaacuuuagcaaaauguuccucaaaggcauaucgggcuccgacgucucaacgggcgagaccuucgacauaauaaccgccaugugggagacagauaacaaccuaaugcaaauacucucgaaaaaguucaccuucauggacaacgucgaagacuucaacucaggaaaaguuggaaaaauagacaaaauaacuuacgacagcacagucaaagagauguuccucagcccagaaaacaaacgggcaguauggcaaaccauccaaguagccgaagagauaaagaaaguuaugggaugcgaaccgaaaaagaucuucaucgaaauggcacgaggcggagaaaaggucaagaaaaggacaaaaagccgcaaagcccaacuacucgaacuauaugcagcaugcgaggaagauugccgagaacuuaucaaagaaauagaagaccgcgacgaacgcgauuuuaacuccaugaaacucuuccucuacuacacccaguuuggcaagugcauguacucgggcgacgacaucgacauaaacgagcuaauaagagggaacucaaagugggacagagaccauaucuacccacaauccaagauaaaggacgacucaauugacaaccuuguccuaguaaacaaaacauacaacgcaaagaaaagcaacgaacuccugagcgaggacauucagaagaaaaugcauucauucuggcugagccuucuuaacaaaaaguuaaucaccaaguccaaauaugaccgccugacgcggaaaggcgacuucaccgacgaggaacuaucaggcuucaucgcucgccagcugguugagacacgccaguccacaaaggcgauagcggacauauucaaacagaucuacagcagcgagguggucuaugugaagaguucccuggucagcgacuuucgcaagaaaccgcuaaacuaccugaaaucacggagaguaaacgacuaccaccacgccaaagacgcuuaccucaacauuguaguagggaacguuuacaacaagaaauucaccucgaacccgauacaguggaugaagaaaaacagggacacgaacuauucacucaacaaagucuucgagcacgacgucgucauaaacggcgaagugaucugggaaaagugcaccuaccacgaagauaccaacacauacgacggcggcacgcucgaccggauccgaaaaaucguagaaagggacaacaucuuauacaccgaguacgcauacugcgaaaaaggagaacuguucaacgcaacaauacaaaacaagaacgggaacagcaccgucucacuuaagaagggcuuagacgugaagaaauacggaggcuacuuuucagcaaacaccagcuacuucagccugaucgaguucgaagauaagaaaggcgaucgggcccgacacaucauagguguaccgaucuacaucgccaacaugcuagaacacuccccgagcgcuuuccuggaguacugcgaacagaaaggauaccagaaugucaggauccugguggagaaaaucaagaaaaacagccuacucauaaucaacggcuacccgcuccgcauaaggggcgaaaaugaagucgauacuagcuucaaacgggcgauacagcugaagcucgaccagaaaaauuacgagcuaguacggaacauagaaaaauucuuggaaaaauaugucgaaaagaaagggaauuaccccaucgacgaaaaccgcgaccacaucacacacgaaaagaugaaucagcucuacgaaguacuucucagcaaaaugaaaaaguucaacaaaaagggcauggcggacccaucggauaggaucgaaaaauccaaaccgaaguucaucaaacucgaggaccuaaucgacaaaauaaacgucauaaacaaaaugcugaacuuacugcgaugcgauaaugauacgaaagcggaccucucccuaauagaacugcccaagaacgcaggaucauucgucgucaagaaaaacacaauaggcaaaucaaaaaucauacucgucaaccaaagcguaacaggacucuacgaaaaucgccgggagcucuga

SEQ ID NO: 6568 - RNA, 4098 nt, Artificial Sequence
  Cas9 variant
auggacaccgcaaaaacaaacaaacagcccuacuacauaggccuggacaugggaaccagcagugugggcugggccgucacagacgccuccuauaacgucgucaagaaacacggcaaagccuuguggggcgucagguuauuugaagaggcgcagaccgccgcagaccggagacuacaccggaccgccagaagacgcauucagcgaagaaaacagcgccuggcccuacuccaggagcuauucgccaaagaaaucugcaagguugacccgggcuucuucauacggcuacaugaaucgcggcucuggcaagaggacaaaucuaucgaccaaccgaacacccuguucaacgacgaggauuucgacgacaaagccuaccacaaagccuauccaacgaucuaccaucugcgcuacgcccucaugacggaaaacaaauccuucgacguccgucuaguauaccucgccauucaccacaucaucaagcaccgcggccacuuccuucuggagaacuacgaccucagcaaccaagagacaagcggcuucgaugaaucuuauauagcacugacgaaugcaaucaaagaacuccuccagaaagaaauccccguugggcacgucgaaaagauacagauaauccuaaaggacaaaucccucagcaaacgagaaaagacagagaaaauacuccaaguuugggacguuauaaaagauaaacagcucaaagaaguaguucagcugauaugcgggggaacagcaaaccucucaacccucuucauggacgaaucccucaaagaagcacucaaaguuuucgaaauaaaagacucaaaaaucagcuucaguacagcaguauacgaagaaaaagaaucugaccuccagaguguccuagagcaacgguucgauuuaguuuacgccgcaaagaugcuuuacgacuggagccuccuagcggaacucaugggcgacagaaaaacgcucagcgaggcaaagaucgcaauuuacgaaacccacaagaaagaccucgaaguccuuaaacggcuaacccgacaagacaaaucccuauaucgcaaacucuuccgagggaccgauaaagacucguauuccgcauacguaggcagcugcaugauacacggcgagaaacucgucaucgagaaaagagggagcaccgaagaguucuacaaauuccuaaagaaagaaaucagcaaacucccugacugcgaagacaaaauauacguccucucaaagaucgaagcagaaaacuuucuaccgaaagcagucaguacgauuaacggaauaaucccauaccagcuccaagagcaagaacuagacaucauccucaaaaaggccgaacaauaccuaccguuuuuaauggaaaaggacgcauauggaaccauauccgagaaaaucaaacaacuccucacuuuucgaauccccuucuacguaggcccgcucaaccgacacucagauaagagcugggcagugcacaccgacaaagaaggcaggauccuacccuggaacuucaacgaaagaauaaacgaagaaaagagugccgaaaaguucaucaccaggaugacaaacaaaugcacguacuuacuuggcaaagacguccuacccaagaacucccuacucuacaccgaauacaugcuguucaacgaacucaacaacguaaagauaggcaaggcuggaaccuaccuaacagaagaacagaaggaaaaacucuggaaggaacuauuucuaaccacgaagaaaguaacccugagcaaauucucuaaauuccuaaucaaagaagggauagacaaggaagaagcggucgaaauaaaaggacuagaugguggguucaaguccucgcuugcacccuggaucgaucucaaaaacauacucggagaagacuucacucgcgacaaagcagaagagauaaucaaggccauaacucuauucagcauggacaagaaaauacuaaagaaauauuuaaugcgaaucgucucagaacccguugcgaaacaacuguccaaacuuagauacacaggcuggggccgcuucaguaaagaguuccugaccgaaaucaccccgaggguaaccgacgacguccaggugcucguagacaccuccacaggagaaaucaugaauaucauuacagcacucaagaaaacaucccugaaccuaauggaaauccuuuccucaaccuacggcuacagugccgcaaucucagaagccaauaaagaacucguaggcaacacgguccuaucauacgaaacugugaaagaacucaccgucagcccagccguaaaacgcccuauuuggcaaacucugaagauaaucaaagaaauaacccacaucaugggcgccgagcccgcgcgcaucuucaucgaaauggcaagagacaagcagccagacaaaggaaggacugacucucggaagaaacaguugauugaacucuacaagaaaugcaaagaagacguccgcagcuggucaaaccgugaaagcaaagacuggguggaagagauagagagcaaauccgauucccagcuccggucaaacaaacuauuccuguacuacacucaaaugggcaaaugcauguacaccgguaaaccaaucgaccucggugcccuacuaaaagggcaacuauacgaccgcgaccacaucuacccacaaagccagacgaaagaugacagccucgacaaccuuguaauagucgacaaccgugaaaaccgggacaaauccaacacguacccccuaucuaagaacauacgagaacggcaaauaggcuucuggaaacuauugcgcgacaaaggguuuaucucgaaggaaaaauacuuccgucucaccagaaacacacccuucucagacgccgaaaaagccgaguucaucgcgcgccaguugguagaaacgagacagagcacaaaagccgucgcggaaauacugaaacgaguacucccaaagagcauaaucguauacgugaaagcaggccugaccagucgauuccgccaauacggcgaguucaucaaaguacgagaucugaacgacuaccaccacgccaaggacgccuaccucaacaucgugaccggcaacguccacuacacgaaguucacaagcaacccaauacgguuugugaaggauugucaaauauauucccucaacgaacacgcgcuauacaaauacaccguagaacgcaacggcgucgucgccugggcgccaaacgaagaagggaugaugccauccgugacuagguggaugaacaagaacaacauccucgugacaagaaugucguacgugggacagggcgaacucuucgaccaguugccccucaaaaagggaaagggucaaguaagucugaagaaagaaggagcaauaucggacaucucgaaauacgggggcuacaacagugccaguaccgccuacuucauguacguagaaggagaagacaacaaaggcaaaccaguauacguaaucgaaaccaugccgcuccacuuagccgcgcgacugacaacccuagaagaaaaacagaaauacugcgaggaacucuggauguccacgggcggaaaacucaaaaaccccaaaguucuuauugagcagauacccauacaaucacuguucagugucgacggcuuuagggucacaauagccggaaaaaccggcaagcaguacggcugccgccucgccgaggagcuaguucugaauaacggguacgcgaugacucuuaaggcggugcucaaauuuguaaaccgacgcaaaaugaacaaagaagcacuaauaacuucguacgaccaccuggaagagucacaacuccuugcccuauacgacgucuuccucgacaaacuggaacacucgugcuucagcaaacgauuuuccacccagcgcgacguccugaagaacggccgagaaagcuacaucgcacucucacuggaagacaagugccaaauucucuccgagauacuccaccucuuccaaugcaacgcaacccugucgaaccuaagccuccucggcagcaguaaacagagcggucgacucuacaugucgaaaaacuuaucagauaaagacucaugguacaucauccaccaguccgugaccggcuucuacgaacaacacaucccgcuagcaccguacaagaaaagcuga

SEQ ID NO: 6569 - RNA, 4098 nt, Artificial Sequence
  Cas9 variant
augguaaagaagaaauaugcaauagguauagauauagguacgaacucaguaggcugguccgucgugacggacgacuacaaaguacccucgaagaaaaugaaagucuucggcaacacugaaaaacgcuauauaaagaaaaaccugcugggaacacuccuguuugacgagggaaauacagcggaaaaccgacgacuaaaacgcacagccagaagaagauacacucgacgacguaaccgcauccuauaccuacaagaaaucuucgcugaagaaauaaacaagaucgacgacucauucuuccagcggcucgacgauucauuucucauagucgaagacaagcaaggcagcaagcaccccauauucggcacuuuacaggaggagaagaaauaccacaaacaguuccccaccaucuaccaccucaggaaacaacucgcagacucaucacaaaaagcugacauacgucuuaucuacuuagcccuagcgcacaucaucaaauaccgagggcauuuucuauucgaaggcgaccucaaaagcgaaaacaaggacguccaacaccuguuuaaugacuucgucgaaauguucgacaaaaccgucgaaggcucauaccucagugaaaaccuuccaaacguagccgacguccuggucgaaaagguauccaaaagccgccggcuagagaacaucuuacacuacuucccaaacgaaaagaaaaacggccuuuucggcaacuuucuggcccucgcuuuaggccugcagccgaacuucaaaacaaauuucgaacucgcggaagaugcaaaaauccaauucuccaaagagacauacgaagaagaucucgaggaguuacuaggaaaaaucggcgacgacuacgcggaccuguucauagcaacaaaaucccuguaugaugggauccuucuagcaggcauccuaucuaccaccgauagcacuaccaaggcgccccuguccuccagcauggucaaccgcuacgaagaacacaagaaagaccuagcccugcucaaaaacuucauccaccaaaaccuauccgacagcuauaaagaaguauucaacgauaaacucaaggauggauacgcaggcuacaucgagggaaaaaccacucaagagaauuucuaccgcuucaucaaaaaggcaaucgagaaaaucgaaggcucggacuacuucaucgacaaaaucgacagggaggacuuccuaagaaagcaacgcacauucgacaacgggagcaucccacaccagauccaccuucaggaaaugcaugcuaucaucagaagacaagccgaguucuacccguuccuaguagagaaccaagauaaaaucgagaagauccuaaccuuccgcauacccuacuacgugggccccuuggcccgaggaaaauccgaguucgccuggcucaaccgcaaguccgacgaaaagauccgcccuuggaacuucgacgaaaugguagacaaggagaccuccgccgaaaauuucauaaccaggaugacuaauuacgaccaguaccuaccggaccaaaagguccuacccaagcacucgcuacucuacgaaaaguucgcgguauauaacgagcucacuaaagugaaguucauagccgagggcaugcgcgauuaucaauuccucgacagcggacaaaagaaagacaucgucaagacccucuucaagaccaaacgcaagguaacagcaaaagacauaaaagcauaucuagaaaacucgaacggguacgcaggcguagaacuaaaggggcucgaagaacaguucaaugccagccuaccgacauaccacgaccuguugaagauccuaagggacaaagcguucauagacgccgaagaaaaccaagaaauccuagaagacauugucuuaacgcucacccuguucgaagaccgggaaaugauucguaaacgccuggaaaaguacaaagacauucuaaccgaggagcaacgcaagaaacucgaacgccggcacuacaccggcuggggacgccucuccgcaaaacucauuaacgguauucuagacaaagucacacggaaaacgauauugggauaccucaucgaugaugggacuuccaaccgaaacuucaugcagcucauuaacgacgacacccucucuuucguggacgaaauccgacuagcccaaggcucgggugaagcagaagacuaccgagcagaagugcaaaaccuagccggcucgccagcgauaaagaaagguauccugcagagucuaaaaauagucgacgagcuaaucgaagucaugggauacgaccccgaacacaucgucguagagauggcaagggaaaaucaguuuacaaaccaaggacggagaaacucccagcaacgauacaagaaaauagaaaaugcgaucaaaaaccuagauucgaaccuaaacucgaaaauacucaaagaauacccgaccaauaaccaagcacuacagaacgaccgucuguuucuauauuaccuacaaaacgggaaagacauguacacggacgaagaacucgacauagaccaacucucacaguacgauaucgaccacauaauuccacaggcauucauaaaagacgacagccuagacaacaaaguccuuaccaagagcgcuaaaaaccggggcaaaucagacgacgucccaucucuagaaauaguccacaagaagaaaaacuucuggaaacaacucuuagacagucaacucauaucccagcguaaauucgacaaucuaaccaaggcagagcgcgggggccuuacaaaugaggacaaggcccgcuucauucaacggcaacuggucgaaacacgacagauaaccaagcacguggcccgcauucuagacacaagauuuaacacuaaacuugacgaagccggaaaccgcauacgugacccuaaaguaaacaucauaacccugaaauccaaccuaguaucacaguuccgcaaggauuaccaacucuacaaaguccgcgaaaucaacaacuaccaccacgcucaugacgccuaccugaacgccguaguggccacggcacuauuaaagaaauacccccaacuugccccggaguuugucuacggagauuaccccaaauauaacagcuacaaaagucgcaaaagcgccacagaaaaaguccucuucuauuccaacaucaugaacuucuuccgucgcguccuaguauacucaaaaaccggcgagguuagaauacgccccguaauagaggucaacaaagagaccggggaaaucguuugggacaagaaaagcgacuuuaggaccguccgcaaaguccucagcuacccacaaguaaacguggucaagaagguggaaaugcaaaccggaggcuucagcaaagaguccauauuacaacacggcgacucagacaaacucauaccucgcaagaccgagaaauucuaccuggacacgaagaaauauggaggguucgacagcccgaccaucgcauacagcguccuacucauagcagacaucgaaaagggaaaggccaagaaacucaaacgagucaaagagcuaauaggcaucacgaucauggaaagaauggccuucgagaagaacccaauagaguuucuagaacauaaaggcuacaaaaacauccuggagaaaaacauaauaaaacucccaaaguacagccucuucgaacuagaaaacggacgccgccggcuccuagccucggcuaaagaacuccaaaagggaaacgaaaugauacuuccuccccaccuuguuacccuacucuaccacagcagcaacauacauaagauaaccgagcccauacaccuaaacuacgugaacaagaacaaacacgaguucaaagagcuacuccggcacaucucagacuuuagcacccgcuacauacuagcacaagaccgucucagcaaaauagaagaacucuacgacaagaaugacggcgaugacaucucugaucugaccagcaguuucgucaaccuccucaccuucacagcaaucggcgcaccagcagcauucaaauuucucgguucggucauagauagaaagcgcuacaccuccaucgccgagauacucgaagccacccuaauccaccaaucagucacaggccucuacgaaacaagaaucgaccuauccaaacuaggaggggacuga

SEQ ID NO: 6570 - RNA, 4101 nt, Artificial Sequence
  Cas9 variant
augaagaaaccauacagcaucggccucgacauuggcacaaacucagucggcugggccgucaucaccgacgacuacaaggucccugcaaagaaaaugaaaguuuuaggcaacaccaacaaaaagacaaucaagaagaaccucauaggcgcucuccuguucgacgcugggaacacugccgccgaccgacgacugaagcguaccgcacgccgccgauauacccgacgccgaaaccggauccuuuaccuacaagagauauucgcagcagaaaugaacaaacucgacgaauccuucuuucaucgccuugacgacucauucuugguucccgaggacaaaggggguucaaaguauccgaucuucggaacgcucgaagaggaaaaagaauaccauaagcaauuucccaccauauaccaccucagaaaaagucucgccgacucaaaggaaaaggcagaccuacggcuaaucuacuuagcacuagcgcacauuauaaaauacagaggccacuuccuguacgaggauaccuucgacaucaaaaacaacgauauacagaaaauuuucaacgaguucacauccaucuacaacaacaucuucgaagaauccagccucagcaacgagaacgcccaaguagaggagaucuucacagacaagaucucaaagagcgcuaaaaaggaccgaguccuuaaacucuuccccgacgagaaaucuaccggccucuucuccgaauuucuaaagcucauugugggaaacaaggcagacuuuaagaaacauuucgaccuggaagaaauggcaccccuccaauucaguaaagacaccuacgacgaagaccuggaaucacucuuaggacagauaggagacgacuacgcagaucucuucgucgucgccaagaaacuauacgacgcgauucuacuagccggcauccuauccgucaaagacccggcaacaaaggcgccccuuucagcguccaugaucgaacgcuacgacaaccaccagaacgaccucucggccuugaaacaauucauccgaucaaaccuacccgagaaauacgccgagguuuucuccgaugacucgaaagacggauacgccggauacaucgauggcaagaccacacaagaaggguucuacaaauacaucaagaaccaaauuucaaaguucgaagggacaaaguauuuucuggagaagauagaacgggaagauuuccugcgaaaacagagaacauucgacaauggauccaucccccaccaaauccauuugcaggaaaugaacgccauacuccaaaaccagggcggauauuacccauuucugaaagccaacaaagagcgaauugagcaaauucuuacauucaggaucccauacuacgugggaccgcucgcacgaggcaacucagacuucgccuggcuuacacggaauagcgacgacgcaauacgccccuggaacuuugaggaagucgucgacaaagccucaucagccgaggacuucauaaacaagaugaccaacuacgaccuguaucuaccagaagaaaagguccugccgaagcauagccuccucuacgaaacguucgcgguguacaacgaacucaccaaggucaaauucaucgccgaggccaugaaggacuacgaguuccucgacuccgggcaaaaacgaaaaaucguagaaaauauuuucaaaaaccaccggaaaguaaccgaaaaggacauaaucaacuaccuucacaaugucgacggcuacgacggcauagagauaaagggaauagaaaagcaauucaacgcgucccucuccaccuaccacgaucuccucaaaaucaucaaggacaaagaguucauggauaacccgaagaacggggaaauacucgaaucgauaauccacacccucacgaucuucgaagaccgggaaaugauuaaacagcuccuagcccaauacaacagcgucuucgacgagaaggucaucaaagcacucagccgcaaacacuauaccggcuggggcaagcucucugccaaacuaaucaacggcauacgcgacaagcaaacaggcaacagcaucuuggauuaccugauggacgauggaaaguccaacagaaacuucaugcagcuaaucaaagaugaugggcuaucauucaaagagaucaucgacaaagcucagguugucggggagaccgacaaccuacgucagguaguccagaaccuuccgggcucacccgcgaucaagaaaggcauacugcaauccauaaagcuagucgacgagcuaguaaaaguaauggggucagacccggagagcaucgucaucgaaauggcacgcgagaaccaaacgacaaacaaagguaaaagcaagucacaacagcgccugaaaacucuaucagacgccauauccgaacugggcagcaacauccuuaaggaacacccaaccgacaacauucaacuucaaaacgacagacuauuucuauacuaccugcaaaauggcaaggacauguacacaggagaagcacucgacauaaaccaacuuagcaacuacgauaucgaccacauuauaccccaagcauucauaaaagacgacucacucgacaacagcguccucacaagcucaaaggacaaccgcggaaaaagcgacaacguucccagccuggaaaucguggagaaaaugaaagguuucuggcaacaacuccucgacagcaaacucaucucggaacgaaaauucaauaaucucacaaaagucgaacgaggcgggcuagacgaacgugacaaggucggauucauuaagaggcaacugguggagacccgccagauaacgaaacacguggcgcaaauccucgacgcccgcuucaacgcugaagucaacgaaaagaaccaaaaacugcgauccgucaaaaucaucacgcucaaaucaaaccuagucagcaauuuccgcaaggaguucgggcucuacaaaguccgcgaaauuaacgauuaccaccacgcccaugacgccuaccucaaugcagucaucgccaaagccaucuuaaaagaauaccccaaacuugagccggaguucguauacggugacuaccagaaauacgaccucaaaagauacauaagcagaaccaaagaccccaaggaaaucgagaaagcuacggagaaauauuucuucuacucgaaccuccugaacuucuucaaagacaaggucuacuacgcggaugggacaaucauucagcgagggaacguagaguacucaaaagacacgggggaaauagcauggaacaaaaagcgagacuucgcaauaguccgaaaagucuuaucauacccccaggucaacauugugaagaagacggaggagcagaccgggggcuuuagcaaagaaucaauucuucccaaggggaacagugacaagcucaucccccguaagaccaaaaacauucaacucgacaccaccaaguacggcggguucgauucgcccgucauagcguacuccauccuacucguagcagacguagaaaaaggcaagagcaagaaauugaagaccgugaaaagucucaucggcauaacaaucauggaaaaagucaaauucgaggcaaacccgguagcauucuuggagggcaaaggauaccaaaacguuguggaagaaaacaucauaaggcucccgaaauacucacucuucgaacucgaaaacgggcgacgcagaauguuggcaagcucaaaagaauuacagaaaggcaacgagaugguccuccccuccuaccuucuagcccuacuguaccacgcuaagaaaauccagaaaaaggacgaaccugaacaccuggaauacaucaagcaacaucacuccgaguucaacgaccuccucaacuucgucagugacuuuucucagaaauacguccuagcagagucgaaccuagagaagaucaagaaccucuacaucgacaacgaacaaaccaaccuugaagagauagcaaauagcuucauaaaccuacuaacauucaccgccuucggagcgccagccguguucaaguucuucggcaaagacaucgaacgaaaacgcuacagcaccgugacugaaauccuuaaagcgacacucauacaccaauccaucaccggccucuacgaaacacgcauugaucucuccaaacucggcgaggaguga

SEQ ID NO: 6571 - RNA, 4101 nt, Artificial Sequence
  Cas9 variant
auggacaagaaauacaacauuggccucgacauaggaacguccucaauuggcuucgucgcaacagacgaggacaaccacgucaucagagcaaaagggaaaaacgucaucggagugagauuauucgacgaaggccaaucugcggcagaacgccggggcuuccgcaccacgcgccgucgucuaaaccgccgaaaguggcgacuaaaccuccuaagagagaucuucgaaccacacauauaccccauagacgcgucauuuuucaugcgacaaaaguacucuaaccucagcaaacaagacccaaaccagaaaauugaguucaaagacauccuauucucagauaaguccgacgcagaguucuaccgucaauaccccacaauauaccaucuacgccaagcucuuaugaccgaaaagcgucaauuugaucucagagaaauauaccucgccauccaccacauaguaaaauacagaggacacuuccuggacgaaacccccacggacaaguuuuccuucgaccaacucgaccucacucaagaguucgaacgccugaacguccucuucagcgaacaaaauccagaggagcccuucgaaauaguagucaaucagaaccaauccaucgaggacauccuaucuaaccagucgaugaccgccucggaccgccgcaaacaagcacucgucguguucuaccaacaauccgaaaacaaggaaaaugaaaaacaguacaaagcaaucgcgaccgaaauccugaaccuacugcucggcaauaaagccaagcugaacgucauccuggcucaagaaguagacaaagaagcugcgaaggacuggagccuaagccucucaucagaaaccuucgacgacgaccuagaaaaggcuagcucaggccuaaaugacagccaacuggaaaugguagguauauuugagagaauuuacuccucacuuauacuuaaauccauuauaggggaccacaacucccucuccgccgcuaugguggacaaauucaaaacccacgcacaacaccgcgaucuacucaaagacguaauuaagaacucugacgccaccaaaggagaacagcuacaguuugccuaugaccacuaucuccagagacacucugcugacggaaaagcauacgguaaagacgacuucuauaaagaagucaagaaaaacuuagaugacuccgaugccgcccaacaaauccagcagcuaauagacaccgaccaguuuaugcccaaacaaagaacaaaggcaaacggggcgaucccccaccaaguccagcagaaagagcuagaccugauuaucgaaaaccaaugccaauacuacccguggcuggcagaagaaaacccaaacagcgaacgccacaacgucgcgaaguacaagcucgacgaauuagugagcuuccgaguacccuacuacguaggcccucuuaucucccccgccgacgacgagaccgacccccaagccauccagaauacaaaguucgccuggaugauccgaaaggacgcgcaaggaagaauaacccccuggaauuuugacgacaaaguagaccgcgagaaaagcgcagacaaguuuaucaaacgcaugaccaccaccgacacauacuuaauaggagaagacguacuccccgaccaaucgcucauuuaucaacgcuacaaaguccucaacgaacucaacaacguccgaauaaacggacgccccaucgagguccaaaucaagcagaacauauacacagaucuuuucaagaaauucaaaagcgucagcgucaagaaacuaagaucauaccucgaagagaugucauacuaccccggauccuucaaaaucuccggccucaccaaccccgggaaauuugauaacgggcucaccuccuaccucgacuacaaaaacauacuuggcgacucggucgacgcuaacgacaaaagagcagacaucgaacaaaugaucgaauggaguacaauauucgaagacaacaaaauauucgcgcaaaagcuagaaucaaugaccugguugacagccgaacagcgaaaggcuauaagccguaagagguacaccggauggggccgccuuucaaacaaacuccuuacacaauuaaagaaccaagacaacagauccaucauggaccuacucugggaaacagaagaaaacuucaugaaaauacaauccgcccccgacuucuccaaaaugauugaagcccacaaucaacaauucaucaaaaacgaagccaacauccagcaagucaucuccgaccuauacacaucaccacagaacaagaaagcuaucagacagauccuccugguggucgacgacauacaaaaagccgucggccacgcccccgagcacaucgcaaucgaguucgccaaaggagaagauaaaaacccccgcagaacuauuagccgggaaaugaaaauccaggauguguaccagcaaaucucugacgacauccucgucagcccagaaguacgagcgcagcucaacgagaaaauagaaaaccgccauggccgccucagcgaucgccucuucuuauacuucaugcaaggcgggcgagauauguacaccggcaagccgauaaacauuaacaauaucagccauuacgacauagaccacauccugccgcaggccuucauuaaagacgauucacuggauaaccgcguccugguuagcgauaaacucaaccgagaaaagucagacacagucccccgggaccucuucggaagagaaaugauguccaccugggaaaagauggcggaccgcggccucaucaccaaacgaaaacuugccaaucugaaaaccauaccgggaagcaucgaugcacacaaggcacagggauucauuaaccggcaguuaguugaaacgcgacaagugauuaaacuggccgugggaauuaugauagaccaguaccccgaaacacagaucguaagcgucaaggcgaaccucacccacgaaaugcgcgaaauguucgacuuagucaaaaauagggacguaaaugauuaucaccaugccuucgacgcauaccuuacagccuuuguagggaauuaccucuugcaacguuacccaaagcucgaaccauacuucguauacgacaaauucaagaaauuaaaagaccagaacauaaguaugcgcgacuucaaccuccucuacgaccuuaagaaaaacgaggacgucuaugaccagcgcaccggccacagcgcccacaaaaucugggaucagcacggaucaauagacuacauccgccaccuguucgccuacaagaaaauccucguaagccacgagguacaccaaaacggcggggcccucuacaacaugaccgucuacggcaaagccgacgacgccaaacgaaaauuaaucccgauaaaagccgacaaacccacagagcucuacggcggcuauacaucgcgcaagcuggcuuacauggccauugugaagacgaagaaaggcaagaaagaacaauaccaagucaccgggguccccguauccgcacuaaccaccuuacgccaauuuaaagaagauagccccgaacagaaacaagcacuagaagagaucgugcgccgaaacuucgacgagaaaaccgaaguggaaaucauaguacccaaaguucuauucaaccaacucauaguagacgaaaagugccgcuuuaugguaggauccgacacauaccguuacaacgcccaacaacucguccucuccgcggaugaccucgaaaucauuaacgcgucccacaaagacauccagacaaucgacagcagcgacuacucccaacagcuagaucagguauaccaaaacauccugacaaucguggacaaacauuucccaauguacgacauaaauaaguuucgcacuaaacuccacgacaucuacgaacaguacaucgaacuuccuaacgaggacgucugggaaaacaacaagcucacaacccuuggcaagcacacaaucaucauccgcaucuugcaaggcuuacaugcaaacgcaacagucguugaccucaagcaacuaggcauaaagaccccauucggguuuaugcaacaggcccgcggcaucgucgucagccccgacgcacaacuaaucuaucaaucaccaaccggacuguacgaaagacgagugcgccucggggaccuauga

SEQ ID NO: 6572 - RNA, 4101 nt, Artificial Sequence
  Cas9 variant
augggagaccgcaaauacaaccugggccuugacaucggaacaucaucgauaggauucgcagccguugacgagaauaaccaacccauaagggugaaaggaaagaccgcaauugggguccgacucuucgaggaaggaaaaaccgcagcagaucgccgcggcuuucguaccacacggcgacgucugagccgaagaagauggagaaucaaucuccucaacgggauauucgacgcccaccuggcggaggucgaccccaccuuucuggcacgccucaaagagucaaaccgaucgaaccucgaucccaaaaagucauuucaggggagccuccucuucccggagcgaaaagacuaccaauucuauaaggaauaccccaccaucuaccaccuucgcaaagcccugauggaggaagaccgcaaauucgacauccgagaaauauaccuagccguccaccacauaauaaaguaccgaggcaacuuccucaauggcacaccaaugaggagcuucaaaguagaaaacaucgagcuggacacccuauuugaccgacucaaccaacuauaugaggaaaucaucccagacaacgagcucgcuuucgaccuggagcaaguagccgacguaaaagaaguccuaagcuccacgacaaucuacaaaauggacaaaaagaaacaacucgucaaaaugaugcuccugccaacuuccaacaaagcauugcaaucagaaaacaagaagauagucacacaauucguuaacgcgauacuaaauuacaaauucaaacucgauguacuccuacaaguggaaaccgacgcugacuggucgcuuaaacucaacgacgaaggagcagacgacaaacucgaagaguuuacaggagaccuagacgagaaccgccucgaaaucaucgaucuccuacagcgacuacauaacugguucagucucaacgaaauaaccaaggacggaaauagccucucagcagcaauggucgaaaaauacaaagaucaccgucaccaccuugagcuccucaagaaagucaucgaggaccaucccgacgccaagaaagcaaaagcccuaaaagaaacauauaccgccuacguaggcaaaacagacgacaaaacgcaaaaccaagacgacuucuacaaagcaguagaaaagaaccuggacgacagccccgacgccaaggagaucaagcgccucauccaacuggaccaauucaugccaaaacaacgaacgggacagaacggagcaauaccucaucaacuacaccaacaagagcuggaucaaauaaucgaaaagcaaaguaaauacuauccauuccucgccgaacccaaccccaacguaaaacgccguaaggacgcgccguacaaauuggacgaacuaauagcauucaaaaucccauacuacgucggaccccucgugacgccagaagaacaagcccaaaacggugaaaacguauucgcuuggaugaaacguaaggucgccggcccuauuacgccguggaacuucgacaagaaaguagacagaauggaaucagccaaccgcuucaucagacgcaugacaaccaaagacacauaccuguucggagaggacgugcugcccgcugaauccaugaucuacgagaaauucgucguccucaacgaacuuaauaaccuaaaaaucaacggaagacaucugagccugaaagacaaacaagacauauacaacgaccucuucaagcagcagaaaacaguuucaaucaaggcacuacaaaauuacuaugucaccaagaaaaaggcggcaacagcucccacgguaggcggccuugccgaccccaagaaauuccugucaagccucuccacauacauagacuucaaaaauauguucggagaacaaguuaaugauccacaguuccaagaagauuuggagcaaauaguagaguggaguacaauauucgaagaccgcggcauauucaaggcaaaacugcaggcccucggcuggcucagcgaaaagcaaauacaacaacucguagccaaacgcuauaaaggauggggccgauuauccaaaaagcuacucacaggucucaagaacgccgaaggauacucuauccuagacgaaauguggagguccaccgaaaacuucaugcaaauacagucccgaccugaguucgcugcccugauucaacaagccaacgaaaaacaauucgaaggcaacgacccgaacaacguaugggaaaacauagaaaacauauuaggagacgcauacaccagcccccaaaacaagaaagcaauaagacaagucguaaaagugguccaagauauugaaaaagccguaggaaaucccccagagaaaaucgcuaucgaguucacaagggaagccgcggccaauccacagaggacucaaucccggcuccgaacacucgaaaaacucuacgaaucagccgaggaagucgucgacgcgcgccuuacagcugagcucgccgaguucaaagaaaauaagcacguucuaucagacaaguacuaccucuacuuuacgcaacugggaagggacgucuacacaggugacaccauaucacuggaccggcucaaugacuacgacguagaccacauccuaccccagagcuucauaaaagacgauagcuuagacaaccgaguccucacaauccgcgccgucaacaauggaaaaucagacaacguacccgcuaaaauguucgggaaaaagaugggauccuuuuggcgguaccuacucgauaacggaaugauaagcaaacguaaauacaacaaucuuaucaccgacccagacaauaucucgaaauaugcacaaaaaggauucaucaaccggcaacuggucgaaacgagucagguuauaaaacuuaccgcgaacauccuaaacggcauuuacgacaaagacaccgaaaucauagaggucccugccaaaaugaacucccaaaugcggaagauguucgaucucgucaaaguacgagagguaaacgacuaccaccacgccuucgacgcuuaccugacaaucuucaucgggaacuaccuguauaagugcuacccuaaacuacgcccuuacuucgucuacggaaaauucaagaaguuuucagacaacgaagauaucgaggucggggacggcagauucaacuuucugaaccgcauugaacgccucaaaaaugucaccgaccccgaaacaggggaaauccuauggagcaacguagcccccaacgaaacgaucaaacggaucaagaaaguuuacaacuauaaauucaugauuguaucgcgggagauaacgacccggagggccgagcuauucaaccaaaccgucuacccgaaaaacuaccggggcaaacucauacccauaaaggaggaucgcccgaccgaccucuacggcggguacuccggcaacacagaugcauaccuugccaucguagcgcuagaagacaaaaagaaaggcaaauacuucaaagucgucggcaucccaacacgcgccgcugcaaagcuggaaaaacucaaacagcaagacucacaacaauaccuccaggccguccacgaggugauugcaccacaauucaccaaguccacuaagaaaggcaucaaaaagacggaguuccgcauaguacucgacaaaguccacuaccgccaacugguccaagacgguccagucaaaaugaugcucggaaguuccaccuacaaguacaacgcaaaacagcuaguacuaucagaaaaagcccuacaaguuauaaaggaugaccggaaguucgacgaaacccaaaaagacgauaaccuaaucgcaguauacgacgaaauccucagcaucgucaaccagagcuucgaccucuaugacauaaacggcuuccgcaagaaacucaacgacaaccgcaaucaauucauagacuuaccagccgaaacuaaauaugaaggacgaaaaguggucgcccacggcaaacgcgaaaugauacucgaaauacugaaaggccuacacgcaaacgccucguucggcaaccuaaagcccauaggcuuugccacaccauucggccaaaugcaguccaaaaacggaauagagcuaagcgaaaacgcguuccuaauacaccaauccccauccggccuuuuugagcacaaaauaaaacucagcgaccuuuga

SEQ ID NO: 6573 - RNA, 4101 nt, Artificial Sequence
  Cas9 variant
augaccaaacucggaaaaccauacgggauaggaguagacaucggcaguaacucaauaggcuucgccgcaguggacgaaaauucgcaccugauuagacuaaaaggcaaaaccguaaucggcgccagacucuucgaagaaggcaaagcagcagcauaucggcgcgcaucucggaccacacgacgccgcuuaucacgcaaucgcuggcgcuuauccuuccuccgcgauuucuucgagucucacauuacccccacagauccaaauuucuucaugcggcaaaaauacuccgaaauaucccccaaagacaaggcacgcuacaaguaugaaaagcgccuguucaacgacaggacugacgcagaguucuaccaacaguauccaaccauguaccaccuccgcacccgccugcuaaccgaccccucaaaggccgacguacgugagauauacuuugccauacaucacauccuaaaaucgagaggucacuuccucacgccaggcuaugcaaaagacuucaacacuaacaaaguagcacugaacgaaauuuuuccagcccuccaagacgccuacgcccaagucuacccugaucuagacaucaccuuugacgaaaacaaagugaacgaguucaaaacaguccugcucaacgaaaaagccacccccuccgacacccagcgcgcacuggucaaccuccuacucgccaaagaaggugaucgggacauauuaaagcaacaaaagcaagugcucaccgaguucgcaaaggcugucgucggacucaaaaccaaacuaaacguagccuuaggcacagaaguagacaguagcgaagcuacggcuuggaacuucagccuaggacaacuagaugacaaaugggcggggaucgaauccgccaugacggacgaaggaaccgaaauccuggaccaaauccgcgaccuauauagagcgcgacuucucaacgguaucguacccgcggggaaaacacucucucaagcaaaagucgacgacuacgcccaacaccacgaagaccucgaacuauucaaagacuaucucaaacaacuugaagaugacggaacggcaaaggcaauaaggcaacucuacgaccguuacaucgauggcgacgacgcgaaaccauucgugcgcgaagacuucguaaaagccuuaacgaaagaagucacagcacauccgaacgccaaaagccccgagcuccucgaaaggcuggcacaacccgacuuuaugcucaaacagcgcaacaaagcuaacggggccaucccaguacagaugcaacaacgcgagcucgaccagaucaucaagaaccaggccgucuacuacgacugguuagcagcuccaaaccccgucgaaaaacaccgacaaucaaugaccuaucaacuggacgaacuccucaauuuccgaaucccuuacuacguagggccccuaguaaccgcaaaagaacagaaagccgcccaaggaggcguauucgccuggauggucaggaaagacccagacgguaacaucacaccguacaacuuugacgaaaaaguggaccgcgaagccuccgccaacacauucauacaaagaaugaaaaccaccgacacauaucuaaucggggaggacguccucccaaaacaaucccuccucuaucaguccuacgaaguacugaaugaacucaacaacguacgcgucaacgacaauaaacuuucguucgaccaaaaacagcaaguccuaggcgaacuauuugaaagacacaacaccgucacaaucaagcaauucguagauaaccuccuugcacacggggacuacgaucgcauccccgaaguccgcggacuagcagacgagaaacgauuccuuagcucacugucgacguacaaccaacucaaaggcauccugcacgaggcgaucgacgacgccgacaaacaaaccgauauagaaaacauaaucgcauggucaacaauuuucgaggauaaggccauuuucaagaccaaacuaaacgaaauuucauggcuaaacgcagguaugaucaacucacucgcaaacauccgauaccgcggcuggggccaauuuagccacaaacuccucaacgaacucacacucagcaccgggcggacuguauucgaagaacuguugaucucaucccggaaccucaugcaaauccuaacugacgagguccuaaagcagaaaaucgcugaacucaacgcacacgaacuaaaagccagcggcauauacgccgcuauugacgacgcauacaccucgccaucuaacaagaaagcccuucgccaaguacuaucugucaucgaugacauaaccaaugcugcaggacaagccccgaacuggcuguacaucgagaccgccgacggcgacggaguccccggaaagcgcacaaacagccgccagcgcaagauacaagagaucuacgcaaacgccgcccaagagcuuauaacagggagcguccgcggugaguucgaagacaaaaucgcauccagggcagacuucacggaccgccuaguacucuacuucaugcaaggcggcagagacauauacaccggugagccccuaaacauugacaacuuaucaagcuacgacauagaccacaucuuaccccagucccuuaucaaagacaacagccucgauaaccgaguccucguacacccucuuguaaaccgagagaaagauaccauuuucgccaguacucgauucgcaaaacagaugaacggcauguggcgacaauggcacgccgccggccugauuuccagccgaaaacuccgaaaccugcagaugaggcccgacgaaaucgacaaauacgcaucgggcuucguggcaagacagcuaguggaaaccagacaaauaaucaaacucaccgaacaaaucgucgcagaucaauaccccgacaccaagauaauagccgucaaggcaggccucuccagccaguuaagaaaagaacucgacuucccuaaaaaccgcgaggucaaccauuaccaccacgcuuucgacgcguuccucgcggccagaauuggcacauaccuccucaaacgcuaccccaaucucgaacccuucuucacauacgggaaauucaagaaaacugaagucaagaaacuaaaaucucucaaaagccucaaaucauuuaacuucauaagagacaugacgcacgcaaaagacaaaaucguggccaaggaaacgggcgagauaguuugggacaacgccagugacauaaacgaauuagaccgcaucuacaacuuuaagagaaugcucaucacucacgaaguccgauucgaaaccgccucccucuucaaacaaaccuuguacgccgccaagaacuccaaaaaccgcgggggcuccagacagcuaauaccaaagaagaaaggcuaucuggucgacaucuacgggggcuacacccaagaaaccggcucauaccugagugucguucgacucacaaagaaagcaauguaugccgucgugaaagucagcacccgugacgcagccaaauuagccguagcgaaaucaauauccgaacaaaaagaaaacgagacccuaaagaaaaucaucgacgggaaacucucaaaaacgucaaagaaaggcaaaacaacccaucagcuauucgaaauagugcucccacgcgucggucagaaaacauuauucaaaaacucaaaauacaaucaauuccuaguaaacucggauaccuacaugcacaacuaccaagaacucuggaugccaagagaauaucaacgaauguggaaagacauccuccucuccaaccauggagacgcccaaauagagggacaauuagaccaaaucuucaaauucauaguaucccaaguuaauuccuacuucaaucucuacgacaucaaucaauuccggaagaaaaucgcagacgccacggacaaauuugccaaacuaccuacccacgacacagauaacgcacgcgggaaaauagccacaaucggccaacuccuaauagggcuacaagcaaacgcgaugcgaagcgacuugcggaaccucgacauaaaaaccccauuuggccuccuacaaaucggaaccgggaucacauuagaucuugacacuucuauaauauaucaaagucccaccggacucuuugagcgugaagugccccuaaccgaucuguga

SEQ ID NO: 6574 - RNA, 4101 nt, Artificial Sequence
  Cas9 variant
augaccaaagacuacucacugggacucgacaucggcaccggcagcguaggauucgcggcacucgacacuaauuaccgccugcuacgagccaagggcaacaacgucauagguguacgacucuucaccccagcggaaaccgcggaagaacgacgaggcuuccgcacggcccggagacgacugucgcggcgccgcuggcgccuaggagcgcucaacggcaucuucgcaccagaacuggcaaagguggaccccaacuucuuacaucgccucaaguacgccuggguacaccccgcggaccagcaaaacaagggcaaauacucagccgcaccccuguucaacgacgccgccuuggaccgacaauuccacgacgacuauccgacaauauaccaccugagacuaaaauugaugacugacacuucccagcacgaccuccgagaaguuuaccucgcgauccaccacauuauaaaauuccgcggaaacuuccugcguggcgaaggccccaucaacgcgagcgaagccuucgauaucaacaccuucaucgaucagaugacggccuucuacgaccaggcauucccagacuucaagaucgucgaccaagucgaccaacagaucaucuucaaaggccucacagacaugacgcucagccccgcagaucgagcgaacaaagcacucaugggauucaacaacgccgcucaacagcccaacaaaagaaucuucaaagcgauucucuccggacugguaggcaaccaaguugaccucauggccaucuuccaauuagacgggauaccaaaagaagaccagaaagaguuuaaauucaaauucgucgauaacgacauagaagagaaacuugccgcacucggggacaaccccgcccucuccgaugaacagaaugaguuccucacgacccuauacgcggcauucagcggacugacccucaaaggccuccucggagacgccacauccauauccgcggccaugguggcaagauacgcaucccaccggacggacuggacauacaucaaagaccauguccuuacaccucaaaacaacagagaacuccgacuagcauacgccgaccuaaugaccgacaaugaagacguccgccuuaaagcggggaaaaaguucgccaaagccauagaggccgcagacauaccggcagccaagaaaucggaauuuagccugaaaauagacaacaaugaguuccuaccccgccagagaacgaaggcgaacgggacaaucccgcaccaacuccaccucaaugagcuacaacaaaucauagaaaaccagggacaauacuaccccuuccucaaggccacauuugaacaggacgggcacacacuaaacaaaaucgagggucucguaaaauuccggguccccuauuacgucgggccccucguacccaagcacaaggucgccggcaacaacgcaaaccacuggauggugcccaaagaacccggcgcaaucacacccuggaacuacaccgagaaaguugaccgcgacaaaagcggcaacgaguucauccgccgcaugacgggcacagacaccuaccucuuaggagaacccacacuucccaaaaacagccucguauaucaagaguucaacguucuacaggagcucaacaaccuccgcauagaaaaacgccggcucgacaucgccgucaaacaggauaucuucgaacacguuuuuaaaacgaauaaaaccgucacggucaaacguauugaagaauaccugacaacagaauuuggcuccccgguaacccucagcggcuucgccaacgucaacgaaaggaagcugaacagcagccuaagcacauaccauuacuucgucggaaucuucggggcugaguucguagacgauccgaagaaccuaacccuccucgaacagauaguggaauuacagacaguguucgaagaccgcaaagcacuccaaagacagcucaaacuccgcccagaacucucagagaaacaagugaaacaacuagcacguacacacuacacaggcuggggccgauuaucacagaaacuacuuacgucaaagaucguacacgucgcccuggaaggagaacgcgaaccuggccaauacucaauacuagaaacacucuacggcacacagaugaacuucauggaaauagucaacgacaugaaggaucguuauggaguaaaaagcuggcucgaucaagaaaacuccggcucagaaaauaaccugucccucaaacaacggauacuggacaugcccgggcccaagaauaucaaacgcggaauaaaccaagccuuucauaucaucgacgaaaucacccgcgccgucggcaacgccccaagccgcaucuacauagaguucgcucgagaaucccaacagaguaaccuaacaaacgccagaguaaaccggcugaagcaacucuacucuaaucaagcccucaaaaaggaauuugccaaacucgcuuccgaaauaaaagaccucaccaaagagcaacuaaaagacgaucgccuuuaccuauacuaccuacagcaaggaaaagauauguauaccgagaccgacauugacaucaccaagaucucaucuaacuaccagaucgaucacauuauaccacaagccuacaccaaaaacaacuccuuagacaaucgaguccucgugaacagcgaaaugaacgcacgcaaaucagacucccccacguuccugccaagucuaauccaagagcgcaaagcaugguggagacaguugagagacacggggcugaugaguaccauaaaauacaacaaucugacaagaacgucagacgacuucucagccgaccaaaaggaacgcuuuaucgcucgaucccugguagagacucggcaagucaucaaaaacgucgcaacgcucauuaaggaauacuacgacgauagccaagucgaagcacucccuucagaaauaaccgcggaaaugcgccgauaucugaacgugcguaaaaaucgagacauaaacgacuaucaccacgcccaugacgcccuucuguucgccacagccggcgaguucucuagaaaagucggcaucauggaaaaagggcgcgucuccgacggugccgggaacaucuauaaccgcuacaccaaagacaucauacagcgggcccgcgccaaagccggucaagacaagaaagucagaccguucacguucauagucggcucgauggccaacccugacaccaaauuccaaacuaaccaaaccaccggagaaauagucuggacccccgaagacguagccuaccuccguaaagugauagacuacaagaaaaugcuaguaaccaaaaugacccucgaccaaacagguacguuauacaacgaaacacgcuacggcucaggagacaaacacgucgcgguugcccucucuaaagacaaagcagcggaccucuacggcggcuucggaucucucaaacccgccuacgccgcacugguauacucgaaaaagaaauucaggcuggucaacguccuacgccucuggcucccagaaaucaagaaaaacgcguccguauuagaacgcaaagugcaaagcguacugggcgacgacaaugcgaaagucaucagggcgcacguccccugcggccagcuacugaucaaggacggcgcucucgucacaguaucgagcgcaaccgaauuacacaacuucagacaauuauggcucccaaaagccgacuaucaggacauauccauacuacugggcgcaccugacaaagucacagccgaaaacagacuccaagcugaaucccacuucgacgacgucgaccaacgguuugaaucccuacucaaggacgugauagaccaagcccgccaauacuacccacuuaaaacccaccagacaucccucgaaaaacuuauagggaaaaucggaaaauucgacgaacucaaauuugcccaaaaacaacaaguuuucuccagauugcuaucagcgcuccacgccaaugcaaccaacucagaccugaaacaaaucggccucuccaccgccuggggccgacugaucuacccuaaaggggucagcuuaaccgacgaggacaagcuaaucaacucaucuuucaccggacucuucaaugacguaaugucuaucaaagaauuucacgacuucuccauaaacuga

SEQ ID NO: 6575 - RNA, 4104 nt, Artificial Sequence
  Cas9 variant
augaagaaacaaaaauucucggacuacuaccucggcuucgacauaggcacgaacucaguaggauggugcaucaccgaccuggacuacaacguccuccgauucaacaaaaaggacauguggggaucccgucucuucgaagaagcgaaaacggcugcggagcgccgcguacaacguaacucgcgacgaagacucaagcggcgaaaauggcgccugaaccuacuagaagagaucuuuagcaaugaaauacucaaaaucgauagcaacuucuuccggagacuaaaggaaagcucacuauggcucgaggacaaaucguccaaagaaaaauucacgcuguucaacgacgacaacuacaaggacuacgacuuuuacaagcaguacccuacuauauuccacuuacgcaacgagcuuaucaaaaauccggagaaaaaggacauacgacucgucuaucucgccauccacuccauauuuaaaagccgugggcacuuccuauucgagggccagaaccucaaagaaauaaagaacuucgaaacacuauacaacaaccucauagccuuccucgaggacaacgggaucaauaagauaauugacaagaacaacauugaaaagcuggaaaagauugugugcgacaguaagaaaggacucaaagacaaagagaaagaguucaaggaaauauucaacagcgacaaacagcucgucgcgaucuucaaacucagcguaggcagcagcguaucucuaaacgaccuauucgacaccgacgaauacaagaaaggggaaguggaaaaagagaaaaucucguuccgcgaacaaaucuacgaagacgacaaaccuaucuacuacucaauacuuggcgaaaagaucgaauugcuugacaucgcaaaguccuuuuacgacuucauggugcugaacaacauacucgccgacucgcaauacauaagcgaagcaaaggucaagcuguacgaagaacacaagaaagaucuuaaaaaucuaaaauacaucaucaggaaauauaacaaaggcaacuacgauaaacuguucaaggauaaaaacgagaauaacuacucggcguacaucggacucaacaaggaaaaaggaaagaaggaggucgucgaaaaaucccggcuuaagaucgacgaccucauaaaagucauaaaaggcuaccucccaaagcccgagcgaauagaagagaaggauaagacggucuucaacgagauauuaagcaagauugagcucaagaccauacuccccaaacaacgcaucucggacaacgggacacuccccuaccaaauacaugaaguugaacuugagaaaauccucgaaaaccaaaguaaguacuacgacuuucuuaacuaugaagaaaacgggguaagcacaaaggauaaacuccucaagacauucaaguuucgaauccccuauuaugucggcccacugaacagcuaccacaaagacaagggcggcaacuccuggaucgugaggaaagaggagggaaaaauucugccauggaacuucgaacaaaaaguugacaucgaaaagagcgcagaagaguucaucaaacgcaugaccaacaagugcacauaccuaaacggcgaagacgugaucccaaaggauacguuccucuacucagaauacgugauacugaacgaacuuaacaagguccaagucaacgacgaauuuuugaacgaagaaaacaaaagaaaaaucaucgaugaacuguucaaagaaaacaagaaagucuccgagaagaaauuuaaagaauaucugcucgucaaacagaucgucgauggaacaaucgaacucaaaggcgugaaagacucguucaacuccaacuacaucagcuacauccgauucaaagacauauucggcgaaaaacuaaaccucgacauauacaaagagauaagcgaaaaauccauauuguggaaaugccucuauggagaugacaagaagauauucgagaaaaagaucaaaaacgaauacggagacauacugacaaaggacgaaaucaagaaaaucaauacguucaaauuuaauaacuggggacgacucagcgaaaaauuacuaaccggcauagaguucauaaaccucgagaccggcgaauguuacucgucagugauggacgcauugcgacguacaaacuacaaccuuauggaguugcucagcucaaaguucacccuacaggaaucaauuaacaacgaaaacaaagaaaugaacgaagcauccuaccgagaccuaaucgaagagagcuacguaagccccucgcucaaacgcgccaucuuccagacccuaaaaauauacgaagagauccgcaaaauaacaggacgggugccaaagaaagucuuuaucgagauggcacgaggcggggacgaaagcaugaaaaacaagaaaaucccagcccgccaggaacagcucaagaaacuauaugacagcugcggcaaugacaucgccaacuucaguauagacauaaaagaaaugaaaaacucgcucaucucauacgacaacaacagccuaagacaaaagaaauuguaccucuacuaccuccaauuuggaaaaugcauguacaccggacgugagauagaucucgaucgccugcuccagaacaacgacaccuacgacaucgaucauaucuacccgcgcagcaaagucaucaaagaugacuccuucgacaaccuaguccuaguacuaaagaacgagaacgccgaaaaaucuaacgaguacccagucaagaaagaaauucaggagaaaaugaaaucauucuggcgguuccuaaaagaaaagaacuucaucagcgacgaaaaguacaagcgucugaccggcaaggacgacuucgaacuaagaggcuucauggcccgccagcucgucaacguacggcagaccacaaaggaaguagggaaaauccuccaacaaauagaaccagaaaucaagauaguguacucuaaagccgagaucgcguccagcuuccgggaaauguucgacuucaucaaagugcgcgaacugaacgacacacaccacgccaaggaugcguaccugaacauaguugcggggaacgucuacaacaccaaauucaccgaaaaaccauacagguaccuccaagaaaucaaagagaacuacgacgugaagaagaucuauaauuacgacauuaagaacgccugggacaaggagaacucccuagaaauuguuaaaaagaauauggagaaaaacacuguaaacauaacccgcuucaucaaggaagaaaagggccagcuguucgaccucaacccaauuaagaaaggugagacaagcaacgaaauuaucuccaucaaaccgaaagucuauaacggaaaagaugacaaacuuaaugagaaguacgguuacuacaagaguuugaauccugccuacuucuuauacgucgaacacaaggagaagaacaaaaggaucaaauccuuugagcgagucaaccucguggacgugaacaacaucaaggaugaaaagagucuagugaaauaccugaucgaaaauaaaaagcuaguagaaccccgagucaucaagaaaguuuacaaaaggcaagucauccuuaucaaucacuaccccuacucuaucgucacgcuugacucuaauaaacucauggauuucgagaaccucaaaccucuauuccuggaaaacaaauacgagaagauccucaagaauguuaucaaguuccucgaggacaaccagggcaaauccgaggagaacuacaaguuuaucuaccucaagaaaaaggaccgcuacgagaaaaacgaaacccucgaaagcguaaaggacagauauaaccucgaauuuaaugagauguacgacaaguuccuagaaaaguuagacaguaaagacuacaaaaauuacaugaacaacaagaaguaccaggaacuacuagaugugaaagaaaaauucauuaaacuaaaccucuucgacaaagccuucacgcuuaaguccuuccucgaccucuucaacagaaagacaauggccgacuuuagcaagguuggccugacgaaauaccucggcaaaauacagaaaaucuccagcaacguccuaagcaaaaacgaacucuaccuccuggaagaaagcgucaccggacuauucguuaaaaagaucaaacuguga

SEQ ID NO: 6576 - RNA, 4104 nt, Artificial Sequence
  Cas9 variant
augaagaaacagaaauuuagcgacuacuaccuuggcuucgauauaggaaccaacuccgucgguuggugcgugacugaucuggacuacaaugucuuaagauucaacaagaaagacaugugggguagccgcuuauucgacgaagccaaaacagccgccgagagacgcguucaacguaacagucggcgccgacucaaacgccgaaaauggcgacugaaccugcuggaggagauuuucucggacgaaauuaugaaaaucgacuccaacuucuuccggcggcucaaagaaagcucacuauggcucgaagacaaaaauagcaaagaaaaguuuacccucuucaacgacgacaacuacaaggacuacgacuucuacaagcaguauccgaccauauuccaucugagggacgagcucaucaaaaacccagaaaagaaagacauacgacucauauaccucgcgcuacacaguaucuucaaguccagaggccauuucuuguucgagggucagaaucucaaggaaaucaaaaacuucgaaacccucuacaacaacuuaauaucauuccuggaagauaauggcauaaacaaauccauagauaaggauaauaucaagaaacuugagaagaucauaugcgacuccggcaaaggccucaaagauaaggaaaaggaguucaaagaaaucuucaacagcgacaagcagcuagucgccauauucaaacuaagcgucggcuccagcgucagccuaaaugaccuguuugacacagaugaauacaagaaggaagaggucgaaaaggagaaaauaucauuccgagagcaaaucuacgaggacgacaaacccauuuacuacucaauccuaggcgaaaagaucgaacuccucgauaucgcgaaguccuucuacgacuuuaugguccucaauaacauacucagugacuccaacuacaucucagaggccaaagucaagcuauacgaggaacacaagaaagaccucaaaaaccucaaauacaucauacguaaauacaacaaggaaaacuacgacaaacuguucaaagacaaaaacgaaaacaacuacccagcguauaucggguuaaacaaggaaaaaggcaagaaggaggucgucgaaaagucgggucucaagaucgacgaccucaucaaagugauuaagggguaccugcccaaaccggaacgcauagaggagaaggacaaaacgauauucaacgaaauacugaacaagauagagcucaagacuauacuccccaaacagagaaucagcgacaacgggacccuacccuaccagauccacgaagucgaacuggagaaaauccucgaaaaucaaagcaaauacuacgacuuccuaaacuacgaagaaaauggcgucucgaccaaagacaaacuccucaaaacguucaaauuccgcauccccuacuauguaggcccacuuaacagcuaccacaaggacaagggaggcaacuccuggaucgugcgaaaagaagaaggaaagauccuacccuggaacuucgaacaaaaaguagacaucgagaaaagugccgaagaguucaucaagcgcaugacaaacaaaugcaccuaucuuaacggggaagacgucaucccaaaagacagcuuccucuauucagaauacauaauacuuaacgaacuaaacaaaguccaagugaaugaugaguuccucaaugaagaaaacaaacgcaagaucauugacgaacucuucaaagaaaauaaaaaggucagcgaaaagaaauucaaggaauaccuacugguuaaccaaauagccaaucgcaccguggaacugaaaggcaucaaagacucauucaacagcaacuacgucaguuacauuaaguucaaagacauuuucggugagaagcugaaucucgacaucuauaaggaaaucagcgaaaagaguauccucuggaagugccuguacggggaugacaagaaaauuuucgagaaaaagaucaaaaacgaauacggcgacauacugaacaaagacgaaauaaagaaaaucaauagcuucaaguucaacacuuggggacgccugagcgagaaacuacugaccgggaucgaguucauaaaccucgaaacgggcgagugcuacagcagcgucauggaagcgcugcgacgaacgaacuacaaccucauggaacugcuguccucaaaguucaccuuacaagagagcaucgacaacggaaacaaagagaugaaugaggucucuuaucgagaccugauagaggaaagcuacgucagccccagccuuaagcgagccauauuacagacacucaagaucuaugaagaaaucaaaaagaucacgggccgcgugccaaagaaagucuucaucgagauggcccgcgggggcgacgagacaaugaaaaacaagaaaauacccgcgcggcaagaacaauugaagaaacuauacgacuccugcgggaacgacaucgcgaacuucuccaucgacaucaagaaaaugaaaagcagccuaaguagcuacgacaacaacucucuucgacaaaagaaacuguaccuguauuaucuccaguucggaaaaugcauguacacaggacgggagaucgaucucgaccgcuugcuccaaaacaacgacaccuacgauaucgaucacaucuacccgaggucgaaagucaucaaggacgacucauuugacaaucucguucucguccucaaaaacgaaaaugcggaaaagagcaacgaauaccccgugaagaaagaaauucaagaaaagaugaagaguuucuggcgcuuccucaaggagaagaacuuuaucagugacgagaaguauaaacgccuaacgggcaaggacgacuucgagcucagaggcuucauggcacggcagcuagugaaugugcgucaaaccaccaaggaagucggcaaaauccugcaacagauugagccagagaucaaaaucguauacucaaaggccgagaucgccuccagcuucagggaaauguucgacuucaucaagguccgcgaacucaacgacacacaccacgcaaaagacgcauaccucaacauagucgccggaaacguuuauaauaccaaguuuaccgaaaagcccuaccgguaccuacaagagauaaaggaaaacuaugacgucaaaaagaucuauaacuacgacauuaagaaugccugggacaaagaaaauagccuugaaauaguuaaaaagaacaugaagaaaaacacaguaaacaucacucgcuucauaaaagaagagaagggacagcuauucgaccuaaauccaauaaagaagggagagacaucuaacgaaaucaucaguaucaaaccgaaauuauacaacgggaaggaagaaaaacucaacgaaaaguacgguuacuacaaaucauuaaacccagccuacuucuuguacguagagcacaaagaaaagaacaaacgcauaaaaucuuuugaaagagucaaccuagucgacguuaacaacaucaaagacgaaaagucacucguaaaauaccuuauagagaacaagaaauuaguggaaccccgacucaucaagaaaguuuauaaaaggcagguaauacucauuaacgacuacccguauagcaucguugcccuagauagcaacaaacucauggacuucgaaaaucugaaaccccucuuccuagagaacaaauaugagaaaauacugaaaaacgugaucaaguuucuagaggacaaucaagggaaaagcgaggaaaacuacaaauuuaucuaccuaaagaagaaggacagguacgagaaaaaugaaacccuagaaaguguaaaggaccgcuacaaccuagaauuuaacgaaauguaugacaaauuucuagaaaaacuagacucaaaagauuacaaaaacuacaucaacaacaagaaauacaaaaaccuacucgacguaaaagagaaauucaucaaacugaaucucuucgacaaggccuuuacccucaagucauuccucgaccuguucaaccggaaaacaauggccgauuucucaaaggucggacuuacgaaauaucucggcaaaauccaaaagaucagcucgaacguacucagcaagaacgagcuauacuuacuggaggaaucugucaccgggcuguucgucaagaaaauaaaacuuuga

SEQ ID NO: 6577 - RNA, 4104 nt, Artificial Sequence
  Cas9 variant
augaaaaagcaacaauucucggacuacuaccugggauucgacaucggcaccaauagcguaggcuggugcgucacagacuucaacuauaacguccuccgguucaacaagaaggacaugugggggucccgauuguucgacgaagccaagacggcagccgaacggcggguccaaaggaacagccgcagacgacucaagcgccgaaaguggcgacucaaccuccucgaggaaaucuuuagcgacgaaauccucaagauagacaguaacuucuuccggcggcuaaaagaaucgagccuauggcuagaagauaaaagcucaaaagaaaaguucacacucuucaacgacgacaacuacaaggacuacgacuucuacaagcaauaccccacgauauuccacuuacgcaacgaacuaaucaaaaacccagaaaagaaagacauccgccugguauaucucgcacugcacucaauauucaagucgcgcggccacuuucuuuuugaaggccaaaaccugaaggacauuaaaaacuuugaaacgcuguauaacaaccucauggccuuccucgaagauaacgacauauacaagaacauagacaguucauacauagguaaucuagaaaacaucaucugcgacaguaagaaagggcucaaggauaaggagaaggaguucaaggaaauauucaauagcgacaaacaacucguaggcuucuucaagcucagcgugggcucaucaguaagucugaacgaucuuuucgauaccgacgaauacaagaagggagaaguugaaaaagagaaaauaucauuccgugaacaaauuuacgaagacgacaagcccaucuacuacucaaucuuaggggaaaagaucgaguuccuagacauagccaaaucuuucuacgacuucaugguacucaacaacauacuagcggauucccaauacaucucggaagccaaagugaaacuguacgacgagcacaaaagggaccucaaaaaccugaaguacauaauccgaaaauacaacaaagaaaacuacgacaaacuauucaaggacaaaaaugaaaguaacuauagcgcauacaucgggcucaacaaggaaaaagggaagaaagaagucauagagaaaucucgccuuaaaaucgacgacuuugcgaaaaucaucaaaggguacuugcccaaagcggagaagaucgacgaaaaggauaggagcaucuuuaacgagauacuggacaagaucgagcucaagaccauccucccgaaacaacgaauaucggacaacgggacacuccccuaucagauacacgaggcggagcuggagaaaauccucgaaaaccaagcgaaguauuacgacuuccuaaaccacgaagaaaacggcaucuccaccaaggacaaacuccuuaugacguuuaaguucagaauacccuacuaugugggcccauugaacagcuaccacaaaaacaaagguggaaauagcuggaucgugcgcaaggaggaggguaagauccucccauggaacuucgaacaaaaaguagacaucgagaaaagcgccgaagaguucauaaaaaggaugaccaacaaaugcaccuaucuaaacggcgaagacgucauucccaaggauagcuuucucuacuccgaauacaucauacuaaaugaacugaacaaagugcaaguaaacgacgaguuccuaaacaaggaaauuaaaaagaaaaucaucgaagaccucuucaagaaaagcaagaaaaucagcgagaaaaacuuccgcgaauaccugcuagucaaucagaucacgaauaaaaccguggaacuaaagggcgugaaagacgcuuucaacucaaacuacguauccuauaucaaguucaaagacauauucggcgacaagcugaaucucgacaucuacaaagagaucucagaaaaauccauacuguggaagugccucuacggcgacgacaaaaagaucuucgaaaagaaaaucaagagcgucuacggagacauacucaccaaagacgaaaucaagaaaaucaacuccuuuaaauucaacacguggggccgccucagcgagaaacuucuaaccgaaaucgaguucaucgacuuagaaacgggcgagugcuacagcaguguaauggacgcccugcggagaaccaauuauaaccuuauggaacuacucuccucgaaauucacccuccaggagaacauagacaacgaaaacaaagaggucuccgaguucaguuacagagaccucgucgaagaguccuacgucucccccucccuaaagcgagcgauccuucaaacccuaaagauuuacgaggaaauacgaaaaaucacaggacgcauccccaagaagguauucaucgaaauggcacgcggaggugacgagaccaugaagaacaaaaagauccccgcacgccaggaacagcuaaagaaacuauaugacagcugcgggaaagacaucagcaacuucucaauagacauaaaagaaaugaagaacucauuaaacagcuacgauaauaauagucuccgccagaagaaacuguaucuauacuaucuccaauucggaaaauguauguacacaggaaaagaaaucgaucucaaccgccuacuccagaacaacgacacguacgauaucgaccacaucuauccccgcagcaagguaauaaaagacgacagcuucgacaaccugguauugguccuuaaaaaugaaaacgccgaaaagagcaacgaauacccgcuuaagaaagagauccaagagaaaaugaaaucuuucuggaaauucuuaaaagagaaaaacuucauaucagacgaaaaauacaagcgacuuaccggaaaggacgaguucgaacugcgaggcuucauggcccggcagcuggugaacgugcggcagacgaccaaagaagccgggaagauccuccaacaaaucgaaccagagaucaagaucguauauucgaaggccgaaaucgcgagcagcuuucgcgagauguucgacuucauaaaagugcgcgaacucaaugacacccaucacgccaaagacgcauaccugaacaucguggcgggaaacguauacaauaccaaguuuaccgaaaagccauaccgguaccuccaagaaauaaaggaaaacuaugacgugaagaaaauauacaacuaugacaucaaaaacgccugggacaaagagaaaagccucgaaauaguaaagaaaaacauggagaaaaauaccguuaacauaacccgcuucauaaaggaagaaaagggacaacucuuugaucucaaccccauacgaaaaggagagacgucgaacgaaauaauugcaauaaagcccaaguucuacgaaggaucaacagaaaaacucaacgaaaaauacggguacuacaaaucgcucaaccccgcguacuucauauacguagaacacaaagagaaaaauaaaauaauacgcagcuucgaacgcguuaaccucgucgacgucaauaaaaucaaggaugagaaaucacuuauuaaguaccuaauagagaacaaaggacugaucgaaccgaaagucauaaagaaagucuacaaacgucaggucauccuuauaaacaacuuccccuacucuauugucgcccucgacuccaacaaacuuauggacuucgaaaaccugaaaccacuguuccuggaaagaaaauacgagaaaauccuaaagaacgcgaucaaguuccucgaagacaaccaggggaagacggaagaauacuacaaauuccuuuaucucaaaaagaaagaccgcaacgagaaaaacgaaacuaucgacucgguuaaggaaagauacaauaucgaguucaaugaaauguacgacaaauuccucgaaaaacucgacucuaaagacuacaagaacuacaucaacaacaagaaguacagcgagcucguaaacguuaaagaaaaauucaucaaacuaaaccucuucgacaaagcauucacccucaagucuuuccucgaccuuuuuaacaggaagacaauggccgacuucucaaaggucggguugacaaaauaccucggaaaaauucagaaaaucucgucgaauguuuuaucgaaaaacgaauugcaccucuuagaagaaagcgugacagggcuauucguaaagaagauaaaacucuga

SEQ ID NO: 6578 - RNA, 4104 nt, Artificial Sequence
  Cas9 variant
augaaagacuacuaccuuggacucgacaugggauccuccuccgugggcugggcccucuccgacgaacgauacaacuuacugcgcgcaaaagggaaagaccucuggggcguacgccucuucgacgaagccaagacugcggcggagcgacggaccuuccggucacaacgacguaggcuugaacgaagcaaauggcgacugucccuacugacaagucucuucgaagaagaaaucagcaagauagacgauaaguucuucgacaggcuuaaagauagcaaguucuuuauugaugacaaguccgaccagcaaccgaacacccucuucaacgacguuaacuucacggacaaagaauaccacaagcgauacccauccaucuaccaccuucgcaaugcacucuucaaccaaaacgacaaguucgauaucagacugauauuccucgcccucucacacaucguaaagaaacggggccacuuccuuuucgacggggauaaagcaggauuuggagaagacauagacguaauucucgacgagcuaaaagccuaccugcaagaugcauuucauaccaagcucgaguucacuuccgaguucaagagcauuaugcuagacaaaaaccuacgcaaaaagcaaaaggaagaagaacugaaaaacucgauuaaaaucuccagcgacaccaucaacagcaaggacggcaaguccauccuaauaaaacuuuuccuaggcuacgaggccaaccugaagccguucuuccucgaguacaaggucgaaaaggacaacgaauacaagauaaauuucagcaaggaagacuacgaagaaaagcuccucgacaugacauccaaauucgaagaaacgacauacuucauugagauagcaaagaagauacacgauuacuuccuccucgaagaaauaaugcugggcuucaagaacauauccgccuccaaagucuccaucuaccagaaacacaaaaacgaccugaaaacccucaagaacauuguaaagaaccaaaucaacaacucauacaacgcaaucuucaaggauauugggcucgacaauuacccggccuacgucucaugcuggaacucaaagaaacauaaggaaaagcaaaagggcugcacaaaagauaaauucuacgccuuccugaaaaccaaacucaaaaauauaaacaacgccaaggaaauccuagacuccaucgacaacgacgacuuccugccccgucucgucgacaaaaacuccauaaucccccaccagauacaccuggcagaacugaucaagaucaucgacaaccagucccaauacuauccuuuccugaaggagaucaaggacaaaaucauauccaucuucaaauuccgaaucccuuucuaugugggcccccuaaauaacuuccacaaggacaaaggcggcaacgcguggauagaaaagcugaaagacgagaggauauuccccuggaacuucaacgacguaguggaccucaauaagagugcugccaacuucauagaaaagaugauaaaugaaugcagcuaccuaaaaggcgaaaaaguccuagcuaaaaacucacuccuuuacacgaaauacucaguccuaaaccucaucaacaaacuuaaaaucaacgggaccgcagucuccgucgagaccaaacagaaaaucuauaacgaacuacuccucaaacagaaaaacaucaagaaaaccgcgauaaagaaauuccucauaaacaacagcauuauagacaaaaacgacgaaaucagcgguaucgacgacucccugaccucgaaccucgcaguguucaucgacuucgagaaaaucucgaaccgucuacgcuacgaccaaaaagaagacaucaucaaaaguaucagcuuauucggauacgacaacgccaugcugaaaaagcaaauaaucacaauugcgccagaccuaagcgaagacgaacuagaaaaacucuccaagcuacgcuacuccggcuucggccggcucucaaagcgacuccucaccuccauaaagcauaacggaaaaucaaucaucgagauguuaugggacacaaaugacaaccugauggaacuccuaucggaccgcuacacauucaucgaacaaauaaacaaacauaacgacggauucaaagaggacauaaaucucaacuuccaaaacguugacacgcuuuacguaagccccucgguuaaacggcaaaucuggcaggccuucaagguuaucaacgagcuaauaagugucaugggccgcgagccaaagaaaauuuuuguggaaauggcacgagaggaaggcgaaaagaaacgcacccaagcacggaaagacaaggugcucgaacucuacaaaucuaucaagaacaaugaaauuuccaccuuccuaacaaacuucaaagacaucaaaaccaaacuugaaggagagagcaaccuaaauuccaaaaagcuguaccuuuacuaucuccaacuaggggucgacauauacaccggagagaagauccccuucgagaagcuauuugaccaaaacauauaugacauagaucaugucauaccccgcagucucaagaaagacgauucguuugacaaucuagugcucacaagcaaaacaaauaacgccaagaaaacagacgaguuccccguguccucagaaauacaaucgaaaaugcaaacguucuggaaaguacugaaagacaaagaccuuaugucggagauaaaauacaccaaccucaccaggaagacccaccuaucagacgacgaacuaggggacuuuaucgcacgacaacucguugaaacgcgacaaucgaccaaggcccucacccaaauccugaagaacguauacgccaacucggacaucguauacgucaaggcaggcaucguguccgaguuccgccagcaauucgauaugcugaaaaucagagaacucaacgacuuccaccacgcaaacgacgccuaccuaaacaucgucaucggaaauguauacaacaucaaauucaccaaaaacccacgaaacuacguuaaagaauacuacaagaaaggcgagcacuacaaccucaaaaucgagaaaaugcuagagaaagauaucgcacgcggagggaacuucggaugggacaagaaacacuccauagagacagugcaaaagacgaugaaaaagcaaagcccucugaucaccuaccggaccuucgagaauaaaggugaguucuucaaccaacaaccguccaaggcguccgcaaaucuccuagcucucaaaucaucggacaagcgucuacuggacaccguccgguacggcggguacaagggaacccaauacgcucacauguuccuagucgaacacuucaacggaaagaucauaaaagagaucaugggcguccccaucuaccucagcaaagaaaucaaggacgauaaggccaaacugcuagaauacuguaacgacguacucaaacuuaaaaacccuaagauccucuucucgaagauacccuacaacucucugaucgucuacaacggcuaccccauacuucuccgaggauuaaccggcguacggggagcugcacaacugaagcucgaccaaacgucaacgcaaguggucaagaacauugucaaacuuuacgacuggcucucccaaaaacaaaaagagcucucugaccucucaaagaagauagaguucuuccaggaaaauaacaagaaagacgaaguuaaagccgcaaugcucgaagcagauaacauacuauucaucuuaaacgaccgauuuaaaaacacaaagaucggaaaggauaucaugaacgacaaccacuuaaacaaccuauacgacacuuucaucaacaagcuggaaaacucaaucuauaagaacaaaccaggcgggaagcaggauguccucaugaaagaaaaacgagaccucuuccuauccuucagcaugaguaagaaaugcauaacccuguacaaaaucaucaaaauauucggguccugugaccagggcguagauuucagcgauaucgccgagaaaauauccaaaucuggaggaauaggaggcaaaaaccuaggcaaaaacaccuucgaccuaguuuucaaagaaaacuccacauacacccugguucagucgucagucaccggccuuuacgcuaagaaaaccgaccuacacaaacucuga

SEQ ID NO: 6579 - RNA, 4104 nt, Artificial Sequence
  Cas9 variant
augaaaaagcaaaaguucucagacuauuaccuugguuucgauauaggcaccaacagcgucggauggugugucacggaccuagauuacaaugugcugagguucaacaagaaagacauguggggcagccgucucuucgaagaagcgaaaacagccgccgagcgcagggugcaacgcaacagcaggagacggcuaaaaaggagaaaauggcgccuaaaucuccuggaggaaaucuucagcaacgaaauccugaaaauagacucgaacuuuuuccggcggcucaaggaaagcucgcucuggcucgaggacaagucgagcaaggaaaaguucacgcuguucaaugacgacaacuauaaagauuacgacuucuacaaacaguacccgacaaucuuccauuuaagaaacgaacugauuaagaaccccgaaaagaaagacauccggcucguguaccucgcgauacauucaauauucaaaucacgcgggcacuucuuguucgaaggccagaaccucaaggaaaucaagaacuucgagacacucuauaacaaccucaucgccuuccuggaagacaacggcauaaauaagauaaucgacaaaaacaacaucgaaaaacuagaaaagaucguaugcgacucaaagaaagggcucaaagacaaagaaaaagaguucaaagagaucuucaacagcgacaaacaacugguugcgaucuucaaguugucagugggcucaagcguaagucugaacgaucuguuugauacagacgaauacaagaaaggugaaguagagaaagaaaagaucucauucagggagcagaucuaugaagacgacaaaccgauauacuauuccauccugggcgagaaaaucgaacugcuagacauagcgaaaacauucuacgacuucaugguccuaaacaacauccucgccgacagccaguauauaagugaggcaaaggucaaacuauaugaggaacacaagaaggaccugaagaaccucaaguacauaauacggaaauacaauaaagggaacuacgacaaacucuucaaagauaaaaacgaaaacaacuauagcgcuuacauaggccucaacaaagaaaagucaaagaaagaggucauagaaaagucgaggcuuaaaaucgacgaccucaucaagaacaucaagggguaccuaccaaaaguggaagaaaucgaagaaaaggacaaggcuauauuuaacaaaauccucaacaagauagagcuaaaaaccauccucccgaaacagcgcaucucggacaacggcacacuuccguaccagauccacgaagccgaacucgagaaaauccuggaaaaccaguccaaauauuacgacuuccugaacuacgaagagaacgguauaauuaccaaggacaagcuacucaugaccuucaaauucaggaucccuuacuacgucggaccccuaaauuccuaccauaaagacaagggaggcaacucauggauaguccgcaaagaggaaggcaaaauccuaccauggaacuucgaacaaaaaguagauaucgagaaauccgcggaggaguucauaaaacggaugacgaacaaguguaccuacuuaaacggugaggacgugauccccaaagacacguuccucuacucagaauacguaaucuuaaacgagcucaauaaaguccaggucaacgacgaguuccucaacgaagaaaacaaacggaaaauaauagacgaacucuucaaggagaacaagaaagucuccgaaaagaaauucaaagaguaccuacucgucaagcaaauaguagacggcaccauagagcucaaaggcgucaaagacagcuucaacuccaacuauaucucguacauccgcuucaaagacauauucggcgagaaacucaaccuggacaucuacaaggagaucagcgagaaauccauucucuggaaaugccucuacggagacgacaagaaaaucuucgagaagaaaaucaaaaacgaguauggggacauccugaccaaagacgagaucaagaaaaucaacacuuucaaauuuaacaacugggggcgccuaucagagaagcugcuuaccggaaucgaguucaucaauuuggaaacuggcgaaugcuacucaucagucauggacgcgcuucgacggacgaauuauaaccuaauggagcuccucucuuccaaguucacccuccaagaaagcaucaacaaugaaaacaaagagaugaacgaagccucauauagagaccucaucgaagaaaguuacgucagcccaucacucaaacgagcaaucuuccaaacccugaaaaucuacgaagaaauccggaaaauuacgggccgcguaccaaagaaggucuucaucgaaauggcccggggcggcgacgaaagcaugaagaauaagaaaauacccgcgcgacaagagcagcuuaagaaacucuacgacuccugcgggaacgacauagcgaacuucagcaucgacauuaaagagaugaaaaacuccuuaaucucguacgacaacaacucccugagacagaagaaacuauaccucuacuaccuucaauucggcaaaugcauguacaccggccgcgagauagaccuugacagacuacuucaaaacaacgacacguacgacaucgaccacaucuacccgcgcagcaaagucaucaaagacgacucauuugacaaccugguccuaguacucaaaaacgaaaaugcggaaaaaucaaacgaauacccuguaaagaaagaaauccaggagaaaaugaaauccuucuggagauuucugaaagagaaaaacuucauaagcgacgaaaaauacaaacgccuaacggggaaagacgacuucgaacugcgaggcuucauggcaagacaacuuguaaacguccgccaaacgaccaaagaaguaggcaaaauccuccagcaaauugaaccagaaaucaaaauagucuacagcaaagccgaaauagccucaucauucagagaaauguuugacuucauaaagguaagggaacuaaacgacacucaccaugcgaaggacgcauacuugaacaucguagccggaaacguuuauaacacgaaguucaccgaaaagccauaccguuaccuacaagaaauuaaagaaaacuacgacgucaagaagauuuacaacuacgacaucaagaacgcgugggacaaggagaacucgcuagagauugugaaaaagaacauggagaaaaacaccguaaacaucacgcguuucauaaaagaaaagaaagggcagcuauucgaccugaaccccauaaagaaaggagagacuucaaaugaaauaauaucaaucaaaccgaaagucuacaacggcaaagacgacaaacuaaacgaaaaauacggcuacuacaagagcuuaaacccggcauacuuccuauaugucgaacacaaagagaaaaauaaacgaaucaagagcuuugaaagagucaaccuaguagacgucaacaauauaaaagaugaaaagagccucgugaaguaucuaauagaaaacaagaaacucguggaaccgcgagugauuaagaaaguauacaaaaggcaaguaauccuaaucaacgacuacccuuacuccauagucacacuggacucaaacaaauuaauggacuucgaaaaccucaaaccacuauuccuggagaacaaauacgagaaaauacugaaaaacgucaucaaauuucucgaagacaaccaaggcaaguccgaagagaacuacaaauucauauaccucaaaaagaaggaccgguacgagaaaaacgaaacccucgaaucgguaaaagacagauacaaccucgaguucaacgaaauguacgacaaguuccuagagaaacuugacagcaaggacuacaaaaacuacaugaacaacaaaaaguaucaggaacuguuagacgucaaggaaaaguucaucaagcugaacuuguucgacaaagcauuuacucuaaagucauuccucgaccucuucaaccgcaaaacaauggcugacuuuagcaagguggggcucacgaaguaccucggaaagauacagaaaaucucaagcaaugugcugaguaaaaacgaacucuacuugcucgaagaauccguaacgggccucuucgucaaaaagauaaaauuguga

SEQ ID NO: 6580 - RNA, 4104 nt, Artificial Sequence
  Cas9 variant
augaagaaacagaaauucuccgacuacuaccucggauucgauaucggaaccaacagcgucggguggugcguaaccgacaugaauuacaacgucuugagauucaacaagaaagacauguggggcagccgccucuucgaagaagccaaaacagcagcugaacgacgcguccagcgcaauagcagaaggcgccucaaacgccgaaaauggcgucuaaaccuccuagaggagaucuuuucaaacgaaauccugaagauugacagcaacuuuuucaggcgcuugaaagagagcucccucuggcuggaagacaaguccucgaaggaaaaauucacgcuauucaacgacgauaacuacaaagacuacgacuucuacaagcaauacccuaccaucuuccaccuccgaaacgaauuaaucaagaaucccgaaaagaaagacauccgcuugguguaccucgcaauccacagcauauucaaaagcaggggacacuucuuguucgaggggcagaaccucaaagagaucaagaacuucgaaacacuauacaacaaccuuaucgcauuccucgaagacaacgguauaaacaagaguaucgacaaagacaaucuggaaaagcuagagaaaaucgugugcgacucuggcaaggggcugaaggacaaggagaaggaauuuaaggaaaucuucaacucagacaagcaacucguugcaauauucaaacucuccgugggcuuauccguaagccucaacgaccucuucgacacagaugaguacaaaaagggcgaaguagaaaaagagaaaauaucauuccgagagcaaaucuacgaagacgauaaaccuaucuacuacuccauacucggcgaaaagauagaacuucuggacauagcuaaauccuucuaugacuuuaugguacuaaacaauauacucgcggacagccaauacauaagugaggcgaagguaaagcuguaugaggagcacaaacgagaccucaagaaccugaaguacaucauccggaaauacaaccgcgaaaacuacgauaaacucuucaaagacaagaaugaaagcaacuacccagcuuauaucgggcucaacaaggaaaagagcaagaaagagguaaucgaaaaguccaagcugaagauagacgaccuaauaaaauccaucaagggauaccuaccgaaaguagaggaaaucgaagaaaaagacaaggcgauuuucaacgaaauucucaauaaaaucgagcucaagaucauccuccccaagcagagaauaucagacaauggaacccuaccauaccaaauacacgaagcggagcuagagaaaauucuggaaaaccaguccaaguauuacgacuuucugaauuacgaagagaacgggaucauaacaaaggacaaacuccugaugaccuucaaauuccgcauccccuauuacguaggcccacugaacagcuaccauaaagacaaagggggcaacucauggauuguccgcaaagaagaagggaaaauacuaccauggaacuucgaacaaaaaguagacaucgagaaauccgcggaggaguucaucaagcgcaugaccaauaagugcaccuaccuaaauggcgaggacgucauuccgaaagauuccuuccuauacucugaguauauaauacugaacgagcugaacaaaguccaagugaacgacgaguuccucaacgaagagaacaaaaggaagaucaucgaggaacucuucaaaggaaauaagaaaguaagcgaaaagaaauucaaagaguaccuccuugucaaccagaucacgaccggaacaaucgaacuaaaaggcaucaaagacucguucaacucaaacuacaucagcuacaucaaauucaaggacauauucggugaaaagcucaaccuagacauauacaaagagaucagcgagaaauccauccuauggaaaugccucuauggagacgauaagaaaauauucgaaaagaaaauuaaaaacgaauacggugacauacucaccaaagacgagauaaagaaaauaaacacguucaaauucaacaacuggggaagacugucagaaaaacuccugaccggaauugaguucauaaaucuagaaaccggcgaaugcuacagcagcgugauggaggcccuccgccgcaccaacuauaaccucauggagcuccuguccagcaaauuuacccugcaagaaaacaucgauaaugagaauaaagacauaucccaauuuucauaccgugaucuaguugaggaauccuacgucucgccaagccugaagcgggcaauccuccaaacacugaaaaucuacgaggaaaucaagaaaauaacgggucgcguccccaagaaagucuucaucgagauggcgagagggggagacgaaucgaugaaaaacaagaaaauaccggcacgacaagaacagcucaagaaacuguacgacucaugcggcaacgacauagccaacuuuaguauagacaucaaagaaaugaaaagcucguugagccuguaugacaacaacucccuucgccaaaagaaacuguaucucuacuaccuacaauucggaaaaugcauguacaccggacgagaaaucgaccuugaccgucuccuacaaaacaaugacacuuacgacaucgaccacauauacccccgaagcaaagucaucaaggaugacagcuucgacaaccuaguacucgugcuaaagaacgagaacgcggagaaaucaaacgaauacccagucaagaaggaaauucaagaaaagaugaaauccuucuggcgguuccugaaagagaaaaauuucaucagcgacgagaaauauaaaaggcuaacgggaaaagacgacuucgagcugcgaggguucauggcccgacagcuaguaaacgucagacaaaccaccaaggaaguaggcaaaauccugcaacagaucgaacccgagaucaaaaucguuuacuccaaggccgaaaucgcaucgagcuuccgcgagauguuugacuucaucaagguacgcgaacugaacgacacgcaccacgccaaagacgcauaucuaaacauaguugccgggaacguauacaacaccaaauucaccgagaaacccuaccgauaucuacaagagaucaaggagaauuacgacguaaagaaaaucuacuccuaugacaucaagaaugccugggacaaagagaacucccucgaaauagucaagaaaaauauggagaaaaacacggucaacaucacgcgcuucaucaaagaagagaaaggucaacuguuugaccucaacccuaucaagaaaggcgagacaagcaacgaaaucauuucuauaaaaccaaaagucuauaacggaaaagacgacaaauuaaaugagaaguacggcuacuacaagucccucaaccccgccuacuucuuguacgucgaacauaaagagaaaaauaaaagaaucaaaucguuugagcgaguaaaccuagucgacguuaacaacauuaaagacgaaaaaucacuuauaaaauaccuagucgagaauaaaaagcuggucgagccccgagucaucaagaaggucuacaagcgacaggucauccuaauaaacgacuacccauacagcaucgucgcccuagacagcaacaaacuuauggacuucgaaaaccucaagccacuuuuccucgaacgcaaguacgagaaaauccugaagaacgucaucaaauuccucgaagacaaccagggcaaaagcgaagaaaacuacaaguucaucuaccucaaaaagaaagaucgguacgagaaaaacgaaacgcuagaaagcguaagagaacgguacaacauagaguucaacgaaauguacgacaaauuccuagaaaaacuaaauaguaaggacuacaaaaauuacaucaacaacaaaaaguaccaggaccuacucgacgucaaggaaaaauucaucaaauuaaaucucuucgacaaagccuucacccucaaaucuuuucuagaccucuuuaacagaaagacuauggcagauuucagcaaagucggacugaccaaauaccucggaaaaauccagaagauaagcagcaacguccuauccaagaacgaacucuaccuacuagaagagagcguaacuggacuguucgucaagaaaauugagcuguga

SEQ ID NO: 6581 - RNA, 4104 nt, Artificial Sequence
  Cas9 variant
auggucaaaaagaaguaugcgauugguaucgauaucggcacgaacucgguggguuggucgguggugaccgacgacuacaaaguacccucgaagaagaugaaagucuucggcaacacggaaaaacgauacaucaagaaaaaccuccucggcacccuauuguucgacgaaggcaacaccgcggagaaccgccgacucaaacguacagcccggcguagauacacacgacgccggaaccguauccuguacuuacaggaaaucuucgccgaggagauaaacaaaaucgacgacagcuucuuccagcgccucgacgacagcuucuuaaucgucgaggacaaacaaggaaguaaacacccaauauuuggcacgcugcaagaagaaaaagaguaccacaagcaauuccccacuaucuaccaccuacggaaacaacuagccgacagcagccaaaaagccgacauucgguugauauaccucgcgcucgcacacauaauaaaauauagggggcacuuccuuuucgagggcgaccucaagucggaaaacaaagacguacaacaccuauucaacgacuucgucgaaauguucgacaagacgguggagggaaguuaccucagcgagaaucuaccaaaugucgcagacguucuaguagaaaagguauccaaaagucgacgccucgagaacauccuccacuacuucccaaacgaaaagaaaaauggacuauucggcaacuuccugacacucgcccucggacuccaacccaacuuuaaaaccaacuuugaacuugccgaagacgcaaaaauacaguucucaaaagagacuuacgaggaggaccucgaagaacuacuagggaagaucggcgacgacuacgccgacuuauucaucgcaacaaagagccuauacgacggcauccuccuggccggcaucuuaucuaccacggauucuacgacgaaggcuccccucucuuccuccauggucaaucgcuacgaagaacaccaaaaagaccuggcccuucugaagaacuucauacaucaaaaucugucagauuccuacaaagaaguauucaacgacaagcucaaagacggauacgccggauacaucgaagggaagacgacacaggaaaacuucuaucgcuucauaaagaaagccaucgagaaaauugagggaagcaacuacuuuaucgacaaaauugaucgagaagacuuccuccgcaagcaacgcaccuucgacaacggaaguauaccccaccaaauccaucuccaagagaugcacgccaucauccgucgccaggcagaguucuacccauuccuggucgaaaaccaagacaagauagagaaaauccucacauuccgaaucccguacuacguaggaccccuagcaagagguaaauccgaguucgcaugguugaaccgcaaaagcgacgaaaagauaagaccauggaacuucgacgaaaugguagacaaagagacuuccgccgagaacuuuaucacacgaaugaccaacuaugaccaguaccuccccgaccagaagguccuucccaaacacucacuccuauacgagaaguucgccguguacaacgaacuaaccaaaguacgauacgucacagaacaaggcaaauccuuuuucuucgacgcgaauaugaagcaggagauauucgacggaguauucaaaguuuaucgcaaggugaccaaggaaaagcuaauggacuucuugggcaaggaguucgacgaauuucgaauagucgaccuccuaggccuggacaaagacaacaaauccuucaacgcaucacucggaacauaccaugauuuaaagaaaauugucaguaaagaccuccucgacaacccggaaaacgaagacauacuagaaaacgugguacuaacgcuaacgcuauuugaagaccgcgagaugauaaggaaacgccuagagaaauacaaggaugugcucacagaagaacaacgcaagaagcuagagcggcgacacuacacagguuggggcaggcucucagccaagcuaauuaacggcauacgcgacaaaguaacacgcaaaacaauacucgauuaccuaauugacgacggcaccuccaaccgcaacuucaugcagcucauaaacgacgacacccuuagcuucguggacgagaucaggcuugcacaaggcucgggagaagcugaagacuaccgggcagaaguccaaaaccuggccggaucuccagccauaaagaaaggcauccugcaaagccuaaaaaucguagacgagcugaucgagguuaugggauacgaccccgaacacauagucguagagauggccagagaaaaccaguucaccaaccaaggacgccgcaacucccaacaacgauacaagaaaaucgaaaaugcgaucaaaaaccuggacucaaaccuaaacuccaaaauacucaaagaauaccccacuaauaaucaagcacuccaaaacgaccggcuuuuucuguacuaccugcaaaacggcaaagacauguacaccgacgaggaacucgacauagaccaacucagccaguaugacaucgaccacaucaucccccaagccuucauuaaggaugacucacuagacaauaaaguccugaccaagagcgccaagaaccgagguaaguccgaugacguuccgucccucgaaauaguacacaagaagaaaaacuuuuggaaacaacuacuagacucccagcuuauaagucaaagaaaauucgacaaccuuacgaaagccgagcgcggaggccuaacgaacgaggacaaggcccguuuuauccaacggcaacucguggagaccagacaaaucacuaaacacgucgcccgcauccucgauacgcgcuucaacaccaaacucgacgaagccgggaacaggaucagagaccccaaagucaacaucauaacccuaaaauccaaccuugucucccaauuccggaaggauuaccaacuauauaagguacgcgagaucaacaacuaccaccacgcacacgacgcguaccuaaacgcaguaguggcaaccgcccugcucaaaaaguacccccagcuggcacccgaguucgucuacggagacuacccaaaauacaacucauacaaaucaagaaaauccgccaccgaaaaaguccuuuucuacuccaacauaaugaacuucuuccgaagaguccuaguauacucgaaaaccggcgaggucagaauacggccaguaauugaggucaacaaagaaaccggagaaauagucugggacaagaaguccgacuucagaaccgugcgcaaagucuuaucuuacccccaagugaauguaguaaagaagguugaaaugcagaccggaggauucucaaaagaaaguauacugcaacacggcgacagcgacaaacugaucccacgcaaaacagagaaguucuaccuagacaccaagaaguacggcggcuucgauagcccaaccaucgccuacucuguacuccuuauagccgacaucgagaaaggcaaagcgaagaaacuaaaacgagucaaagaacucauaggaauaacgaucauggagcgcauggcauucgagaaaaacccaauagaguuccuagaacacaaagguuacaaaaacauacuugagaaaaacauaaucaaacucccaaaguacucccuauucgaacuggaaaacggcaggcgccgacuguuagcauccgcgaaagaacuccaaaagggaaacgaaaugauccugccaccccaucucgucacgcuccucuaccacucgucaaacauacauaaaaucacggagccuauccaccuaaacuacgucaacaagaauaagcacgaguucaaggaacuccugcgacacaucucggacuucuccacccgcuacauacuagcccaagaccgcuugucaaaaaucgaagaacuguacgacaaaaaugacggagacgacauuucugaccucacaucgaguuucgucaaccugcugacauuuacugccaucggagcccccgccgcauucaaguuccucggaucaguuauagaucguaagcgauacaccagcauagccgagauccuugaagcuacucuaauccaccaaucagucaccggccuguacgaaacgaggauagaccuaucaaaacuagggggcgacuga

SEQ ID NO: 6582 - RNA, 4104 nt, Artificial Sequence
  Cas9 variant
auggucaagaagaaauacgccauuggcauagacauaggaaccaacagcgugggauggagcgucgucacagacgacuacaaaguucccucaaagaaaaugaaagucuucggaaauaccgaaaaacgcuacauaaagaaaaaucuacuuggaacacuacuauucgacgaaggcaacaccgccgaaaaucgacgccucaaacguaccgccaggcgccguuacaccagacgaagaaaccgaauccuuuaccuacaagaaauauucgcagaagaaaucaacaaaaucgaugacuccuucuuccaacgacucgaugacuccuuccugauagucgaggacaaacaagggucaaagcauccaauauucggaacccuccaggaagagaaagaguaccacaagcaauuccccaccauauaccaucugcggaaacagcuagcagacagcagccaaaaagcugacauccgcuuaaucuaccuagcccuugcccacauaauaaaauaccgaggccacuuccucuucgaaggagaccuaaagagcgaaaacaaggacguccagcaccuuuucaacgacuucguugagauguuugauaagaccguggaaggauccuaccuaagcgaaaaccuucccaacgucgcggacguccuugucgaaaagguaagcaagucacgccgacuugagaacauacuacauuacuuuccaaacgaaaagaaaaacggacuauuugggaacuuucuggcacucgcacuaggccuccaaccuaauuucaaaacaaauuuugaacucgcagaagaugccaagauccaguucucuaaggaaacguaugaagaggaccucgaagaacuacucgggaagaucggagacgauuacgccgaccucuucauugccacaaagucgcucuacgacgggauacuucucgcuggaauacucagcaccacugacucaaccacgaaggcaccacugucgucuucaauggucaaccgcuacgaagaacaccaaaaagaccucgcccuccugaaaaacuucauccaccaaaaccucuccgacucuuauaaagaggucuuuaacgauaaacucaaagacgguuacgccgguuacauagaaggcaagacaacucaagaaaacuucuaccgcuuuaucaaaaaggcgaucgagaaaaucgagggaaguaacuacuucaucgacaagaucgaccgagaagacuuccugcgaaagcagcgcacauucgacaacggcucaaucccacaccaaauacaccuccaagaaaugcacgcaaucauacgccgccaagcagaauuuuaccccuuccuaguggagaaccaagacaagauagagaaaauccuuacauuccgcauacccuacuacgucggaccccuugcccguggaaaauccgaguucgcauggcugaaucgcaagucagacgaaaagaucagaccuuggaacuuugacgaaaugguagacaaagaaaccucggccgaaaauuucaucacccggaugaccaacuacgaccaguaccucccggaccagaaaguccuaccuaaacacucccuccucuacgaaaaguucgccguuuacaacgaacuaaccaaagucagauauguaacagaacaggguaaguccuucuuuuucgacgcgaacaugaaacaagaaauauuugacggcguauucaaaguauaccgaaaaguaacgaaggaaaaacugauggauuuccucgggaaggaguucgacgaguucagaaucgucgaccuacuagggcuugacaaagacaacaaauccuucaacgcaagccuaggcaccuaccacgacuugaagaaaaucgucucuaaagaccuccucgacaacccagaaaacgaagacauacucgaaaacgucguccuaacgcuuacccucuucgaagaccgagaaaugaucaggaaacgccucgagaaauacaaagauguacuuaccgaggaacaacgcaagaaauuggaacgacgccacuacacgggcuggggacgccuaagcgcaaaacuaaucaacggcauccgggauaaaguuacacgcaaaacaauccuggacuaccugaucgacgacggaaccucaaauagaaacuucaugcaacuaaucaacgaugacacgcucagcuucgucgacgagauccgccuagcccaaggcuccggcgaagcagaagacuaccgggcugaagugcaaaaccuggcaggcagucccgccauuaagaaggggauacuccaauccuuaaaaaucguagacgagcuuaucgaaguaauggguuacgaccccgagcacaucguaguggaaauggcccgcgaaaaccaauucacgaaccaaggucgcagaaacagccaacaaagguacaagaaaaucgaaaacgcgaucaaaaaccucgauuccaaccugaacuccaagauacuaaaagaauauccaaccaacaaccaggcccuacagaaugacagacucuuccuuuauuaccuucagaacggcaaagacauguacacagacgaggaacuagacauagaccaacucucccaauacgacauagaccauauaaucccccaggcauuuauuaaagacgacucccuagacaacaagguucucaccaaaagcgccaaaaaccgggguaaaagcgacgacguccccagccucgaaauugugcacaaaaagaaaaauuucuggaaacaacuccuagacucgcaacucauaucccaacgcaaguucgacaaccucacaaaggccgaacgaggcgggcucaccaaugaagacaaagcccgauucauccaacgacagcuggucgagacccgccaaauaacgaaacacgucgcacguauacuagacacccgauucaacaccaaacucgacgaagccgguaacagaauacgcgacccuaagguaaacaucauaacacuaaaaaguaaccucguuucccaauuccgaaaagacuaccaacuauauaaaguacgcgagaucaacaacuaucaccaugcgcacgacgccuaccucaaugcggucgucgccacggcacuccugaaaaaguauccacagcuagcacccgaguucgucuacggggacuauccuaaauacaacagcuacaaaagccgcaaaagcgcuacagaaaagguacucuucuacucuaauaucaugaacuuuuuccgccgcguccucguguauucaaaaacgggagaagucagaauuaggcccgugaucgaaguuaacaaagaaaccggagagaucgucugggacaaaaagagcgacuuccgcacgguccguaaaguccuguccuacccacaagucaacguggugaaaaaggucgaaaugcagacaggcggauucagcaaagaaucaauacuccaacacggagauagcgauaagcugaucccccgcaaaacagaaaaauucuaccucgacacgaaaaaguacggugguuucgacagcccaacaaucgcuuacagcguccuacuuauagccgacaucgagaagggcaaagcaaagaaacucaagcgagucaaagaacucaucggaaucacaaucauggagcgaauggccuucgagaaaaaccccauagaguuccuggaacacaagggauacaaaaauauacucgagaaaaacaucauaaagcucccaaaauacucccuuuucgaacuagaaaacggucgcagacgacuccucgcaucugccaaagagcugcaaaaaggcaacgagaugauccugcccccgcaccucgucacacuucuauaccauucgucgaauauacacaaaaucacagagccgauccaccuuaacuauguaaacaagaauaaacacgaguucaaagaacuacucaggcacauauccgacuucucaacgagguacauccuggcccaagaccggcuaucaaaaauagaggagcucuacgacaaaaacgacggcgacgacaucucggacuugacuuccagcuuuguaaaccuccuaacguucaccgcgauaggcgcccccgcugcauucaaguucuugggaucugucauugaucgcaagagauauaccagcaucgccgagauacuagaagccacgcucauccaccaaucagucaccgggcuuuacgaaacgcgaauagaccuaucaaaacucggcggcgacuga

SEQ ID NO: 6583 - RNA, 4107 nt, Artificial Sequence
  Cas9 variant
auggacaaaaaguacuccaucggacuugacaucggaaccagcuccauaggcuucgugggugucgacgaaaacgguuggccccucaacauaaaaggaaaacgagcaaucggagcccaccucuucagagaaggcgaggcagcugcugagacucgggguuuccguacaacccguaggcguuacaaccgccgaaaauggaggcuuagacuacuccgcgagaucuucgaugaacccauaucccguguagaccccaccuucuucgcgcgaaugaaagaaagcuccguauccccaaaggacccaaacuacgacggccuggccaaggaaauacucaucccccgagacaaagacggcaagauccuauaccccacaauauaccaccuaagacacgcgcuuauguacgaagaccaccaguucgacauuagagagauauaccuagcaauacaccacauagucaaguaccgcggucacuuucuacucgacggcgcggccaaaaacuucgaauccuccaaccuugaccugaaaucagacauacacgaaaucaacgccauccuggucgguauauuuggaaacgaacagguacaauucaacgaucaguacguagaaaaacucaaagaaguccuacuagacagcacccagucacggagcgacaggcagaaagcagccgcaaaaguccuacuaccaaccaaugaccuugacaaagacaccacaaaaauccuaaaaacaguauccacagaaauaacuaaagccaucacggguuuaaaagccaaauucuucgucaucaccggcaacgauauugccaaagaccagcaaaaagacuggacguucucuauagacacucuagacgaaaagauguccgucauagagcccucuuucucagaaaagaauuucagccucauuaccaucuugcaaaagcuauauuccucagucaccuuagccggaaucgucccaaacgguuuaucgcucucggaggccaugauccaaaaauaugaccgccacgccucagacuuaguccuccucaagaaauacugggauacaaaacccaaaguucugaaacaccaacuacaaaauaccuacgccgaauacaucgaaauccaccagguagucgacgaguucuacucagaccucaguaagcuaaucaaaaacgacgacgacacccucgcccaagaaauaaaauccaagaucaccauaggcaacuuccugcccaaacagcgcacaaccgaaaacggcgucaucccuuaucagcuacaacaacgcgaacucgacaccaucaucaaaaaucaacaagaguauuauccauggcuagcggaggaaaaccccguggcagaccaccaaauagccuucccauacaagcucgacgaacuugucggcuucagaauaccguacuacguagggcccaugauagccaaagaagauacaaguaacagcaagaacuccaaauucgcuuggaugauccgaaaacaguccggggaagugacccccuggaacuucgacgaaaagauagaccggaccgccuccgcgaccgcguucaucgauagaaugaccaccacagauaccuaccuaauaggugaagacguccuaccaaaacaaagccugaucuaccaacgauucgaagugcucaacgaacugaacaaaaucuccauagauggccaacccauaacgcggaaacaaaaacagagcguguacacccacguauucgaaaagaaaaagacgguccagguaaaggacguccaaaaauuccucgucucaaguggagaagugaugagccuacccaagauaggcggccuggcgaacgaaaaacaauucaacaguucccuaagcacccuuuacgacuacaacaaaaucauuccagacgcacuagaagaccggaacaaggucgaugacauugaaaagaucauccuauggucuacuauuuucgaggacaacagcauuuuugucgagaaacuagacucaaucgacuggcuaaccuccucccaacggaaacgccuagcacagaagcgcuacaggggauggggacgacuaucacugcggcuacucacaaccuucaaaaauaaggacggcuauuccauccucgacgaacucuggaacuccaaccauaauuucauggaaauccaagcacaguccgacuucagcgaacaaaucgccacggcaaacaacaacaaccugagccaagugcuccccgcaaaaugggagcccggccgcaaaaaccucgcaucccuugaugaguucaucucuaaccuuuacaccagcccccaaaauaagaaagcccuucgcaaagcgauccgggucguccaagacaugaugaccgcagcaggccacaugcccgagaaaauuuucauugaagucgcucgagacaccuccaacucacaccaacaaaccaucgcacgacaacgacagcuucaacaacucuaccaauccgaagcaaaggaaguaaucgacagcucagugcgaucggaacuagacgauauccucaaaaaccgagccaacaucaaagaccaacuauuccuauacuuccaacaaggaggccgagaccuauacacgggcaaggccauaaacaucgauaaacugucccuguaccacauagaccacauacuaccacaaucccuaguaaaggacgacagccuagacaaccguguacuugucucccagaaaaccaacgaagacaaaggggucaccuuuguauccgacaaauacaugaacaacaugcuaccaaccuggaagcgguggcacgaaaugggucucaucuccgcaaggaagcuaaagaaccucacaaugcgccccgacgagauagacaaguacgccccgggauucauacaacgccaacucguagaaacacgacaagugacaaaacucgugauugaacuacuagacgcacuccuaggcaacucacaaacagaaauaaucacgaucaaggcaagucucucccaccaauuccgacaacaguuugaccugguaaaaauucgagagguuaacgacaaccaucacgcauucgacgcauuccucgcggcaagaaucggcacguaccucuacaagcgguaccccaagcuaaggcccuacuuuguauacggucaauauaugcagaaccacaaaaaccucaagucuauaaaccuaaucaaaacgcuagauuccgacaaagccaucguagacgaaggcaccggugaaauccuaugggacaagaaauccgaccuugcgaaaaugaucaaaauauacaauuaccaacgacuacuuauaacccacgagucuagaacaucguucggcgcgauguacaagcagaagauccuaaaagcgaccgacgcgaaacaaaacggcggggguuucaagcuaguccccaccaagcggaacuggccaguagacauauacggcggguacacaggccaaaccgcagccuaccucaccauaguccgggucuacucaaagaaaaccucagaacuccgcguccuacccaucuauaccaacaaaguccaacaaauagaaaaagcaaugacccagggcgacaaagccacuaugcuagccuucaagaaaguaaucgcaccccaacucggcaaagaaaacaaaaagacccacgagauuaaaauacccgaguucgacguaguaauccccaaaguacuucuggaccagcucguuaucgacgacaucgcuggcucaccucaucgcuuccgacucgggacugauaccuacuaccacaacucccagcaacucuuccugccucuaucaaugcagcggcaacucauggaccgugaauccgacgacaaagucuaccuggacaucuucaaugacgucuugaagcagguagacucguacuucaaucuguacgacgucaacggcuuccgcgcagcccuacaaaagaguaagaaagcguuugaacaacucccgaucaaugauuuucccaaagacgugcccgacaacaaaaagaagaaaggaaaacgcaguauacuaaaagaaaucuuuauaggcuugcacgccaacgccacccuagguaaccucaaacaaaugggaauaaaaacagacuucggcaaacuucagaaaaguaacggccuccgaaucaccgagaacuguaaaauuauccaucaguccccuacgggacucuucgagagaaucguaccaauaaaauga

SEQ ID NO: 6584 - RNA, 4107 nt, Artificial Sequence
  Cas9 variant
augucccgacccuacaacauuggacuggacauuggcaccagcuccaucggauggagcgucgucgacgaccaauccaaacuugugagcguacgcggcaaguacggauaugggguacgguuauacgacgaaggacagaccgccgcagagcgccguuccuuccgaaccacccgucgaagacucaaaaggcgaaaauggcgcuuaggccuucuccgcgaaauauucgaacccuacauuacgcccguagacgauaccuucuuuuuacgacaaaaacaauccaacuuauccccaaaagaccaacgaaaacuguacccccaaacuucccucuucaacgaccgaacggaccgagccuucuaugacgacuaccccacaaucuaccaccuucgauacaaacuaaugacagaaaaacggcaauuugacauaagagaaaucuaccucgccaugcaucacaucgucaaauauaggggccauuuccucaacgaagccccagucagcuccuucaaaaguuccgaaaucaaucuuguagcccacuucgaccgccuaaacacaauauucgcggaccucuucucagagucgggguuccaacuagaaacugacaaacuagcagaggucaaagcacugcucuuagacaaccagcagucagccucuaaccggcagcgccaggcucucucacugaucuacacaccaagcacgaacaaagccguagaaaaacaaaacaaagccauagcaacggagcugcugaaagccauacuaggacugaaagcgaaauucaacguccuaacaggaaucgaggcggaagacgucaaagcauggacucucaccuucaacgcggagaacuuugacgaggaaauggucaaauuagagucgagccuagacgacaaugcucaccagaucaucgaaagccuacaagaacucuacagcggaguccuccuugccgggaucgucccggagaaccaaucacuuucacaagccaugauuaccaaguacgacgaccaccaaaaacaucuaaaaaugcucaaagccguccgagaagccuuagccccagaagaccgccaaagacucaagcaagcauaugaccaguacgucgacggacaggagaacaccaaagccuauucuaaggaagacuucuacggcgauauaacgaaagcacuuaaaaacaauccagaccaccccaucgucagcgaaaucaagaaacuuauagaacuagaccaguuuaugccgaaacagcgcacaaaagacaacggcgcgauuccacaccaacuacaccaacaggaacuagaccgaaucauugagaaccaacaacaguacuacccauggcuagcagaacucaacccaaacuccaaacgccaaacagucgccaaauauaaacuagacgagcuaguagccuuccgcgucccauacuacguuggaccccucauaaccgccgaacaacaacgccaaagcagcgacgccaaauucgccuggcugauucguaaggccgagggucgcauaaccccauggaauuucgacgauaaggucgaccgacaagcgucagcaaacgaguucauaaagcgcaugacaaccaccgauaccuaccugcuagcugaagacgugcugccaaagcaaucgcuaauauaucaacgauucgaaguccuaaacgaacucaacgggcugaaaaucgacgaucaaccuaucacaaccgaacugaagcaggcaauauucaccgaccucuuuaugcagaaaaucuccgucaccgucaaaaauauccaagacuaccucguauccgagaaaagauacgcgucccgccccgccaucaccggacucuccgacgaaaacaaauucaacucccgccucuccacauaccacgaccucaaaaugaucgucggcgacgccguugacgacguggacaaacaagccgaccucgaaaaaugcaucgaaugguccaccaucuucgaagacgggaaaaucuauagcgccaaacugaacgaaaucgacuggcucaccgaccaacaacgaguccaacuugcagcgaagcgcuaucgcggcuggggccgucuaagcgcuaaacuucuaacacaaauaguaaaugccaacggccaacgcauuauggaccuuuuaugggacacuacugacaauuucaugagaauaguccacucggaagauuucgacaaacucaucacugaagcaaaccaaaugaugcuggcagagaaugauguccaagacguuauaaacgaucuuuacacaucgccccaaaacaagaaagcacuacgacagauccuacucgucgucaacgacauacaaaaagcaaugaagggccaggcacccgagagaauccucauagaguucgcacgagaagacgaggucaacccccgucuuuccguacaaagaaagcgacaagucgagcaaguauaucaaaacaucuccaacgaacuccugaacaacacugaaauccgcaacgaacugaaagaucucuccaacuccgcacucagcaacacccgacuuuuccuuuacuucaugcaaggcggccgcgacauguacacaggcgacucacuuaacauagaccgacuuuccacauacgauauagaccacauacucccacagagcuucgucaaggacaacagccuagacaaccggguccucguaucccaaaagaugaaccgauccaaagcagaccaagugccaacagacuucacgagcguggagcugggaaagaaaaugcaacuacagugggaacagauguuaagagcgggacuuauuacgaaaaagaaauacgacaaccuaacacucaacccugaccacaucucaaaguacgcaaugaaaggauucauuaaccgacaacuugucgaaacgcggcaagucaucaaacuugcaacgaacuuacucauggaacaauacggcgaagacaacaucgaacugauaaccgucaaaagcggacucacccaccaaaugcgaacagaguucgacuuuccgaaaaaccgcaaucuaaauaaucaccaucacgcauuugacgcauaccucacugcguucgucggacuauacuugcucaaaagauaccccaaacucaaacccuauuucguuuacggcgaauaccaaaaagccagccaacaagauaaguggaggaacuucaacuuccucaacggccuaaagaaagacgaacucguugacgaaaacaccgaagcagugauaugggacaaggaauccggacucgcguaccuuaacaaaaucuaucaguucaaaaagauacuggucacacgggagguccacgaaaacagcggagcauuauucaaucaaacccuguaugcggcaaaagaugacaaggcaagcggccagggcggcaagcagcuaauuccagccaaacaagaccgucccaccgcacuuuacggcggcuacuccgggaaaacaucagcauaccugugccuagucaaaaucaaaaacaagucugaauacauauaccgaaucuucggaguaaauaccagcugguccagcgagcucaagcagauccaagauccagcagagcgccucguacgacucgagaaacugcugacaccccaacuuacaauaaacaaaaagaagaaaggcgaacccguaccaguaacaaaagauuucaaaauaauccucccgcggauccucaucaaccaaaaauucuacagcagaggccaagacauuuccauagcuuccgaguucuaccuacauaaugagcaagagcuaguccuagacaaaucugacaucaaaauccucaacggugccauaaaaguaaauaacuccaacaaacaagucaucaaccucuuuaaccacauccuagaacaggugaaccaguacuuccccguauacgacaucuacaaaucucgcgaaguacuaaauuccagcaaagaaauuuucgaaaaccugacauggaacgaccaauggcgcaaccgcaaacugaucaacguaggccagaaaaccauacucaaccgaauccugaucggccugcacgcuaacgccgcaagaauaaaaaucuccgaacucggauucaagaacgacuucggacuccucacccaaacauccggaaucacauucaccccugacacacaaaucauauaucaaucgccaaccggcuuauucgaacgccgggucgcccuccgcgaucuauga

SEQ ID NO: 6585 - RNA, 4107 nt, Artificial Sequence
  Cas9 variant
augaagcgcucauacaacauugggcuagacaucggcaccaacaguaucggaugggccaucguagaugaccaauccaaacuaauaagcguaaaagggaaauauggauacgggguacggcuuuacgacgagggacaaacugccgccgaaagacgcucauuucguaccacccgacgccgccuaaagcgacggaaauggcgacucggccuacuuagagaaauuuucgaaccguacauuacaccuauagacuccacguuuuuccucagacaaaaacaauccaaccucagccccaaagaccaacgaaagcucuauccgcaaaccucacuauucaacgaccgacccgacgccgacuucuaccaacaguaucccaccaucuaccacuugcgguaccagcugaugacggaaaaacgacaauucgacauccgcgaaauauaccuggcgaugcaccacauaguaaaauaucgaggccauuuucucaacgaggccccuguugcaucuuucaaaucaagugaaaucaacuuagcagaacauuuugaccaacugaauacaauauucgccgaucuauuccgugaaucgggauuccagcucgagacagacgagcuggucgcaguaaaagcccugcucauggacaaccagcagucagcaagcaaccgccaacgaaaagcacuaccaaaacuguacaccccaucagcggacaaaucaaucgaaaaacaacguaaagcuauagccaccgagauccucaaagcuauccucggccucaaggcgaaauuuaacguugucaccggaauagaagccgaagacguaaaggcuugggcccuaacguucaacgccgaaaauuucgaugaagaacuagcaaaacuagaguccuccuuagacgauaauggccaugaagucaucggaauccugcaggaacuuuacagcgggauccuacucgcaggaauaguuccagaaaaccaaagucugagccaggcuaugaucaccaaauaugaggaacaccaagcccaucucaaaaugcucaaagcgguccgcgacgaccucgccaccgcggaccagcaaaaauuaaagaaagcauacgaucaauacaucgacggccaggaaaacaccaaagccuacuccaaggaagcguucuacgacgacgugacaaaggcccuaaaagacuacuccgaacaaccacuuguaucagaaauccaaaaacuaaucgaacucgaccaauucaugccaaaacagcgaacgaaggacaacggugccaucccacaucagcuccaccagcaggaauuagaccggaucaucgaaaaccaacagcaauauuauccuuggcuagccgaacuaaacccgaaccccaaacgccaaacugucgccaaguauaaacucgacgagcuugucgcuuucaggguccccuacuacgugggaccucuuaucacagcggagcagcaacaacaauccuccaacgcaaaguucgccuggaugauacgaaagacugaaggccgaauaacaccguggaacuucgacgacaaagucgaccgccaagccucagcgaacgaguucauaaagcggaugaccaccacugacaccuacuuacuggcagaggacgugcucccaaaacagagcuuaaucuaucaacgguuugaaguacucaacgaacuaaacggacuaaaaaucgacgaucaacccaucacgaacgaacuaaaacaagcuaucuucaacgaccucuucaugcaaaagacauccgucagcguaaagaacauccaggauuaccucgucucagaaaagcgcuaugccucccguccagccaucacggggcuauccgacgaaaagaaauucaacucccgacucuccacguaccacgaccuaaaaguaaucguaggcgacgcagucgacgacgucgacaaacaagcagaccucgaaaaaugcaucgaauggucgacgaucuuugaagacggaaaaaucuacagcgcaaaacuuaacgagauuacauggcucacagaacaacaacgcggccagcuugccacaaaacgauaccggggguggggccggcuaucagccaaacuccuaacccaaaucguaaaugccaacgggcaacgcaucauggaccuccuaugggauacaacggacaauuucaugcguauuguacacuucgaggacuucgacaaacucaucacagaggcgaaccaaaugguccucgccgaaaacgauguccaagacguaaucaacgaccucuauacaucaccacaaaacaagaaagcccuacgccaaauacuccuaguggucaacgacauacaaaaagccaugaaggggcaggcacccgagcgcauacuaauagaguucgcccgcggcgcucaaaaggacaaaagccuaaccguacgacguaaacgcaaacuggaugaaauguacucccaaauaucggaugcaguacuugccgacgaaucugugagacaagaacuaaaaucgagcaaccaagacgaucucguaaaagaaaaagucuacuuauacuucaugcaaggcggacgugaccucuacaccgguaacgcccuaaacauagaccgccuguccgacuaccacguagaccacaucaucccacaggcauauauuaaggacgacuccuuagacaacaaggcccugguauccucccgcaugaacgaaauuaaggccgaccgaguaccccuccagguaguacaaaaacaauuuggcaagaacauggccuccgaauggggcuacaugcaccgagcaggcuuaauaucacgaaagaaauacgacaaucugauguuuaaccccgaaaaccucaacaaauaccaaauuaaccgcuucaucucccgucagcuaguggaaacucagcaggucauaaagcuagucgccaaccuacugaguaaccaauacgaaggcgacaacguuaaaaucauaaccgucaaaucuaaacuuacccaaacgauacgauccgaguuugacuuccccaaaaaccgagaaguaaacaacuaccaccacgccuucgacgccuaucucaccgccuucguaggcauguaccuccugaaaagauauccaaaacuaagcucuuauuucacguacggggaauaucuuaagggcaaccaacaggacaaguggaguagcuucaacuuucuaaacgaccuaaaaagggcuaaacucgaagacaaaacgaacaaagaaaucuucuggcacaaagaaagcggccuagccuaccucaacaagaucuaucaauucaagaaaauacuuguuacgcgcgaaguccacgagaacagcggcgcccuauucaaccaaacccucuacgcugcaaaagacgacaaagccuccggccaaggagggaaacaacuuauaccagcaaaacaggcacgacccacggcgcucuauggcggcuacucaggcaagacaguugccuacaugugcaucguccgaauuaaaaacaaaaagggagaccuauacaaaguaugcgguguagaaacaucauggcucgcacaacuaaaacaacucaaagacgaggacucacaaaaagcguuccucaaacagaagaucucaccccaauucacaaaggcuaagaaacaaaaaggaacaauagucaaagucguugaagacuucgaagugauagcaccacacauccuaaucaaccaaagacucuuugacaacggccaagaacucacccugggauccgcaacauacaagcauaacgagcaagaacucaucuuagacaaaacggcagugaagcuacucaacggcgaacuaccacuagcccaaucggaggaacuagccgaguuagucuacgacgaaauccucgaccaaguaaugcacuauuucccgcuuuacgauacgaaccaguuccgagcgaagcuacucgccgguaaaaccgcauucaugcaacucccauggaagucaaaucccgacgacaacaaaaccguacagaucacccaacccauaguccuuaagaaaauccuccaaggacuacacgccgacgccggccgaguuucacucaaagaacuaggcaugacaaccgacuucggcaugcuacaaaaagccaccggaaucacauucacaccggacacacaaauaauauaccaaagccccacgggacucuucgagcggagaguggcacuacgagaccuauga

SEQ ID NO: 6586 - RNA, 4107 nt, Artificial Sequence
  Cas9 variant
auggacaagaaauacagcauuggacuggacaucggaacaaauagcgucggaugggccgucaucaccgaugacuacaaaguaccgucgaaaaaguucaaagucuuaggcaacacagaccgccacucaaucaaaaagaacuuaauaggugcacuccucuuugacagcggugaaaccgccgaggccacgcgacucaagcgaaccgcccgcagacgauauacccggcguaaaaaccgaaucugcuaccuccaagagaucuucucuaacgaaauggcaaaggucgacgacucauucuuucaucgccuagaagagagcuuccugguagaagaggacaagaaacacgaacgacaccccaucuucggcaacauaguggacgaagucgcauaccacgaaaaguacccgacuaucuaccaccuccgcaagaaacucgucgacucaacagacaaagcagaucuccgccuaaucuaccuagcgcuugcccauaugauaaaauuccguggacauuuucucaucgagggagaccugaacccagacaacagcgacgucgacaaacuuuucauccaacuggugcaaaccuacaaucaacucuuugaagagaaccccauaaacgcauccgguguagacgcaaaagcuauacucucggccaggcuauccaaaucgcgccgacucgagaaccucauugcgcagcugcccggagagaagaaaaacggacucuucgggaaccucaucgcgcuaucacuaggccugaccccgaacuucaaaucgaacuuugaccucgcggaagacgcuaaacuacagcugucgaaagauaccuacgaugaugaccucgacaaccuacucgcccagauaggggaccaauacgcugaucucuuucucgccgcgaaaaaccuuagcgacgccauccuucuaucagauauacucagggucaacacggaaaucacaaaagcacccuuguccgcauccaugaucaaacgcuacgacgaacaccaccaggaccuaacgcuucucaaagcccuuguacgccagcaacuaccggaaaaauacaaagagaucuucuucgaccaauccaagaacggcuacgccggauacaucgacgggggagccagucaagaggaguucuacaaauucaucaagccgauccucgaaaagauggacggcaccgaagaguugcugguaaaacucaaccgagaagaccuccuacguaaacaacgaacguucgacaauggcuccauaccucaccagauccaccucggcgaacuccacgccauccucagacggcaggaagauuucuaucccuuccucaaggacaaccgagagaaaauugagaagauucucacauuccggauaccauacuacgucgggccacucgcccgcgguaacuccagauucgcauggaugacccgaaaaucggaagagacaaucacgcccuggaacuucgaggaagucguugacaaaggagccagcgcacagagcuucaucgaacgcaugaccaauuuugacaaaaaucuacccaacgaaaagguccuuccuaagcacucacuccuauacgaguacuuuaccgucuacaacgaacucacuaaagucaaauacguuacugaggggaugcguaaacccgcguuucuauccggggaacaaaagaaagcaauagucgaccuacucuucaaaacgaaccggaaagucaccgucaaacaacucaaagaggacuacuucaagaaaauagaaugcuucgacagcgucgaaaucuccggcgucgaagacagauucaacgccagccucggcaccuaccacgaccuacucaaaauaaucaaagacaaagacuuccuagacaacgaggaaaaugaggacauccuugaagacauuguccucacauuaaccuuauucgaagaucgcgagaugaucgaagaacgccuaaaaacguacgcacaccucuucgacgacaagguaaugaaacaacucaaaaggaggcgcuacaccgguuggggacgccugucccgcaagcucaucaauggcauccgagauaagcaaucugggaaaaccauacucgacuuccuaaaauccgacggguucgccaaccgcaacuucaugcaacugauccacgacgacucucucacuuucaaagaagacauccaaaaagcccaaguuucugggcagggcgacucgcugcacgaacacauagccaaucuagcgggaagccccgcgauaaagaaaggaauccuucagacagucaaaguagucgacgaauuagucaaagucaugggucgccacaaacccgagaauaucgucauugaaauggcccgcgaaaaccagacgacacaaaagggacaaaagaacucccgcgaacgcaugaaacgaaucgaagaagggaucaaggaauugggcucccaaauccuaaaagaacacccagucgaaaacacccaacuccaaaacgaaaagcucuaccucuauuaccuacaaaacggucgagacauguacguggaccaagaacucgacaucaacaggcucagcgauuacgaugucgaccacauagucccgcaaucuuuccuaaaagacgacagcaucgauaacaagguacucaccagaagcgacaaaaaccgagggaaaucugacaauguccccucagaagaggucgucaagaaaaugaaaaauuacuggcgccaacuccucaacgcaaaguuaaucacccaacgcaaauucgacaaccugaccaaagcagagagaggcgggcucagcgaacucgacaaagccggcuucauaaaacgccagcucgucgaaacaagacaaauaacuaaacacguggcccagauccuggacucccgcaugaauaccaaguacgacgagaacgacaaacuuauacgcgaggugaaagucaucacccuaaaaucaaagcuagugagcgacuuccgaaaggauuuccaguucuacaagguacgcgaaaucaacaacuaccaccacgcgcacgacgcguaucuaaacgccgucguuggcaccgcucuuaucaagaaauacccaaaacuugaguccgaguucguauacggagacuacaaaguguacgacgugcgcaaaaugaucgccaaaucugaacaagaaaucggcaaagccacagccaaauacuuuuucuacucuaacaucaugaacuuuuucaaaaccgaaaucacccuagcaaacggggaaaucagaaaaagaccuuuaauagaaacuaacggugaaacgggagaaaucguaugggacaaaggccgcgauuucgcaaccguccguaaagugcucucuaugccccaagucaacaucgucaagaaaaccgaaguacaaaccggaggguucucaaaagaaucgauccuacccaaaagaaacucggacaaacugaucgcacguaagaaagauugggaccccaaaaaguacggcggguucgacucaccgaccguugcauauucgguccuaguaguagcaaaagucgagaaggggaaaucaaagaaacuaaaaucugucaaagaacuccucgggaucacaauaauggagcgaagcucauucgagaagaaccccaucgacuuucuugaagcaaaaggguacaaggaagucaaaaaggaccuaauaauaaaacugccgaaauacucacuauuugaauuagaaaacggacgaaaacgcaugcucgccucagcaggggaacuacaaaaaggcaacgagcuagcacucccgagcaaguacguaaacuuucuauaccuggcgagccacuacgaaaagcucaaaggaagcccggaagacaacgaacaaaaacagcuguucguagagcaacacaaacauuaccucgacgaaaucauagagcaaaucagcgaguucucaaaacgaguaauccucgccgaugccaaccucgacaagguacucagcgcguacaacaaacaccgggacaaacccauccgcgaacaagccgaaaauauaauccaccucuucacccucaccaaccucggcgcacccgccgcauucaaguacuucgacaccaccauagaccgcaagcguuacaccagcacaaaagaggugcuagacgcuacgcuuauccaccagucgaucaccggccuauaugaaacgcgaauagacuugagucaacuaggcggagacuga

SEQ ID NO: 6587 - RNA, 4107 nt, Artificial Sequence
  Cas9 variant
auggacaaaaaguacuccaucggacucgacauaggcacaaacagcgucggcugggcagugaucacagacgacuacaaggugccguccaaaaagcucaaaggccuaggaaacacagacagacacggcaucaagaaaaaucuaaucggagcacuacuguucgacuccggcgagaccgccgaagcgacccgccuaaaacgcaccgcccgccgccgcuacacgcgccgcaaaaaccgcaucugcuaccuccaggagauauucagcaacgagauggcgaaagucgacgauagcuucuuccaccgccuggaggaauccuuccucguagaagaggacaagaaacacgaaagacacccaauauuuggcaacaucguagacgaaguagcguaccacgaaaaauacccaaccauauaccaccugaggaagaaacucgcggacagcaccgacaaagucgaccuaagacuuauauaccuagcgcuagcccacaugauaaaguuccguggccauuuccuaaucgagggcgaccucaacccugacaacucagacguagacaaacucuucauacaacugguucagacauacaaccaauuauucgaagaaaacccuaucaaugcgagccgaguggacgcuaaagccauucuauccgcccggcuaagcaagagccggcggcucgaaaaccuaauagcgcaacuucccggagaaaagaagaacggccucuucggaaaccucaucgcgcucucacucgggcucacucccaauuucaaauccaauuucgaccuagcagaagacgcaaaacuccaacugucaaaggacacauacgacgacgaccuagacaaccuccucgcacaaaucggggaccaguacgccgaccuauuccuagcggcgaaaaaccugagcgacgccacgcuacucuccgacauuuugcggguaaacucagaaaucacaaaagcaccccuuagcgcuuccaugaucaagcgauacgacgagcaucaccaggaccuaacccuccuaaaagcccuuguacgccaacaacuccccgaaaaauacaaagagauauucuuugaccaauccaaaaacggcuacgcaggguacaucgacggaggggcuucacaagaagaauuuuacaaauucauaaagcccaucuuggagaaaauggacgggaccgaagaacuccucgcaaagcugaacagggaagaucuccuccguaaacagcgcacauucgacaacggaagcauacccuaccaaauccaccuuggagaacugcaugcuauucuacgccgccaggaggacuucuaccccuuucucaaagauaaccgggagaaaaucgagaaaauccuaacguucaggaucccauacuacguggguccgcuagcgcgcggcaacagccgcuucgccuggaugacccgcaagagcgaagaaacuauaaccccauggaacuucgaagaaguuguagacaaaggagcuuccgcacagagcuuuauagaacggaugaccaacuuugacaaaaaucucccaaacgaaaaaguccuaccaaaacacucacuccucuacgaguacuucacaguguacaacgagcucacaaagguaaaauacgucacugaggggaugcgaaagccagcauucuuaucaggagaacaaaagaaagccaucgucgaccugcucuuuaaaacaaaccggaaaguaacggucaaacaauuaaaagaagacuacuuuaagaaaauagaaugcuucgauagcguggaaauaucgggcguagaagaccgauucaacgcgagccucggcacauaccacgaccuacucaaaauaaucaaagacaaagacuuccucgauaacgaagaaaacgaagauauccucgaagacauaguacucacccugacccuauucgaagaccgugagaugaucgaggagaggcucaaaacauacgcccaccuguucgacgacaaagucaugaaacaacugaaacgccggagauacaccggauggggccgacucucccgaaagcuaaucaacgggauacgcgacaagcaaagcgggaaaacaauacuagacuuccugaaauccgacggcuucgccaaccggaacuucaugcaacuaauccacgacgacagccucacauucaaggaagacauacaaaaagcacaagugagcggacaaggggacagccuucacgaacacaucgccaacuuagccggauccccagcaauaaagaaaggcauacuucaaaccguuaaaguuguugacgaacuuguuaaaguuaugggccgccacaagccagagaacauuguaauagaaauggcccgcgaaaaccaaacuacgcaaaagggccagaaaaauagcagagaacgaaugaaacgcaucgaagaaggaaucaaggaacucggcucggauauacuaaaggaauacccaguagaaaacacccagcuccaaaacgaaaaacuuuaccuguacuaccuacaaaaugguagagacauguacgucgaccaggagcucgacaucaaccgccuguccgacuacgacguagaccacaucgugccccagagcuuccucaaggaugacucaauugacaauaaaguacucacccgauccgacaaaaacaggggcaaaucagacaacgucccauccgaagaagugguuaagaaaaugaaaaacuacuggaggcagcuucuaaacgccaaacugauaacccagaggaaguucgacaaccucacuaaggccgaacggggaggacucucggagcuggacaagguaggauuuauaaagcggcaacucguggaaacuaggcagauuacaaaacauguggcccaaauauuggacucccgaaugaauacaaaauacgacgaaaacgacaaacuaauucgggaaguccgugucaucacacugaaauccaagcucguaucagauuuuaggaaagacuuccaauuuuacaaaguccgugaaaucaacaacuaccaccacgcucacgacgcauaccucaacgcgguuguuggcacagcauugauaaagaaauaccccaagcucgaguccgaguucguauacggagacuacaaggucuacgaugugcgcaagaugaucgccaaauccgaacaagaaauuggcaaggcaacagccaaauacuucuucuacuccaacaucaugaacuucuucaagacagaaauuacccucgcgaacggagaaauacgcaagcgcccacuuauagaaaccaacggagaaacuggggaaaucguaugggacaaaggccgagauuucgccacaguccgaaagguucuaagcaugccccaagugaacaucgucaagaaaacagaagugcaaacugguggcuucucaaaagagucgauauugccaaaaagaaauucagacaaacucauagcacgcaaaaaggacugggaccccaaaaaguacgggggcuucgauuccccgacaguagccuacuccguucucguagucgccaaagucgaaaaaggcaaauccaagaaacuaaaaagcguaaaggaacugcugggaauuaccaucauggagcguagcaguuuugaaaaggaccccaucgacuuccucgaagcaaaaggauacaaagaaguccguaaggaccucaucaucaaacuacccaaauacagccuauucgagcucgaaaacggccggaagcgcaugcucgcauccgcuggugaacuucaaaaggggaacgaacucgcacuaccauccaaauacguuaacuuccuauaucucgcgucacauuacgaaaaacuaaaagguagcccggaagacaacgaacaaaaacagcuauuuguggaacagcacaaacacuaccucgacgaaauaaucgaacaaaucucugaguucucgaaacgagucauacuagcagacgccaaccuagacaaaguccucuccgcuuauaacaaacaccgagacaaacccauccgggaacaggccgaaaacaucauccaccuuuucacauugacaaacuuaggagcuccagcagcauuuaaguacuuugauaccaccauagaccggaaaagauacacguccaccaaggaagugcuugacgcaacucucauccaccaaagcaucacaggcuuauacgaaacccggaucgauuuaagccaacucgguggcgauuga

SEQ ID NO: 6588 - RNA, 4107 nt, Artificial Sequence
  Cas9 variant
auggacaagaaauacucaauaggccuagacauaggaaccaacuccguaggcugggccgugauaacagacgacuacaaagugccaagcaaaaaguucaaaguacucggaaacacagauaggcacagcaucaaaaagaaccugauaggggcgcuccuguucgauagcggagaaacagcagaagcaacccgccuaaaaaggaccgcccggcgucgcuacacccggcggaagaaccgaauaugcuaccuccaagaaaucuucaguaacgaaauggccaaagucgacgacucauucuuucaccgacuagaggagagcuuucucguggaagaggacaagaaacacgaaagacacccgauauuuggaaacaucguagacgaagucgcuuaccacgagaaguauccaacuaucuaccaccuccguaagaaacuagcagacucuacugacaaagcugaccugcgacuaaucuaccucgcauuagcacacaugaucaaguuccgcggccauuuccuaauagaaggagaccuuaacccggacaacucagacgucgacaaacucuucauccaacucguccaaaccuacaaccaacucuucgaagaaaacccaaucaacgcauccagagucgacgcuaaagccauucuaagcgcgcgcuugucaaaaucccgccgccuagaaaaucugaucgcucagcuccccggagaaaaacggaacggccuauucgguaaccuaaucgcccuuucccuaggacuuacccccaacuucaaauccaacuucgaucuggcagaagaugcaaagcuacaacuauccaaagacacguacgacgaugaccuagacaaccugcuagcccagauaggcgaccaguacgcggaccuauuccuagccgcgaagaaccucagcgacgcgauccugcucuccgacaucuugcgagucaacucagaaaucaccaaagcaccgcuguccgccucuaugauaaaacgcuacgaugagcaccaccaagaccucacacuccuaaaagcacucgucagacaacaauuacccgaaaaauacaaggaaaucuucuuugaccaaagcaagaauggcuaugccggcuacaucgacggcggagcuagccaagaggaguuuuauaaauucaucaaacccauucucgagaaaauggacggaacagaagaacuucucgccaaacucaaccgagaggaccugcugcggaaacaacgaacguucgacaacggaucaaucccgcaccaaauccacuuaggggagcuacacgcaauccugcgccgacaagaagauuucuaccccuuucucaaggacaacagagagaagaucgagaaaauccucacguuuaggauucccuacuacgucggcccccuggcaaggggcaacucccgauucgccuggaugacacgaaagagcgaagaaacuaucaccccuuggaacuucgaggaagucgucgacaaaggugccucugcacagagcuucauagaacgaaugaccaauuucgacaaaaaccuccccaacgagaagguacuucccaagcauucccugcucuacgaguacuucacugucuacaacgaacuaacaaagguaaaauauguaacagaaggaaugcgcaaacccgaguuccugucaggcgaacaaaagaaggccauaguagaucugcuguucaaaacgaaccgcaaaguaacgguaaagcaacucaaagaagauuacuucaaaaagaucgaguguuucgacagcguagaaaucuccggggucgaggaccgauucaacgccagccucggaacauaccacgauuuacucaaaauaaucaaggacaaggauuuccucgacaacgaagagaacgaggacauccuagaagacaucguccuaacgcuaacacucuucgaagaccgcgagaugauagaagaacggcucaaaaccuacgcccaccuuuuugaugacaaaguaaugaaacagcugaagcgucgacgcuacacgggauggggacgcuugucgcgaaaacucaucaacggaauccgagauaagcagagcgggaaaacaauccuagacuuccuaaagagcgacgguuucgccaaccgaaacuucaugcagcugauacacgacgauagccuaaccuucaaagaagauauccaaaaagcccaagucucaggccaaggagacagucuacacgaacacaucgccaaccuggccggguccccagccaucaaaaagggaauccuccaaaccgucaaagucguggacgagcucgugaaagucaugggccgacauaaacccgagaacauagucaucgagauggcgagggaaaaccaaaccacacagaaaggccagaaaaacucuagagaacggaugaaacgcaucgaagaaggaaucaaagagcucggcagcgacauacuaaaggaauacccggucgaaaacacgcaacuacaaaacgaaaaacucuaucuauacuaccuccaaaauggacgagacauguacgucgaucaagagcucgauauaaaccgccugucugacuacgacguggaccacaucgugccccaaucauucauuaaggaugacucgauagauaacaaaguucucacccgcagcgauaaaaaccguggaaaaagcgacaauguacccucggaagaagucgucaaaaagaugaaaaacuauuggaaacaacucuugaaugccaaauuaaucacacagcgcaaauucgacaaccugacaaaagccgagcgagguggacucucggaacucgacaaagcaggauucaucaaaaggcaacucguugaaacccgccaaaucacaaaacacguagcgcagauucuugacucacgcaugaacacgaaauacgacgagaacgauaagcucaucagagaagugaaagucauaacacuuaaguccaagcuagucucggacuuccgcaaggacuuccaguucuacaaagucagagagaucaacaacuaccaccacgcccacgacgccuaccuaaacgccgucgucggcaccgcccucauaaagaaauauccaaagcuggaauccgaguucguauacggagacuacaaagucuacgacguccgaaaaaugauagcuaaauccgaacaggaaaucggcaaagcgacagcaaaauacuucuuuuacagcaacaucaugaacuuuuucaaaaccgagauuacacuugcaaacggggaaaucagaaagcgcccucucaucgaaacaaacggggaaaccggagaaauugucugggacaagggacgcgauuucgcuaccguccgcaagguauugucuaugccacaaguaaacaucgucaaaaagaccgaggugcaaaccgggggauucucgaaagaaucaauacucccaaaacgcaauagcgacaaacuaaucgcacgaaagaaagacugggaucccaagaaauacggcggcuucgauuccccgacggucgcauacuccguccuaguagucgcgaaaguugaaaagggcaaauccaagaaacucaaauccgugaaggaacuucucggaaucaccaucauggaaagaagcuccuucgagaaaaaccccauagacuuccuggaagccaagggcuacaaagaaguccguaaggaccucauaaucaagcugccaaaguauucgcuauucgaacuggaaaacggacgcaaacgcaugcuagccagcgccggagagcuccaaaaagguaacgaacucgcucuccccagcaaguacguaaacuuccuauaucuagcgagccacuacgaaaaacugaaaggaucccccgaagacaacgaacaaaagcaacuuuucguugaacaacacaagcacuaccuugacgaaaucauagagcagauauccgaguucucuaagcgagugauccucgcggaugcgaaccuagacaaaguacuauccgcauacaacaagcaccgcgacaaacccaucagagaacaagccgaaaacaucauacacuuauucacccucacgaacuucggcgcaccagcggccuucaucuacuucgacacaaccauuggccggaacagauacaaaucuaucaaagaaguccuugacgcaacccuuauacaccaauccaucacgggacucuacgaaacgcgaaucgaccuaucacaacucggcggugacuga

SEQ ID NO: 6589 - RNA, 4107 nt, Artificial Sequence
  Cas9 variant
augaaauacgaaagugaagaauacuacauaggacuagacaugggcacaagcuccgucggaugggccguuacggacccccacuaucaccuuauccgaaagaaaggcaaagacuuauggggcgcgcgacucuucgaaaaagccaauacggcacaggagcgccggaccaaccggaucaaccgccgccgcaaccagcgccgcaaacaaaggauagcguucauccgcgaagccuuccgcaaagaagucgaaaagguagacgucaacuucuuccgcagacucgaugagucccagcuauaccucgaagacaaauccauaaaggaaccguaccuccuauucaacgaccucaacuacaccgacaaagacuucuaccaccaauacccuacgguauuccaccuaaucaccgaccugcucacuuccgaccguaaauucgacauucgggaaauauacaucgcagucagcucucuuuacaaccaucgcggcaacuuccuaaacaagagccuaggcaacgaaacgcaggacgaggaccuaguauucaaaaaccucgacgaggccuucucagcaugcgggaugaacuggaacaccaaagccgagaacaucgaggucguuaagcagauccucugcgaccgcucccuaaacaaaaaggaaaagcaggaucaacucgcacauugucuagagaucaauaagaaaaccgaaaaagagaagauugaguuccucaaacuccuuacagggggcaaggccgacagcaagaaaauguucccccaauaccacuacgaacgggacgaaaaauuauccuuugcguucgcugacgaaaacggcgacgaaaacugggaagaaacccugaacgccaucgaagaaagauugacgucggacgaauauggccuaauccucgcacuuaaaagcgucuacgacuggagcauucuggcugaucuaaugaaaaacgagaaaacgggagaaaccuauccuuaccucaguauggcgagaaaagacagcuaugagaaacacaaggcggaucugcggcuucucaaaucaguaaucaaacgacucauccccaacgaguacaaccacuuuuuccgacaguacgacgguaagggcaagaccuauacgaacuacauaggaagcgugcaguaccacgagaaacgucacagauucaaacacaucaccaccaaagaauuuuacgacggguugaagaaauuacucaaaccauacuccgaggacgaggaaauaaagcaaauccuacaggacauagaauccgaaacguuccuccccaaacagaucacgaacaugaacggagucaucccaaaucaaguacaugccaaagaacugaaggucauacuagaaaaagcaagccaacacuacgauuuccuaaacgaaacgaacgaauccggucucacagugaaagaacaaaucaugcagauguucaccuuccaaaucccguauuacguaggaccccucgccaaccuaaaugggaaaggaaacggcugggccguacgcuacgucgggaaggaaagaaccaaaguguacccauggaacauggacgaaguuaucgacgagaaagaaacggccgaccaauuuauaaaacgcaugauaaguaccugcacauaccucggggacgaauacguacuacccaagagcucaauccuguacgaaaaauuugccguccucaacgagcuuaacucacuaaaaauaaacgggcaaccggugagcguggacuugaaacagaaaauauaccgcgaucuauucaccaaaggcaagagaguaacucagaagggccuguuacuauaucuaaaacgagaaggggugaucagcaaauccgaagaaacaaucuuauccggcuucgacauagacuucaaaaacacccuuagcucauaccggaaauucugcgaggucuucgcaacaaacgaacucaacgacgaacaaauaagaauggccgaagacauaauagaauggcugacggucuucggcgacagcaaaaaguuuguccgcgagaaaauacacgggaacuacccccagaucaccgcgaaucaacucaaacggauucuauccuucaacuuuaaggacugggguaagcucuccaaacaauuucuggaauuggaaggcgaggacagagaaacaggcaagucaugcagccuaauucaagcccucugggacaccaacaacaaccuaaaucagcuccucaguagucgauuuacauacaaggaaaaccuagagaagaaacgcaagaaaaucgaaauggaccuauuugaguucacgcacgaagaccuagacgaccuguacauaucggcacccgugaaacggaugauauggcaagcccuuaaaauaaugaaggacauaguuaucguaaugaaagaaucacccacaaaacucuuuaucgaaaugacccgcaacaacgaaaacgaaaagacacgcaccguaucccggaaaaacaagcucgucgaccuauacaaaaagaucaaaggggagucacgugacuggaucaaggagcucgagagauacgaggagaaagacuuccgguccaagaaacuguaucuuuacuauacccagaugggcaaaucagcguacagcggcgagcccaucgauauggacaaacuguucgacaaaaacguauacgacauagaccauauauacccaaaauccaaagucaaagaugacucacuacuuaacaauugcguccuagugaaaagaaaagagaacauggacaagggcaacaacuuccccauagaccccgacauacagacgaaacaagaacaccucuggaaauucuggcuugagaagggccugaucacacaagaaaaauuuaacagacucacaagaaagaaaccauucaccaacgacgagcucgccgauuucguaaaccgacagcuaguagagacgggccaagcaacaaagacgaucgcggaccucuucaaaaugaccuuuccuaacagcgauauaguuuacgucaaagcaggcaacgugaccgauuuccgccaauacauagaggucuacaagugccgcgaggugaacaaucuacaccacgccuacgaugcauaccucaacguuguagucggaaacgucuacgacaccaaauucacgaaaaaccccaugaacuacauaaaggaacaacgaaaagagaacaguaacgagagauaccauauggacaaaaucuuugaauuucccgucauacgaaacgguaaggaggcuuggaucacgaagaaggacgaaaguaucaacauaguacgcaaaacacuagcgaggaagacaccccuggugacaaaaaggaacuucgaggcgaacggcacaauagcaaaagccaccaucuacccuaagggcaacgucaaggaccaaggcuaccucccuagaaagaccuccauaccagcccugcgagacaugaagaaauacggcggcgucaccucaauccagauagcguacuucuuccuaguagaacacgagguuaaaaagaagcguauacgcacgauagagugcgucccaauauaccgcaaggaggaacuuaagacgaaagagcagcuggaaagguauugccgagaggaacuaaagcuaauuaacccaagcauacggcucgagaaaaucaaacccuacagccuccuuaagaugaacgggaacuucuucuacauaacaggcaagacgaacgauagauucagccuagccaacgccauggagcuauacguagacaaaguaagcgagaaccacauccgagaccucguaaaguacaaaaacuguggguacuucaauguagacgacaaagaagcacgcaaacgcaacgaacgccucuacacgauacuaaccaaaaagcaccucaccgucuucaaaggcuccccaaaaccgaugggagaaaagcuccaacaguaccagcaacucuuccucgaacuagaagucucaaaacaaguauacguccuucuccagauacuacagcuaacagcaacaaacgucaagacaaaggccgaccugacagccauagggggcaaagcaaacgaaggcacaauggacaucagcaaaaaucuagaaaacgucauuaaaaaccaaauaaagaaaggucucguaccggagcucaugcuaauaaaccagucgccgacuggccuauucgaaagcgaaaucgaccuccuaacaauuuga

SEQ ID NO: 6590 - RNA, 4107 nt, Artificial Sequence
  Cas9 variant
augucgcguccguacaacauagggcuugacaucggcaccuccagcaucggauggagcguaguagacgaccagaguaaacucguauccguacgcggaaaauauggguauggcguccgccuguacgacgaagggcaaacugcagcagaacgaagauccuuccgaacaacacgccgucgccugaaacggcgcaaauggagacucggacuccuacgcgagaucuuugaaccguacauuacaccugucgacgacacuuucuuccuucgcaagaaacagucuaaucuauccccaaaagaccagcgaaaacuauacccccagacaagccuauucaacgaccgcacagaucgagcuuucuacgacgauuaccccaccaucuaccaccuccgauacaagcuaaugaccgaaaaacgccaguucgacauccgagaaaucuaccuagccaugcaccauauaguuaaguaccgagggcacuuccuaaacgaggcccccgucagcucauucaagagcagcgaaauaaaccuagucgcccacuucgaccgucucaacaccaucuucgcagaccuguucuccgagagcggauuccaacucgagaccgauaaauuggccgaagucaaagcucuacugcuagacaaccaccaauccgcauccaaccgccagcgccaagcacuccuccucauauacacaccuuccaccaacaaagccgucgaaaaacagaacaaagcaaucgcaaccgagcuacugaaagcgauacuaggccuaaaagccaaguuuaaugugcucacaggaauagaagccgaggacgugaaaacauggacacugaccuucaacgcagagaacuucgacgaagagauggucaaacuagagucaucauuggacgacaacgcccaccaaauaauagaaagccuucaagaauuauauuccggcgugcuacuggccggcaucguaccggaaaaccaguccuugucccaggcaaugauaaccaaguacgacgaccaccaaaagcaucuaaaaaugcucaaagcagucagagaagcauuagcccccgaagaccgccagcgccuaaaacaagcguacgaucaauacguggauggacaagaaaacaccaaagccuacuccaaagaggacuucuacggcgacaucacgaaagcccucaaaaacaacccagaccaccccaucguaucggaaaucaagaaacucaucgaacucgaucaauuuaugccaaagcaacgcacaaaagacaacggcgcaaucccccaccaguuacaccaacaagaauuagaccggauaaucgaaaaccagcaacaauacuacccuuggcuagcagaacuuaaucccaacucuaagcgacaaaccgucgccaaguacaagcuagacgagcucguagcguuccgcgugccauacuacguugggccgcucauuaccgccgagcagcagcaacaguccagcgaugccaaguuugccuggaugauacggaaagcggaagggcaaaucacaccguggaacuucgacgacaaagucgaccgucaggccucagcaaacgaguucaucaaacgcaugacuacaaccgacacguaccuacuagcugaagacguacuucccaagcaaagccucaucuaccaaagauucgaaguacuaaaugagcuaaacggacucaaaaucgaugaccaacccauaaccacagagcucaagcaggccaucuucaccgaccucuucaugcagaaaacaucggucacagucaaaaacauccaagacuaccuaguaucggaaaaacgcuaugccuccaggcccgcgaucaccggccuaucagacgaaaacaaauucaacucacgcuugucuaccuaccacgacuuaaaaaccauaguaggugacgcaguggacgacgucgacaagcaagccgaccuagagaaaugcauagaauggucaacaauauuugaggauggaaaaauauacucggcuaagcucaacgagauagacuggcuaacggaccaacaacggguacaacucgcggcaaaacguuacagagggugggggcgccucucagcaaaacugcucacccaaauaguaaaugcaaacggucagcggaucauggaccuccucugggacacuacagacaacuucaugcgaaucgugcacuccgaagacuucgauaaacuuauuaccgaagcuaaucaaaugaugcucgccgaaaacgacguacaggacguaauaaacgaccuauacaccaguccccaaaauaagaaagccuuaagacaaauccugcucguagucaacgacauccaaaaagccaugaaaggccaagcacccgagcgcauacuaauagaguucgcccgagaagaugaaguaaacccacgccuauccguccaacgcaaacgccaaguggaacaagucuaccaaaacauaucaaacgagcuucucaacaacacugaaauccgcaacgaacuuaaggaccuauccaauucagcccucuccaacaccagacucuuccuguacuucaugcagggaggccgagacauguacacaggagacucccuuaacauugacagacucuccacauacgauauagaccauauccucccccaaucauucauuaaagacaacucccucgauaaccgaguccuaguuucacagcggaugaaccgcagcaaagcagaucaggugcccaccgauuucacauccguggaacucggacagaaaaugcaaauacaaugggaacaaaugcugcgcgcaggccucaucacaaagaagaaguacgacaacuuaacccuuaaccccgaccacaucagcaaauacgccaugaagggauucauaaaucgacaacuggucgaaacucggcaaguaaucaaacucgccacaaacuugcucauggaacaauacggcgaagacaacaucgaacucauuacagucaagagcggccucacgcaccagaugcggacugaguuugacuucccgaaaaacagaaaucuaaacaaucaucaccacgcauuugacgcauaccucacagccuuugugggucucuaccuacuaaaacgcuaccccaaguuaaaaccauacuucguauacggggaauaccagaaagccucacagcaagauaaguggcgaaacuucaacuuccucaauggacuaaagaaagacgaacucguugacgaaaacaccgaagcagucaucuggaacaaggaaucggggcucgcauaccuuaacaaaaucuaccaauucaagaaaauccucgucacacgggagguccacgagaauagcggcgcacucuucaaccaaacuuuauaugcugcaaaagacgacaaggccagcggucaaggcggaaaacaacucauaccugccaaacaagacagacccaccgcacucuacggcggcuacuccggcaagacaguggcauacaugugcaucguccguaucaaaaacaaaaagggggacuuguacaaggucugcggaguagaaacguccuggcuagcacaacuaaaacaacuaacggacgaggacuccaaaaaggcauuccucaaacagaaaaucucaccacaauuuaccaaagugaagaaacagaaaggcaccaucgucaagguaguagaagauuucgagguaauagcuccccauaucuuaaucaaccagcgauucuuugacaauggucaagaguuaacacuaggcucggccaccuacaaacacaaugagcaagaauuaauacucgacaagacagccguaaagcuguuaaacggggcccucccccucacgcagucagaggaacuagccgaacaggucuacgacgaaauucucgaucaagucaugcacuacuucccacuguacgacaccaaccaguuccgcgccaaacuaucugccggcaaagccgccuucaugaaacuaccauggaaaucacaaugggauggcaauaaaauggugcaaguaggccaacaagucauccuggacagaguccugauaggucuccacgcaaacgcugccguaagcgaccugggugugcucaagaucuccacaccgcucggcaaaaugcaacaacccagcggcauuucucuuucaccugacacacaaauaaucuaccagucuccaacgggccuauucgaaagacgagucgcccugcgcgaccucuga

SEQ ID NO: 6591 - RNA, 4107 nt, Artificial Sequence
  Cas9 variant
augucacgcccauacaacaucggacucgacauuggaacaagcagcaucggguggagcgucguagacgaccagucaaaacucguaagcgucagaggcaaauacggguacggcgucagacuauacgaugaagggcaaaccgcagccgagcgccgaucguucagaacgacucgacgccgacuaaaaagacguaaauggagacuaggccuccuacgcgagaucuuugagcccuacaucacaccgguggaugacaccuucuuucugcgacagaagcaaagcaaccucucgcccaaggaccagaggaaacucuacccucagaccucccuauucaacgaccgcacugaucgcgcuuucuacgacgacuaucccaccaucuaccaccucagguacaaacucaugacagagaaaagacaauuugacaucagagaaaucuaccucgccaugcaccacaucgucaaauaccgcggacacuuccucaacgaagcuccagucucaaguuucaagagcuccgagauaaaccucguugcccacuucgaccgcuugaacacaauauucgcugacuuauucucggaauccggauuccagcucgaaaccgacaaacuagccgagguaaaagcccugcuccuggauaaccagcaaucugccucaaaccgacaaaggcaagcccuaucccuaaucuauacacccuccacaaauaaagcgguggaaaaacaaaacaaggccaucgccacagaacuacucaaagccauauuaggucucaaagcaaaauuuaacguacucacgcgaaucgaggcagaggacgucaaggccuggacccuuacauucaacgccgaaaauuucgaugaagaaaugguaaaacuggaaaguucccuugacgauaaugcccaccaaauaaucgaaucccuccaagagcuguacuccggcauccugcuugcgggcaucgugccggaaaaccaaucccuuagccaggccaugauaaugaaauacgacgaccaccaaaaacaccuuaaaaugcucaaggcuguaagagaagcgcucgcccccgaagaccgacagcgacucaaacaggccuacgaccaauacgucgacggacaggaaaacacaaaagcauauucaaaagaggacuucuacggugacauaacaaaggcgcucaaaaacaacccagaccaccccauaguguccgaaauaaagaaacucauagaacuagaccaguucaugccaaaacaacguaccaaggauaacggcgccauaccccaucagcuccaccagcaagaacucgaucgcauaauugaaaaccagcaacaauauuaccccuggcuugccgagcucaacccaaacuccaagcgccaaacaguggccaaauacaaacucgacgaacucguggccuucagaguccccuacuacgucggaccacuaaucacagcagaacaacagagacaaucgagcgacgccaaauucgcaugguugauccgcaaggccgaagggcgcaucacacccuggaauuucgacgacaaagucgaucgacaagcgucugccaacgaguucauaaaacgcaugacgacgacagacacauaccuacuagcugaagacguacuucccaagcaaagccucauauaccaacgguucgaagugcucaacgaacuuaacggcuuaaagauagacgaccaaccaauuaccacagaacucaagcaagccaucuucaccgaccucuucaugcagaaaaccucagucagcgucaagaauauacaagacuaucuaguaagcgaaaaacgauacgcaucacgcccagcaaucaccggacuauccgacgaaaauaaauuuaacagcaggcuaagcaccuaccacgaccuuaaggcaaucgucggagacgcggucgaagacguagacaaacaaguggaccuagaaaaauguguagaauggucaacgauauucgaagacggaaaaauuuacuccgcgaaacucaacgagaucgacugguuaaccgaccaacagcgcguacagcuugcggccaaacgguaccgaggcuggggccgccuaagcgccaaacugcucacccagaucguaaacgccaacggccaacgcaucauggaccuccuuugggacaccaccgacaacuucaugaggauaguacacagcgaagacuucgauaaacugaucaccgaagcuaaccagaugaugcucgccgaaaacgacguacaagacguaauaaacgaccucuacacauccccgcaaaauaagaaagcucucaggcagauucuucucgucgugaacgacauacaaaaagccaugaaagggcaagccccagaacgcauacucaucgaguucgcacgugaagaugaagucaacccccgucucucgguccagcguaaacgacaagucgaacaaguuuaccagaacauaaguaacgaacuacuuaacaacacagaaauccgcaacgaacucaaagaccucucaaacagugcacucuccaacacacggcuuuuucucuacuucaugcaaggaggacgggacauguacacaggagacucccucaacaucgauagguuaucgacguacgacaucgaccacaucuuaccgcagagcuuuaucaaagacaacagccucgauaaccgaguccuaguaucgcagaaaaugaaccgcucuaaggcggaucaggugccgacugacuuuacauccguugagcuaggcaaaaagaugcaauuacaaugggaacaaaugcuccgcgcaggacucauaacaaagaagaaauacgacaaucugacccucaacccugaccacauaagcaaauacgcaaugaaaggguuuauaaaccgccaauuaguggagacccgccaggugauaaaacucgcuacgaaccuccuaauggagcaguacggagaagacaacauugaacucauaaccguaaaaagcggccucacgcaccaaaugcgcacggaauuugacuucccgaaaaaucguaaccuaaacaaccaccaccacgccuucgacgccuaccucaccgcuuucgucggacucuaucuccucaaacgcuaucccaaacuaaaaccauauuucguuuacggagaauaucaaaaagcgagccaacaagacaaauggcgcaacuucaauuuccuaaacggccucaaaaaggacgagcuaguugacgaaaauacagaagccguaaucugggacaaagaguccggccuugccuaccuuaacaaaauauaccaauucaagaaaauacucgucacccgcgaagugcacgagaacagcggcgcccucuucaaucaaacacuguaugcagccaaagacgacaaggccucaggccaaggcggaaaacaacuuaucccugccaagcaggaucggcccacugcacuuuauggaggauacuccggcaaaacuguagccuauaugugcaucguacgcaucaaaaauaagaaaggcgaucucuacaaaguaugcggugucgagaccucauggcucgcgcaacuaaaacaauuaaccgacgaggauucacagaaagccuuccucaaacagaaaaucagcccacaauuuacaaaagugaagaaacaaaaggggacaauaguaaaaguaguagaagauuucaaagucauagcuccccacauccucaucaaucagcgauucuucgacaacgggcaggaacuaacacuaggcucagcgaccuacaaacacaacgaacaagaacugauacucgacaaaacagcggugaagcuccucaauggcgccuuacccuuaacgcaguccgaagaacuagcggagcaggucuacgacgaaauacucgaccaagucaugcacuacuuuccccucuacgacaccaaccaauuccgugcaaagcuauccgccggcaaagcagcauuuaugaaacuaccguggaaaucgauuugggacggcaacaagaugacgcaaauagggcaacaaaucauucuagaccgcauccucaucggccuucaugcuaacgcagccguuuccgaucugggcguuuuaaagauaagcacaccacucggaaaaaugcaacaacccagcggaauaucccuuagccccgauacccaaaucauauaccagagccccaccggacuauucgagcgacgaguagcccuccgugaccuauga

SEQ ID NO: 6592 - RNA, 4107 nt, Artificial Sequence
  Cas9 variant
auggucgagaagaaaagcuacagcauaggacucgauaucgguaccaacucagucgguugggccgucauuacggacgacuacaaaguccccgccaagaaaaugaaaguacuaggcaacacaucucgccaaagcaucaaaaagaacaugauaggcgcacuacucuucgacgaaggaggccccgccgcuuccacccgcgugaaacgaaccacacgacggagauacacacgccgcaaaaacagacucuguuaccuccgagacauauucgaauccgaaaugcauaccaucgacaaacauuucuuccugaggcucgaggacuccuuucuacacaaguccgacaaacgauacgaggcgcaccccaucuucggcacacuucaagaagaaaaggccuaccaugacaacuaccccacuauauaccaccucagaaaagcacucgcggacaacaccgaaaaagccgaccuucggcucauauacuuagcccucgcacacaucauaaaauuuagaggucacuuccucaucgagggagcccucagugcgaacaauacagacgugcagcaacugguucacgcgcuuguagacgccuacaacaucauguucgaagaagaccaacuagacauagaagcuauagacguaaaagccauccuuaccgaaaagauaucgaagacucgccgucucgaaaaccuaaucucgaacauuccugggcaaaagaaaaacggccuauucggcaaccucaucgcacugucccuuggccugacacccaacuucaaaucgcacuucaaccugcccgaggaugccaaacuccaacucgccaaagacacguacgacgaagaacucaauaaccuacucacccagauuggggacgaauaugcagaccucuuccucagcgccaagaaccuauccgacgcaauccuauuguccgauauacuaaccgugaacggcgacgggacucaagcaccguuguccgcaucacuaauuaagagauaugaagaacacagacaggaucuagcgcuacuuaaacagauguucaaagaacaacuaccagaucuuuaccgcgacgucuucacugacgagaacaaggacgguuaugcagguuacaucuccggcaaaacaucccaggaagcauucuacaaguacauaaagccgauucucgaaacccuagacggagcagaagauuuccucacaaaaaucaaucgcgaagacuuccuccgcaaacaacguaccuucgacaacgguagcaucccacaccaaauacaccucggcgaacuccaagccauccuagagagacagcaagccuacuaccccuuccucaaagacaaccaggagaaaauagaaaagauucuaaccuuccgcauccccuauuacaucggcccccucgcccgaggaaacucacgcuucgccuggcuaaccaggacaagcgaccagaaaaucaccccguggaacuucgaugaaaugguugaucaagaagccuccgcccaggcuuucauagaacgcaugaccaacuucgacgaauaucuuccgcaagaaaaaguccuccccaaacauucacuaaccuacgaauacuucacgguauacaacgaacucaccaaagugaaauacgucaccgaaggcaugaccaagcccgaguuccuaucugcaggacaaaaagaacaaauaguagaacuccuguucaaaaaguaccgaaaggugaccguaaaacaacuaaaagaagacuucuucagcaaaaucgaauguuucgacacggucgacaucuccgggguagaagacaaauucaaugcaucccuggggacguaucacgaucuacugaaaaucaucaaggacaaggcuuuucucgauaacucugaaaacgagaacauaaucgaagauaucauacuuacacuaacccuguucgaagauaaagaaaugaucgccaaccgacucgcugucuacgaggaccuguucgaccaaaacguacucaaacaacucaaacgccgccacuacacaggauggggcagacucucgaagcaauuaaucaacggcaugcgagacaaacacaccgggaaaaccauacuagacuuccugaaagccgacggguucaucaaccgcaauuucaugcaauugauuaacgacgacaaccuauccuucaaggaggagauuaagaaagcccaagaaggcggcuuaaaagauagcaucaacgaucaaauccgcgaccucgcaggcucacccgcaauuaagaaaggcauacuccaaaccaucaacaucguagacgaaaucguaaaaaucaugggcaaggcuccccaacacaucguagucgaaauggcccgagacguccagaaaacagacaucggaguuaagcaaagccgggaacgaaugaaaagagugcaagaaguccuaaagaagcuaggcucccagcugcucaaagaacaccccguagagaacuuccaacuacaaaacgagcgacuuuaccuauauuacuugcagaaugguaaagacauguauacgggggaggaacucuccaucuccaaccuaucucacuacgacauagaccauauuauaccccgcuccuuuauaaaagaugacucgauagauaacaagguccucacccgaucagaacacaaccgcggaaaaaccgacaacgucccaagcauugaaguaguaaagcgcaugaagccguacuggcaaaagcuacucgauaccaaggucaucagccaaagaaaauuugacaaccuaacuaaggcagaacgagguggccuccaggaaagcgacaaagccaacuucauacaacgccaacuuguagaaacccgccagaucaccaaacacguggcucagauacuagacagccgcuucaacaccgaacgagacgagaaggaccguccaauccgccgggucaagguaauuacacuuaagagcaaauucguauccgacuuccgacaagacuucggcuucuacaaauuacgggaaauaaacgacuaccaccacgcccaugacgcuuaccuuaacgccguaguggggaccgcccuccugaagauguacccaaaacucgccucagaguucguuuauggugacuaucaaaaguacgaccucaaaagaaugguaggcaaaagcggaaaggcauccggacacgcaacggccaaauacuucuucuacuccaaccucaugaauuucuucaaaagcgaaguaaaacuugcuaacggcaacauaauaaaacgaaguccgaucgaagucaacgaggaaacgggggagauaguaugggacaaaaccaaagacuucggaacaguucgaaagguccucuccgcaccccaaguaaacauaguuaaaaagacggaaauacagaccggaggcuucaguaacgagacaauccucucuaaaggaaaaucgucaaaacucaucccacgcaaaaacaaguggcgcgauaccaccaaauacggcggcuucaauacacccaccguagcuuacuccguccuaguggucgcgaaggucgaaaagggcaaagcaaagaaacucaaaccgguuaaagagcucguaggcauaaccaucauggaacguacuaaauucgaggccaacccgauagcauuccuagagucgaaaggguaucacgacauucaagaacaccugaugauaacgcugccaaaauacucccuauucgagcuagaaaacggaagaaggcgccuccuggccuccgcaacagaacugcaaaaaggcaacgaaaugguccuuccgcagcaccucgucacguuccucuacaggguuucaaaacgcgacaaaggaacccaauccgaaaauauggaguacaucuccaaccacaaagagaaguucauagaaauauuccauuacaucaucagauacgcagaaaagaacgucauaaagccgaaggucaucgagaggcucaacgauaccuuuaaucaaaaguucaacgacagcgacuuaacggagcucagcauaucguuccucaaccuauuuaaguucacauccuucggagccccugaaaaauucacguuccuaaacucagaaaucaagcaagacgacguccgcuaccggucgaccaaggaaugccugaacuccacccuaauccaccaaucgguaacuggucuguacgagacgcgcaucgaccuaagccaauuuggcggggacuga

SEQ ID NO: 6593 - RNA, 4107 nt, Artificial Sequence
  Cas9 variant
auggauaagaaguacucuaucggccuggacaucggcacaaacuccgucggcugggcggugaucacggacgacuacaaagugcccucaaagaaauuuaaaguccuuggaaacaccgaccggcacagcaucaaaaagaaucucauaggcgcacucuuauucgacuccggcgagaccgcugaagccacccgacuaaagcgaacagcucgcagaagauacacccgacgcaaaaacagaauuugcuaccuucaagaaaucuucucgaacgagauagccaagguagacgauuccuucuuccacagacucgaagagucauuucuuguggaggaggacaagaaacacgaacgucaccccauauucggaaacauagucgacgaaguggcauaccacgaaaaguacccaacaauauaccaucugcggaagaaacuagcggacucaaccgacaaagcggaccuccgguugauauaccuugcacuggcccacaugaucaaguucagaggccacuuucuaauugagggcgaccuaaaucccgacaacuccgacguagacaagcuauucauccagcuaguccaaaccuacaaucaacucuucgaggaaaauccuaucaaugccuccagagucgacgccaaagccauccugucugcccgacucucgaaaucccgccgacuagagaaccugauagcacagcuacccggggagaaacgaaacggccucuucggcaaccucauagcccuuucuuuaggccuuacccccaacuucaaauccaacuucgaucuggcagaagacgccaaacuccaacuuucgaaagacaccuacgacgacgaccuggacaaccuguuagcgcagaucggcgaccaguacgccgaccucuuuuuggcagccaaaaaccucuccgacgcaauccuacuuagcgauauccuacgcgucaauaccgagaucacgaaagcaccacuauccgccucgaugaucaaacgcuacgaugaacaccaccaagaccucacacuccuaaaggcucucguccggcagcaacucccggaaaaguacaaagagaucuucuucgaccaauccaagaacggcuaugcaggcuacauagacggaggagcaucccaagaggaguucuacaaauucauaaaaccaauacuagagaaaauggacgggaccgaggaacuccucgcuaaacucaaccgagaagaucuccuacgcaagcaacgcacauucgauaacggauccaucccccaccagauccaccucggcgaacuacaugccauccuacgucgucaagaagacuucuaccccuuccuaaaagacaacagagaaaagauagagaaaauacuaacauuccgaauccccuacuacgucggcccacuggcaagaggcaacagccguuucgcuuggaugacacgaaagucagaagaaaccaucacccccuggaacuucgaagaggucguagauaagggggccuccgcucaaucauucaucgaacgcaugaccaacuucgacaaaaaucugccaaacgagaagguacugcccaagcauagccuccuauacgaguauuucacugucuacaacgaacucaccaaagugaaauacgucacagagggaaugcgcaaaccggcauuccucucgggcgaacagaagaaagcgauagucgaccuccucuucaagaccaaccgcaaaguaacagucaaacaacucaaggaagacuacuucaagaagauagaaugcuucgacucagucgagaucagcggggucgaggaucgauucaacgcgagccucgguacauaucaugacuugcucaaaauaauaaaagacaaggacuuccuagacaaugaggaaaacgaggacauucuagaagacaucguccucaccuuaacccuuuucgaggaucgagaaaugaucgaagaacggcuaaagaccuacgcacaccucuuugacgacaagguaaugaagcaacuaaagagaaggcgauacaccggauggggccgacucucucgcaaacucaucaacgggauacgcgacaaacagucgggaaaaaccauucucgacuuccuaaaguccgacggcuuugcaaaucgcaacuucaugcaacuaauacacgacgauucccucaccuucaaagaggaccuacaaaaagcucaggugaguggccaaggggacucgcuucacgagcacaucgccaaccuagcagguucuccggcaauuaagaaaggcauccuucagaccgucaaagucguggacgagcuuguaaaagucaugggccggcacaagcccgagaacaucguuauagagauggcccgcgaaaaccagacgacccaaaaagggcaaaagaacucgcgcgagcgaaugaaacgcaucgaggaaggcauaaaggaacucggcucagacauacugaaagaauacccuguugaaacaacccagcuacaaaacgagaaacuauaccuauacuaccuacaaaacggucgagacauguacgucgaucaagaacucgacaucaaccgacucagcgacuacgacguugaucacaucguaccccagucauuccuaaaagaugauagcaucgacaacaaaguccugacaagaucugacaagaacagaggaaaaagcgacaacguccccagcgaagaaguggucaagaagaugaaaaauuacuggaagcagcuacugaacgcaaagcugaucacccaacgcaaguucgacaaccugacgaaagcggagcgagggggccugagugaacucgacaaagccggguucaucaaacgccaacucguagaaacccgccaaaucaccaagcacguagcccaaauacuagacagccgcaugaacacgaaauacgaugaaaacgacaaacugauacgcgagguacgagugauaacacugaaaagcaaacucgucagcgacuuccgcaaagauuuccaauucuacaaagugcgagaaauaaauaacuaccaccacgcccacgacgccuaccuaaacgccguaguaggaaccgcguuaaucaagaaauauccuaaacucgaaucagaguucguguacggcgacuacaaggucuacgacauccggaagaugaucgcaaaauccgaacaggaaauuggcaaggccacggcaaaauacuucuucuacucgaacaucaugaacuucuucaagaccgaaaucacacucgcaaacggcgaaauccgaaaacgaccuuuaauagaaaccaacggagaaacaggcgagaucguuugggacaaaggacgcgauuucgccacagugcgaaaaguccuguccaugccgcaagucaacaucguuaagaaaacagaagugcagaccggcgguuucuccaaagaauccauccuacccaaacgcaauagcgacaaacucaucgcgcgaaagaaagauugggaccccaagaaauacggcggauuugacuccccgacggucgcauacuccguacucguuguagccaaaguagaaaaaggaaaaucaaagaaacuaaaaucggucaaagagcuagucgggauaaccaucauggaacgaagcucguuugaaaaagacccgguggacuuccuugaagcaaaaggcuacaaagaagugcgcaaagaccugauuaucaaacucccaaaauacucacuauucgaacucgagaacggacgaaaacggaugcucgccagcgccggagaacuccaaaaagguaacgaacuagcacucccgucuaaauacgugaauuuccucuaccuagcaucgcacuacgaaaagcucaaggggucgccagaagauaacgaacaaaagcaacuauucguggaacagcauaaacauuaccucgacgagaucauagagcaaauaagcgaauuuucgaaaagggucauacucgccgacgcgaaucucgacaagguucucagcgcguacaacaagcaccgagauaaacccauacgcgaacaagcggaaaauaucauucaccucuucacccucacaaauuuaggagcacccgccgcuuucaaaugcuucgacaccacuaucgggaggaaccgguacaaguccaucaaagagguuuuagacgcgacgcugauucaccaaucgaucaccggccuauacgagacgcgcaucgaccuaucgcaacucggcggugacuga

SEQ ID NO: 6594 - RNA, 4107 nt, Artificial Sequence
  Cas9 variant
auggauaagaaauacuccauaggacuagacauuggcaccagcuccauaggcuucgucggcgucgacgaaaacggguggccauuaaacaucaaaggcaagagagcgaucggagcacaucuauuccgcgaaggcgaagccgcggcagaaacccggggauuccgaacaacacgccgccgcuacaaccggcgcaaauggcgacuuagacugcuacgggaaauauuugacgaaccaauuucucgaguugacccgaccuucuucgcgcgcaugaaagaauccuccgucucgccaaaggaccccaacuacgacggacuggccaaagaaauucuaauuccgcgcgacaaagacggcaaaauacucuacccgaccauauaccaccuucgccacgcccuaauguacgaagaucaucaauucgacauccgcgaaauauaccucgccauucaccacauagucaaguaucgcggccacuucuuacucgacggggcggccaaaaauuucgaauccucaaaucuagaccucaaguccgacauccacgagaucaacgccauacugguaggaauuuucggcaaugagcaaguccaguucaacgaccaauauguggagaaacucaaggaagugcuccuugauuccacucaaucccgcuccgacagacagaaagcagccgccaaacuacuacuacccaccaacgaccucgacaaggacacuacgaaaauccuuaagaccgugaguacagagaucaccaaggccaucacggggcugaaagcaaaguucuuugucaucaccggaaacgauauugccaaagaccaacaaaaggacuggacauucucgauugacacucuggacgaaaagaugucugucaucgaacccucuuuuagcgagaaaaacuuuagucucauaaccauacuacagaaacuauacucuuccgucacacucgcaggcauugucccaaacgggcucucgcugucggaagccaugauccaaaaauacgaucgacacgccucagaccucguacuucugaagaaauacugggacacaaaaccaaaaguucuaaaacaccaacuccaaaauacguacgccgaguacaucgaaauccaccaagucguagacgaguucuacagcgaccucagcaaacuaaucaaaaacgacgacgacacacuggcccaagaaauaaagagcaaaauaacuaucggcaauuuccuccccaagcagaggacaaccgaaaacggcgugauacccuaccagcugcagcagcgggaacuagacacgaucaucaaaaaccagcaggaguacuacccguggcucgcagaagaaaaccccgucgccgaccaccaaauagccuuccccuacaagcucgacgagcuagucggguucagaaucccuuauuacgucggccccaugaucgccaaagaagauacaucaaauucaaagaacuccaaguucgccuggaugauucgcaaacagucuggugaagucacccccuggaacuucgacgaaaagauagaccgcacagcuagcgcuacugccuucauagaccgcaugaccacuaccgacaccuaccuaauuggagaggacguccuacccaagcaaucccugauauaccaaagauucgagguuuugaaugaacugaacaaaaucucuauagacggccaacccaucacgcggaaacaaaagcagucagucuacacacacguguucgagaaaaagaaaaccguacaggucaaagacguccaaaaauuccucguaagcucaggcgaaguaaugucccucccaaaaauagguggacuugcaaaugaaaagcaguucaacucaucacuaucgacacucuaugacuacaacaaaauuauccccgacgcgcuugaagaccgcaacaaaguagacgacauagagaaaaucauccucuggucgacuauuuucgaagacaauuccauuuucguugaaaaauuggacucgauagacuggcuuaccuccucccaacggaaacgacuagcccaaaaacgauacagaggcuggggaagacucucccuccgacuguugaccacauucaagaauaaagacggcuacagcauccucgacgaacuuuggaacucgaaccacaacuucauggaaauccaagcccaguccgauuucuccgagcaaauagccacggcgaauaacaacaaccucucccaaguccucccugccaaaugggaaccaggacgcaaaaaccuagcaucacuggaugaauuuaucucaaaucucuacaccuccccacagaacaagaaagcgcuucgaaaagccauccgcgucguccaagacaugaugacagccgccggacacaugcccgagaaaauuuucaucgaagucgcacgcgacaccuccaauagccaccagcaaacgauagcacgccaacgucaacuacaacaacuuuaccaauccgaggacaaagaggucaucgacuccuccguccggagcgaguuagacgacauccuaaagaaccgagccaacaucaaagaccaacucuuccuguauuuccagcaagguggucgugaccucuacacgggaaaagcuauaaacauagacaaacuaucccucuaccauaucgaccacauucucccacaaucccucguuaaggacgacagccucgacaaccggguacucgugagucagaaaaccaacgaagacaaaggcgugaccuucguuucagacaaauacaugaacaacauguuacccacauggaaacgcuggcacgaaaugggccugauuuccgcccgaaagcucaagaaccuaacaaugcgcccagacgaaaucgauaaauacgcccccggcuucauccagcgccagcucgucgaaacgagacaggucacuaagcuagucaucgagcuccucgacgcauuacuuggaaacucccaaacagaaaucauaacuauaaaagccucccucagccaucaguucagacaacaauucgaccuaguuaagaucagagaagucaacgacaaucaccacgccuucgacgcauucuuggccgcccgcaucggcaccuaccuauacaaacgcuaccccaagcuccgcccuuacuucgucuacgggcaauacaugcaaaaucauaaaaaccuaaaauccaucaacuuaauuaaaacccucgacagcgacaaggcaauuguagacgaaggcaccggcgagauccuaugggacaagaaaagcgaccuugccaaaaugaucaagaucuacaacuaucaacggcugcucauaacacacgaaucaaggaccagcuucggcgcaauguacaaacagaagauccucaaagcgaccgaugcgaaacaaaacggaggcggcuuuaagcuaguacccacaaagcgcaacagacccguagacauauacggcggcuacacaggacaaaccgccgccuaccugacaauaguccgcgucuacaguaaaaagacgucagaacuuagaguacuacccauauacacaaacaaaguacagcaaaucgaaaaagccaugacccaaggagacaaggcaaccaugcuagcauuuaaaaaggucaucgcaccccaacuaggaaaagagaacaagaaaacgcaugaaaucaaaauccccgaguucgaugugguaauccccaaaguucuuuuagaccaacuugucauagacgacauagcagguucgccacaccgauuucgccuuggcaccgacaccuacuaucacaacucacaacaacucuuccucccuuuaagcaugcagcgucagcucauggaucgggaaagugaugauaaagucuaccucgacaucuucaacgacguucugaaacagguugacagcuacuucaaccucuacgacgucaauggcuuccgagccgcgcuacagaaaagcaaaaaggcauucgaacaacucccuaucaacgacuucccaaaggacguccccgacaacaagaagaagaaaggcaaacgcucuauccuaaaagaaaucuucaucggacuccaugccaacgccacacucggaaaccuuaaacagauggguaucaaaaccgacuucggcaaacuccagaaaucgaacgggcuccgcaucaccgaaaacugcaaaaucauccaucagagcccuacaggccuuuucgaacgcauuguacccauuaaauga

SEQ ID NO: 6595 - RNA, 4107 nt, Artificial Sequence
  Cas9 variant
auggacaagaaauauuccauuggccucgacaucggcacaaauucagucggcugggcaguaauaaccgaugacuacaaagucccguccaaaaaguucaagguacucggcaacaccgacaggcacucgaucaagaagaaccuuauuggcgcacuucucuucgacaguggggaaauagccgaagccacacgacucaaacguaccgcacggcgcagauauacacguaggaaaaaccgaaucugcuaccuccaagaaaucuucagcaaugaaauggccaagguggacgacucauucuuccaccgccuugaggaguccuuucuggucgaagaagacaagaaacacgaacggcaccccaucuucggaaauauaguugacgaaguugccuaccacgaaaaauaccccaccaucuaccaccucagaaagaaauuaguggacuccaccgacaaggcagaccuaagacugauauaccucgcacuagcccacaugaucaaguuccggggccacuuccuaauugaaggcgaccucaauccagacaacuccgacguagacaaacuguucauccagcuaguccaaacauacaaccaacucuucgaagagaacccgaucaacgcgagcggaguggacgcaaaagcaauucucuccgcccgacucucgaaaagccgaagacuugagaaccucauagcccaacuccccggcgaaaagaaaaacggucucuucgggaaccucaucgcccuuucacucggucucacgccaaacuuuaaaaguaacuucgaccucgccgaggaugcgaaacuccaacucuccaaagacacauacgacgacgaccucgacaaccuucuggcccaaauaggggaccaguacgccgaucuauuccucgccgcgaagaaccucucagacgcgauccugcuguccgacauacuucgacuaaacucugagaucacaaaagcaccccucucagcaagcaugaucaagcgcuacgacgaacaccaccaagaccuaacguugcuaaaagcccuaguucgccaacagcugccugagaaauauaaagaaaucuucuucgaccaauccaagaacggauaugccggauauauugacgguggcgcaagccaggaagaguucuacaaauucaucaaacccauccucgagaaaauggacggaaccgaagaacugcucgcaaagcucaaccgagaggaccuccuacgcaagcaaaggaccuuugauaacggaagcauaccccaccaaauccaccucggggagcuacacgccauccugcgaagacaagaagacuucuauccauuccuaaaagacaaccgugagaagaucgaaaagauacuuacauuccgaauacccuacuacguaggaccgcuggcaagaggaaacucccgcuucgccuggaugacgagaaaaucggaggagaccauaacaccauggaacuucgaggaaguagucgauaaaggagcuagcgcacagagcuucaucgaacgcaugacaaacuuugauaaaaaccucccaaaugagaaaguacuccccaagcacucccugcuauacgaauacuucacagucuacaacgagcucaccaaagugaaguacgugaccgaaggcaugcgcaaacccgcguuccuaagcggggaacaaaagaaagccauagucgaccuacuauucaagacgaacagaaaggucaccgucaaacaacuaaaagaagauuacuucaaaaagaucgaaugcuucgacagugucgaaauaagcgguguagaagaucgauucaacgcgucccuuggaaccuaccacgaccuccuaaaaaucauaaaagacaaagacuucuuagauaacgaagaaaaugaggacaucuuggaggacauaguucucacccucacacuguucgaagacagggaaaugaucgaggaacgccucaaaaccuacgcccaccuuuucgacgacaaagucaugaaacaacugaaacgccgccgcuacacagucuggggacgauuaagccgcaaacuaauaaacggcauacgggauaaacagucaggcaaaacaauccuggacuuucugaagucggacggauucgcgaaccggaacuucaugcaacucauccacgacgacucgcucaccuucaaagaggacauacagaaagcacaaguaagcggccagggagacagucuacacgaacauaucgccaaccucgccggauccccagcaauuaaaaagggaauccuccaaaccguaaaagucgucgaugaguuggugaaagucaugggcagacacaaacccgaaaacauaguuaucgagauggcccgcgaaaaccagaccacccaaaaaggacaaaagaacucacgagaaagaaugaaacggauagaagaagguauaaaagaacucggaagccagauccucaaagagcaccccgucgaaaacacacaacugcagaacgaaaaacuauaccucuacuaccuacaaaacggccgcgacauguacgucgaccaggagcucgacauaaaucggcuauccgacuacgacguagaccauaucguaccccaguccuucaucaaagacgacucaaucgacaauaagguccucacccgauccgacaagaaccgcggcaagagugacaacguaccuuccgaagaggucguaaagaaaaugaaaaacuacuggcgccagcuccuaaacgcaaaacuuaucacccaaagaaaguucgacaaccuaacuaaagccgaacgagggggccucagugaauuggacaaggcgggauucaucaaacgacaacucguggaaacccgacaaaucaccaaacacguggcccaaauacuagauagcagaaugaacacgaaauacgacgagaacgacaaacuaauccgcgaagugaaagucauuaccuuaaaaucuaagcuaguaagcgacuucagaaaagacuuccaauucuacaagguacgggagaucaacaacuaccaccacgcccacgacgccuaccuaaacgccguaguaggaacugcucucauaaagaaauacccuaaacuagagagcgaguucgucuauggagauuacaaggucuacgaugucagaaagaugcucgcaaaauccgagcaagagaucggcaaggccacggcaaaauacuucuucuauagcaacauaaugaacuuuuucaagacagaaaucacucucgcaaauggcgaaaucagaaaacgccccuugauagaaacaaacggcgaaaccggcgaaauagucugggacaaaggccgcgacuucgcaacuguccgaaaaguacugagcaugccacaagucaauaucguaaagaagaccgaaguacaaacaggagguuucuccaaggaaagcauacugccuaagcgcaacagcgacaaacucauagcccgcaaaaaggacugggacccaaagaaauacggaggcuucgacuccccgacugucgccuacucuguccucgugguagcaaaagucgagaaaggaaaaagcaagaagcuaaaaucagucaaagagcuccucggcaucaccauaauggaacggagcuccuucgagaaaaaccccaucgacuuucuagaagccaaaggguauaaagaagugcggaaagaccugauaaucaaacuaccaaaauacucccuguucgaacucgagaacggccgcaaaaggaugcuagcgucagccggugaacuucaaaaaggaaaugaauuagcacucccaagcaaguacgucaacuuccuguaccucgcaagccauuacgaaaagcugaaaggaagccccgaagacaacgaacaaaaacaacuguucguagaacaacacaaacauuaccuagacgaaaucaucgaacaaaucuccgaguucucaaaacgugugauccuggcagacgccaaucuagacaagguccucagugcauacaacaaacaucgagacaagcccauaagagaacaagcugagaacaucauccaccuauucacccucacaaaccugggcgccccgacagcauucaaauauuucgauaccaccaucgaccgaaagagguacaccucaacaaaggaagugcucgacgcgaccuucauccaccaauccaucacgggacucuacgaaacacggaucgaucucagccaacuaggcggcgacuga

SEQ ID NO: 6596 - RNA, 4107 nt, Artificial Sequence
  Cas9 variant
auggacaagaaauauucaaucggucucgacaucggaacgaacagcgucggaugggccgucaucaccgacgacuauaaaguacccagcaagaaauucaaaguccugggcaacacggacagacacucgaucaagaaaaacuuaaucggggcccuccuguucgacuccggcgagacggccgaagcgacacgacucaaacgcacugcacggaggcgcuacacccggcgcaaaaaucgaauaugcuaccuacaggagauauucucgaacgagauggcgaaaguagacgacagcuuuuuccaccgucuagaagagagcuuccuaguagaagaagacaagaaacacgaaaggcacccgauuuucggcaauauaguggacgaagucgccuaccaugagaaauacccgaccaucuaccaccuacguaaaaagcuaguagacucaacggacaaagcagaccuucgacucaucuaccucgcacucgcacauaugaucaaauuccgaggacacuuccucauagaaggcgaucuaaaucccgacaauuccgacgucgacaaacucuuuauccagcugguccaaacguacaaucagcuguucgaagagaaucccaucaacgcauccggagucgacgcgaaagccauccuauccgcgcgucucagcaaaagcagaaggcucgagaaccucaucgcccaacuaccaggagaaaagaaaaacggccuauuuggcaaccuaaucgcacucucccucggauuaacaccaaacuucaaaaguaauuucgaccucgccgaagacgcuaaacuccaacucagcaaggacacauacgacgaugacuuagacaaccuccuggcccaaauaggagaccaguacgccgacuuguuccuggccgcuaaaaaccuaucggacgcaauccuucucucagacauccugcgacucaacucggaaaucaccaaggcaccccucagcgccucuaugaucaaacgguacgacgagcaucaccaagaccucacccuccuaaaagcgcugguacgccaacaacugcccgaaaaauacaaagaaaucuucuucgaccaauccaaaaacggcuacgcgggcuacauagacggcggcgcgucacaggaggaguucuauaaauuuaucaaacccauacucgagaaaauggacggcaccgaagaacugcuugcaaaauuaaaucgugaagaucuccuucguaagcaaagaacguuugauaacggcucaaucccacaccagauccaccucggggaacuucacgcgauucuccgcagacaggaagacuucuacccuuuccucaaagacaaucgggagaaaauagaaaagauacucacauuccggauccccuauuacgucggcccucucgcccgcggcaauucccgcuucgccuggaugacacguaaaagcgaagaaacaaucacgcccuggaauuuugaagaaguaguggauaaaggggcauccgcacaauccuucauagaacgaaugaccaacuucgacaaaaaccugcccaacgaaaagguccugccaaaacacucccugcuuuacgaauacuucacaguuuacaaugaacuaacgaaggugaaauauguaacagaaggcaugcggaagcccgccuuccugucaggcgaacagaagaaggcgaucgucgaccuccuauucaaaaccaaccggaaagugacaguaaaacagcuaaaggaagauuacuucaagaaaaucgaaugcuucgacagcguugaaaucagcggcguggaagaucgcuucaacgcgagcuuggguaccuaccacgaucugcuuaagauaaucaaagauaaagacuuccuugacaacgaggagaacgaggacauccucgaggauauuguccuuacccucacccuauucgaggaccgcgaaaugaucgaagaaagacucaaaaccuacgcccaccuauuugacgauaaagucaugaaacagcucaaacggcgaagauauaccggauggggacgacuaagucgcaaacucaucaacggcaucagagacaaacagucaggcaaaacaauccucgacuuccuuaagagcgauggcuucgcgaaucguaacuuuaugcaacugauucaugacgacucgcucaccuuuaaagaagacauacaaaaagcacaagucuccggccagggagauagccuacacgagcacauagccaaucucgcgggguccccggcaauuaagaaaggaauccuacaaacggugaaagucgucgacgaacucguaaaaguaaugggcaggcacaagccagagaacaucgucauagaaauggcgcgagaaaaucaaacaacacagaagggccagaaaaacucccgcgagcgcaugaagcggaucgaggagggaaucaaagaacuuggaucacaaauacugaaagaacacccagucgaaaauacccagcuccaaaacgagaaacucuacuuauacuaccuccagaacggucgcgacauguacgucgaccaagaacuagacaucaaccgccucucagacuacgacguagaccacauaguaccccagagcuucauaaaagaugauagcauagacaacaaaguccucacaagaagcgauaagaaccgcgggaaauccaauaacguuccgagcgaagaaguagugaagaaaaugaaaaacuacuggcgccaacuacuaaacgccaagcucaucacucaacgcaaauucgacaaucucacaaaagccgagaggggcggccucucagaacucgauaaagcuggguucaucaaacgacaacucguagaaaccagacaaauuacuaaacaugucgcccaaaucuuagacagccgaaugaacacaaaauaugacgaaaacgacaaacuaauccgagaagucaaagugaucacccucaaaagcaagcuagucuccgacuuccgaaaagacuuccaauucuauaaagugcgcgagaucaacaauuaccaccaugcgcacgacgcuuaccucaaugccgucgugggcaccgcacucauaaagaaauacccuaaacuagaauccgaguucgucuacggggacuacaaagucuacgacguacgaaaaaugauagccaaaucugagcaagaaaucggcaaagccacagccaaauacuucuucuacagcaacauaaugaacuucuucaaaaccgaaaucacucucgcgaacggagaaauacgcaaacgaccgcucaucgaaaccaacggcgaaaccggcgaaaucgucugggacaaagggcgagacuuugcaaccguccgcaaaguacucaguaugccccaagucaacauagucaagaaaaccgagguacaaaccggugguuucagcaaggaauccauccuaccuaaaagaaacagugauaaacucaucgcgaggaaaaaggacugggacccaaagaaauacggugguuucgacucgccgacaguggcauacagcguccucguaguagccaaaguugaaaaaggaaaaagcaaaaagcucaagucuguaaaagaacuccucggcauaacaauaauggaacgaagcagcuucgagaaaaaccccaucgacuuccuggaagcgaaaggauauaaagagguccgcaaagaucucaucguaaaacucccaaaauacucgcuguucgagcucgaaaacggccgcaaacggaugcucgcgagcgcaggcgaacuucaaaaagggaaugaacucgcccuacccagcaaauacgugaacuuccuauaccucgccucccacuacgaaaaacucaaaggaucaccagaagauaacgagcaaaagcaacucuucgucgaacaacauaagcacuaccucgacgaaauaaucgagcagaucucggaguucagcaagcgggugauccuggccgacgcuaaccuugacaaagucuugucagcguauaacaaacaccgugacaagcccauccgagagcaagcggagaauaucauccacuuauucacacucaccaaucuaggcgccccagcagcguucaaauauuucgacaccaccauugaucgcaagcgguacaccagcaccaaggaagucuuagacgcaaccuucauacaccaaagcauaaccggccuuuacgaaacacgaaucgaccuaagccaacucggcggcgacuga

SEQ ID NO: 6597 - RNA, 4107 nt, Artificial Sequence
  Cas9 variant
augagccgcccauacaauaucggucuggacauaggaacaagcuccaucggauggagcgucguagaugaucaaagcaagcucgucucuguccgcggaaaauacggcuacggcguacgucuguacgacgagggacaaaccgccgcagaacgucgcagcuuucgcaccacccgaagacgacuaaagcgccgcaaguggcgccucgggcuccuacgagaaauauucgagcccuacauaaccccuaucgaugacaccuuuuucuuacgccagaagcaaucaaaccucucaccuaaagaccagcgcaaacucuacacgcaaacguccuuauucaacgacagaaccgaccgcgccuucuacgaugacuacccuacgaucuaccaccuccgauaccggcucaugaccgaaaagagacaauuugauauccgagaaauauaccucgccaugcaccacaucgucaaguaccgcgggcacuuccugaaugaagcccccguaaguucuuucaaauccucagaaauaaacuugguagcccacuucgaccggcucaacaccauuuucgcagaccucuucuccgaauccggcuuccaacucgaaacggacaaacucgccgagguuaaagcccuucuacuugacaaccagcaaagcgccucaaaccgucaacgccaagcucucucgcucaucuacaccccauccacuaacaaagccguagaaaagcagaacaaagcaaucgccaccgagcucuuaaaggcgauucuuggccuaaaggcgaaauucaacguacucaccgggauagaagccgaagacgucaaagcauggacgcuaaccuucaacgccgaaaauuucgacgaagaaauggucaaacucgaaucuaguuuagacgacaacgcccaccaaauaauagaauccuugcaggaacuauacagcggcguacuacuagccgggaucgucccggaaaaccaaucccuaucccaggcuaugaucaccaaauaugacgaucaccagaaacaucucaaaaugcucaaagcagugcgcgaagcccuggcuccgggcgacaggcagcggcuaaaacaagccuacgaccaguacgucgacgggcaagaaaacacaaaagccuauuccaaagaagauuucuacggagacaucaccaaagcgcuuaaaaacaaccccgaccacccaaucguaucggaaaucaagaaacuaauagaacuagaccaauucaugcccaaacagcgcaccaaagacaacggugccaucccucaccaacuacaccaacaagaacucgaccgaaucauugagaaccaacagcaguacuacccauggcucgcggaauuaaaccccaacucuaaacgucagaccgucgccaaauacaaacucgacgagcuggucgcauuucgcguccccuacuacguaggaccacucaucaccgccgagcagcaacgccagagcagcgacgccaaguucgcauggcucauaagaaaagcggaaggucgcauaaccccauggaauuuugacgacaaggucgaccgccaagccucugcaaacgaguucaucaaacgaaugacaacuaccgacaccuaccuccucgcugaagaugugcuacccaaacaaucucucauuuaccagcgauucgaaguccugaacgaacucaauggccuuaaaauugacgaccagccgaucacaaccgaacuaaaacaagcgaucuucaccgaccuauucaugcagaaaaucuccgugacagugaagaacauacaagacuaccugguaucggaaaagcgauacgcgagccggccugcaaucaccggccucucagacgagaacaaguucaacagccgauuauccaccuaccacgaccuaaaaaugaucgucggcgacgcaguggacgaugucgacaaacaggcggaccuggaaaagugcaucgaauggucgaccaucuucgaagacggcaaaaucuauucggcaaaacuaaacgagauagacuggcucaccgaucaacagcgagugcaacucgccgccaaacgauaucgaggcuggggacgccuauccgcaaagcuccucacacaaaucgucaacgccaacggccaaagaaucauggaccuucugugggacacgaccgacaacuucaugagaaucguucauagcgaagauuuugauaaauuaaucacagaagccaaccaaaugaugcucgcagagaacgacguccaggacgucaucaacgaccucuacacgucuccccaaaacaagaaagcccuccgacaaauacugcucguuguaaacgauauacaaaaagccaugaaaggccaagcacccgagaggauacucauagaguucgcacgugaagacgaagugaacuccagacucucagugcaacgcaagaggcagguagaacaaguuuaccaaaacauuucgaaugaacugcucaacaauacagaaauccgcaaugagcuaaaagaccuauccaacagcgcgcucaguaacacacgacucuuccucuauuucaugcaaggcggccgggauauguacaccggagacucccucaacaucgacagacucagcaccuacgacaucgaccauauacuaccccagagcuucauaaaagacaacagccuggacaaccguguccuagucagccaaaagaugaaccgcucgaaagccgaccaaguaccaacagacuucacaucgguggaacuuggacagaaaaugcaaauacaaugggaacaaaugcuacgggccggacugauaacuaaaaagaaauacgauaaccugacacucaaccccgaccacaucuccaaauacgcgaugaagggauucaucaaccgacagcuaguagaaacccgccaagucauaaaacuugcaacaaaccuacucauggaacaauacggagaagacaacauagagcuaauaacagugaaaagcgguuuaacccaccaaaugcggacugaguucgauuucccgaagaaccgcaaccugaacaaccaccaccacgcauucgacgcauaccucaccgcauucgugggcuuauaccuacuuaaacguuacccaaaacucaagcccuacuuuguguacggagaauaucaaaaggccucgcaacaagacaaauggcgcaacuucaacuuccucaacggccucaagaaagacgaacucguagacgaaaacacagaagccguaauaugggacaaagaguccggacucgcguaccucaacaaaauauaucaauucaagaaaauacucgucacgcgaggcgugcacgaaaacaguggcgcccucuucaaccaaacacuauaugcggccaaagacgacaaagcauccggccagggaggcaaacaacucauccccgcaaaacaagaucgcuccaccgcacucuacggcggguacuccggcaaaacggucgcauauaugugcaucguacgaaucaaaaacaagaaaggcgaccuauacaaagucugcgguguagagacuuccuggcuagcacagcucaaacagcuaacggaugaagauucccagaaagccuuccucgaacagaaaaucuccccacaauucacuaaagugaagaaacagaagggcaacaucauagaagccgucgaggaguuugaaguaaucgcaccccauauccugaucaaucaacgauucuucgacaauggccaagaacuaacacucggauccgccacauacaaacacaacgagcaagaacugauccuagacaaaacagcugucaaauugcugaacggagcccugccgcugacacaaucagaagaacucgccgaacaaguauacgaugaaauauuggaccaaguuaugcacuacuucccccuguacgauacaaaccaguuccgagcaaaacugucaacaggcaaagccgccuucaugaagcucccauggaaaagccaaugggacggaaacaaaaugguccaaguaggccaacaagucauacuagaccguauucucaucggacuccaugcgaacgcugcaauguccgauuuaaaaguacucaaaaugacaacacccuucgggaugauucagcaauccacaggcaucacgcuauccgccgauacacagaucaucuaccaaucacccaccggccuguucgaacgaaggguagcgcuacgcgaccucuga

SEQ ID NO: 6598 - RNA, 4107 nt, Artificial Sequence
  Cas9 variant
auggauaagaaauacucaauaggccucgacauaggcaccaacucugucggcugggccgucauaacagacgacuacaaaguccccagcaaaaaguucaaagugcuugguaacacagaccgacauuccaucaagaaaaaccucauaggcgcccuccuauuugacucgggugaaacagcagaagcgacacgacuaaaacggaccgcucgccgcagauacacgcgccgaaagaacagaaucugcuaccuccaggaaaucuuuaguaacgaaauggcaaaaguagacgacucuuucuuccaccgacuagaagaaucauuucucguggaagaagacaagaaacacgaacgccaccccaucuucggcaacaucguagacgaagucgccuaccacgaaaaauaucccaccauauaccaccuacgcaaaaagcuagucgauucaacugacaaagcagaucucagacucauauaucucgcccuagcgcacaugaucaaauuucgcggacacuuccucauugaaggcgaccucaacccagacaacagcgacgucgacaaacuauucauccagcucguccaaaccuacaaccaacuauucgaggagaauccgauaaacgcguccggggucgaugcaaaggccauccuuuccgcucgucuaucgaaaucacgacgacuggaaaaccugaucgcgcagcucccuggggagaagaaaaacggacuguucggaaaucuaaucgcacucucacucggacugacccccaauuucaagucaaacuucgaccuagcggaagacgccaagcuacaacucucgaaagacacguacgacgacgaccucgacaaccucuuagcacaaauaggcgaccaauaugcugaccuguuccucgcagcgaagaacuuauccgacgccauccuccuaagcgacauccuaagacucaacuccgaaaucacuaaagcgccccucagcgcaagcaugaucaagagguacgacgaacaccaccaagaucuaacauuacucaaagcgcuaguacgccaacagcuuccagagaaauauaaagagauauucuucgaucaaucgaaaaacggauacgcaggauacaucgacggaggagcaucccaggaagaguucuacaaauucaucaaacccauacucgagaaaauggacggcaccgaagaacugcuugccaaacucaaccgagaagaucucuugagaaaacagcggaccuuugacaacggaucgauuccacaccaaauccaccuaggcgaauuacaugcaauccucagaaggcaagaagacuucuacccauuucugaaagacaaucgcgaaaagauagagaaaauccucacuuuucgaaucccguacuacguagguccccuggcccgcggaaacagccgauucgcuuggaugacccggaaaagcgaagaaaccauaacccccuggaauuucgaagaaguagucgacaaaggggcauccgcucagagcuucaucgaacgcaugacuaacuucgacaaaaaccuccccaacgaaaaaguccuacccaaacacagccuccuauacgaauacuucacagucuacaacgaauuaacuaaaguuaaauacgucacagaaggaaugcgcaaacccgccuuccugucgggagaacaaaagaaagccaucgucgaccuacuauucaaaaccaacagaaaagucaccgucaaacaacucaaagaagauuacuucaagaaaauagaaugcuucgacagcguagaaauauccggcgucgaagaccgauucaacgcuuccuugggaaccuaccacgaccuacuuaaaaucaucaaagacaaagauuuccucgacaacgaagaaaacgaggacauacucgaggacauaguguugacccuaaccuuauuugaagaccgugaaaugaucgaggaacgcuuaaaaacauacgcgcaccuguucgacgacaaagucaugaaacaacugaaacgucggcgauacacuggcuggggccgacugucgagaaaacucaucaacggaaucagagacaagcaaagcggcaaaaccauccucgacuuucucaaaucagacggguucgccaaccgcaacuucaugcaacuaauacaugaugacucucucaccuucaaggaagacauccaaaaggcccaaguguccggacaaggcgacucccuacacgaacacaucgcgaacuuggccggcucuccggcaaucaagaaaggcauucuccaaaccgucaaaguggucgacgagcuaguaaaaguaaugggcagacacaagcccgaaaacauaguuauugaaauggccagggaaaaccaaaccacccaaaaagggcagaaaaauucgcgagaacgcaugaaacgaauugaggaggguaucaaagaacugggcucgcaaauccucaaggaacacccagucgagaacacccaacuccaaaacgaaaaacuguaccuuuacuaucuccaaaacgggagagacauguacgucgaucaagaacuagacauaaacagacucucagacuacgacguggaucacaucgucccccaaucauuuauaaaagacgacuccauagauaacaaaguccuuacccgcuccgacaaaaaccgcggaaaaucggacaacgucccaucggaggaagucgucaagaaaaugaaaaauuacuggcgccaacuccugaacgccaaacuaauaacucaacgaaaguucgauaaccuuaccaaagcagagcguggcggacuguccgaacucgacaaagccggcuucaucaaacgccaacugguugagacacgccaaaucaccaagcauguggcccaaauccuggacucccgaaugaacaccaaauaugacgagaacgacaaacucauacgugaaguuaaaguaaucacgcucaagaguaagcuaguauccgauuuccgcaaagacuuccaauucuauaaaguccgcgaaaucaacaacuaccaccacgcccacgacgcguauuuaaacgcugucguagguacggcccuaauaaagaaauaccccaaacucgaaagcgaguucgucuacggcgacuauaaaguauacgacguucguaagaugaucgcaaaaagcgaacaggaaauaggaaaagcaacggccaaauacuuuuucuacaguaacaucaugaacuuuuucaaaacagaaaucacgcucgccaacggggaaauacgaaagagaccacucaucgagaccaacggggaaacgggugaaaucgucugggauaagggucgagacuucgcuacagugagaaagguccuaagcaugccccaggucaacaucgugaagaaaacagaggugcaaaccgguggcuucuccaaagaaucaauccugccgaaacggaacagcgacaagcuaauagcccgaaagaaagacugggacccgaagaaauacggcggcuuugacagcccaaccguggcguacuccguucucgugguugccaaaguggaaaaaggaaaauccaagaaacucaaaagcgucaaagaacuccugggacuaacgaucauggaacgaucaucuuucgagaaaaacccaaucgauuuccuagaagccaaaggcuacaaagaagucaagaaagaccucauaauuaaacuaccgaaauacagccuauucgaacuagaaaacgggcgaaagcgcauguuggcaagcgccggagaacuccaaaagggcaacgaacucgcgcuaccgagcaaguacguaaacuuccuauaccuagccagccacuacgaaaaacuaaagggaaguccugaagauaacgagcaaaaacaacuuuucgucgaacaacacaagcacuaccucgacgagauuaucgagcaaauaucugaguucuccaaacgagucauccuagcggaugcaaaucucgauaagguccucucagcguauaacaaacaccgggacaagcccauccgagaacaagccgagaauauaauccaucuguucacacuaaccaaccuuggugcaccagccgcauuuaaguacuucgacaccaccaucgaccggaaacgcuacacaagcacgaaagaaguccuggaugccaccuugauacaccagucaauaacagggcuguacgaaacccgcaucgaccuaagccagcucgggggugacuga

SEQ ID NO: 6599 - RNA, 4110 nt, Artificial Sequence
  Cas9 variant
augaaacggauacuuggacuagaccucgguacgaacucaaucggcugggcacucguaaacgaggcagaaacagucaacgagaaaucgaguaucguuaaacuuggagucaggguuaauccacuaaccgucgacgaacagaaaaauuucgaggcgggaaaaagcauacccacgaacgcaggacgaacacucaaacgaggaaugaggcgcaaccuccaaagauacaaacuuaggcgagacuaccucauccaaugucugaaggaauacggcuggauaacuucagacacacuacuauacgaguguggaaaucgcaccaccuucgaaacauacaggcugcgugcaaaggcuguugacgaggaaauugcacuagaggaacucggcaggguccuccucaugauuaacaagaagcgcggcuacaaaagcaacagaaaagccaaaagcagcgacgaaggccagcugaucgacggcauggcaauagccauggacauguaccacaaugguaccacacccggagaauacguauauucccuccuaucaaaaggaaagaaauacauacccgucuuuuaccgcagcgaccucuuggacgaauuugaccgcauaugggacuaccagugcgccuacuaccccgacauccucaccucacaauucaaggaacucauacgaggcaaaagcagccaagugacgucaaaacuauucaaacaacaauacaaccuauucaccgcagacaacaaggaaaaggauaagcgccugcaggcguacugucgacgcgcggacgcgcucaagaaacgccuuccagucgaagaagucgcggccgcacuaugcgaugucaaucgcgacgugaacgcauccuccggcuaccucggaaccauaagugacagauccaaaaagcuauucuucaacaaacaaaccgugggacaguaccucaugcucgaacuagacaaagacagccacuucucagucaaaaacgaaguauucuaccgacaggacuaccuaaacgaguucgaggcaaucugggaaaaacaagcagaauaccacccagaacuaacuccugaccggaagaagauacuacgcgaugucguuaucuucuaccagcggccgcucaaaagccaaaaagacuuagucgccuguugcgaacuggaacgcagacgcaucgaggugaugaaggacggaaaaguccgcucggucgaaauaggcccaaaaguaugccccaaaucaucaccccucuuccaagacuucaagaucuggcauguacucaacaaccugaaaguacgugacaaggcaacgggagaugagagauuccuagaacucgacgaaaaagaaauauuguucagugaacuugcgaucaaaagcaaacucucaaaaacugaagcgcugaaacuacucuaccaaaaaccaaaaggacuggaccucaacuacgacagcguagagggcaauacaacgcaagcugcgcuauuugaagccuaccaaacagucaucgccaugaccggccacggagaauacgucuucucuaaaaugagcgcaucggaaguuaugucggucgucgaaggcguauuuggaggacuagguuucaacacaagcguucuaagauucgacagucuacugcaagggaaagagcuagaaaaacaagacagcuacaggcuguggcaucuccucuacuccuacgagggggauaacagugugaccgggacagacggacucgucgcaaaagucgcaagccuccuacgcugcgacgaagaauaugccaagguggucgccggggucacauuccagcccgacuacgggucauuaucggcaaaagcgauacgaaggauccucccgcacaugcgugcggggaacgaauacucccuugccugcgaauacgcaggcuacaaacacagucgccgcagccucacaaaagaagaacuagagcagaaggacuacaaggaccacuuggaacuccucccccgcaacucccuccgcaaccccgucguggagaagaucuuaaaccagauggugaauguagucaacgccguaguagacgcauacggcaaacccgacgaaauuaggaucgagauggcccgcgaacugaagaaaagcgccaaggaacgcgaggagaugacagcggcuaucaacaaagccaccagcgaacacgaaagaaucaaagaaauccuaaacaaagaguucgggauccaacacguuucccauaacgacauaguacgcuacaaacuguacugugaacuaaagaacaauggcuacaaaacgcuauauagugacacauacaucccacaagaaaaacucuucagcaaggaaguagacaucgaacacauccugccucaggcccgacuguucgaugacuccuucuccaacaagacccuagaauaccgaagcgucaacaucgagaaaagcaaccaaacagcaugggacuauguagcagccaaguggggcgaggaaggaagccuacgcuacaagaaacggguggacgacuuacucgccgcgggcgucauaggaaaauccaagcacgauaaacuucuaaugaaacaagaagacauaccgacagacuucaucaaccgagaccucagggauacccaauacauugcgaggaaagcgagggaaauccucgaagaccuaguacccaugguagucaguacgaccggcgcagugacggaccgacuccgagaagauuggcagcuagucgacgucaugcaagaacuaaacugggacaaguacgcgaugaagggccucacagaagaauggaccgacaaagacggccgacggaucucacguaucaaagaauggacgaaaagaaacgaucaccgacaccacgcgauggacgcgcucacgauagcguuuaccaaacacucguucauacaauacuuaaacaaccucaacgcccgcagcgacaaaaguggguccaucuacgcaaucgaacaaaaagaauuguaucgcgacaaccacggcaaacuccgcuucaucaugccauucgaaggguuccguuccgaagccaagagacaacuggaaaauauccucgucaguaucaaggcgaaaaauaaaguagucacgcgcaacgugaacaacgcccgacgagguagcggccgucaggcgaaaguccaacucaccccacgcggccaacuacauaacgagacaaucuacggcagcauacacagguacgucaccaaacuugagaaaguaggcggaaacuucgacggcgagcaaauagccaaggucgccaaccuuagguaccgagaggcgcuacaagcccggcacgaggcauuuggaggagacgcaaagaaagccuucacagguaaaaacgcgcuggauaaaaacccccuguaucuaaaagacacuaggacagaggucccccuaaaagugaaaaccguaucaacagaaaccuuguacacaauacgcaaagcuguggcccccgaucuaaauguagauaaaguuauagacgccaagguccguaaaguacuggaagaacgccuccaggaguauggaggggauccgaagaaggcuuucguaaaucucgacgagaaccccaucuaccugaacaaagccaagggcauaacaaucaaacgaguagcaaucaccggcgucaacaacgcgaucgcacuacaugauaagaaagacgucggcgggcaugucaugcucgacgcaagcgggcgaaaacaaccugucgacuucgugaacaccggcaacaaccaccacguagcuauuuaccgagacgcagagggcagucuacaggaaguagucgucagcuuuuacgaagccguggcccgcgucagccuaggccucccagugaucgaccgagaauaucgaaaggaagacggcuggcaauuccuuuucacgaugaagcaaaaugaauacuucguguucccaaaucccgaaaccggcuucaacccacaggaaguggaccugaccgaugagacgaacuacgcacucauauccccaaaccucuuccgcgugcagaaauucacaaucaaagacuacuucuuccgccaccaucuugaaaccacugucgaagacaggaaggaacucaaagacaugacauggaagagguguggccucggggguaucauugggauagucaagguuagaguaaaccacauaggccgaauaguaucgguaggcgaguacuga

SEQ ID NO: 6600 - RNA, 4110 nt, Artificial Sequence
  Cas9 variant
auggccaagaccuacaacauaggccucgacaucgggacaaacagcaucggcugggccgugguugacgaucaaaaccaccuuaugaguaucaaaggcaaguauggcuacggcguuagacuauacgacgaaggaaaaaccgcggaggaacgacgaucauuccggaccacgaggcgccgccuaaagagacggaaauggcgccucucacuuuugagagaaauuuucgaaccccaaauaacuccccucgacaacacguucuuccugcgacaaaaacaaagcucgcucaguucaaaagacaaccgaaaacuauacccggaaaugagucucuucaacgacagaaccgacaccgacuuuuacacacaguacccuacaaucuaccaccucagccgagaccuaaugacaaagaacaaacaauucgacauucgcgaaaucuaucuagccauguaccacauugucaaauaccguggacacuuuuuaaacgaaagccccgucuccucauucaaaucgagcgaaauuaaacucgccgaaaacuucgaaacccuaaaccaaaucuucaaugagagguuuaacgaaucaauguuccaacucgccgucaacgacuuugacgaccucaaggcauugcuccuaaacgaccaacagagcgcuagcaaccgacaaaagaaagcacuagggaugaucuacgucccaaacgaaaacaaaagccucgaaaaacagaacaaagcgaucgccacagaacuacuaaaagcaauacugggacucaaagcaaaguucaacguccuaacaggaauagaaguggacgaugcaaaaccauggacccuauccuuuaacucagagagcuucgacgaagacaucgacaaagccgccacaaacauugaugacgacuccagagagaucaucgcuauacuacaaggccucuacuccggcauacuacucgccggaaucaucccagagaaccaauccuuaagcgaagcaauggucgaaaaguacgaccaacacgcagcccaucuuaaacaauugaaaucaaucuacccgcuacucagcaucuccgacaagaaagcaauccaacaggcauauaacuacuacauagacggccaagacaacgccaaagccuacucaagggaagacuucuaugccgccaccacaaaagcccuaaaaaguuaucaagacaacgaaaccaucgcugagauccucaaacucauugaacucgagcaauucaugccuaaacaacgcaccaaagauaacggugccaucccccaccaauugcaccaacaggaauuagaaagaaucaucgaaaaccaacaaaaguacuauccuuggcucgccgaacuaaaccccaacgagagucgaagaaaaauagcgaaguacaaacuggacgaacucguagcuuuuagagugccuuauuacgugggcccccuuaucacuuccgaacagcaacagcaaucaagcaacaagaaauuugccuggaugauccgcaaagccgaggggaagaucacuccauggaacuucgaugaaaaaguagaccggcaggccucggcgaaugaguucaucaagcgcaugacaacaaccgacacuuaccucuuggccgaagacguccuacccaagcaaagucucguguaccaacguuucgaaguccucaacgaacuaaacggaaucaaaaucgacgaugucccgauaacggucgaacaaaaacaacggauauucaacgaccucuucaugaugcaagccagcguaucggugaaaaauauacaagacuaccucguuagcaaaggguacuuugcguccagacccgagauaacaggauuaagcgacgaaaacaaagucauaagcagacugucuaccuaccacgaccugaaagcgauccucggaggcauuguagacgaagcgaacaaacaggcagaccucgagaaaugcgucgaauggucuacaauauucgaggacggaaagauauucgucgaaaagcucaacgagauagaauggcuaaccgacgagcagcggaagcgcuugucgagcaaacgcuaccguggcuggggccgccucaguaacaaacuccucaaccaaaucguaaacgaaaacggccaaaggaucauggaccuucucugggacaccaccgacaacuucaugcgcaucguccacucggaagaguucgauaaacuaauaucugccgcaaaccaaacccuucuuuccaaaaaugacguacaagacguaaucaacgaccuguacacgagcccgcagaacaagaaagcccuccgccaaauccuccucguagucucggacauccagaaagcaaugaaaaaccaagcacccucgaaaauacuaaucgaauuugcacgcgaggaugaagccaaccccaggcugucuguccaacgcaaacgccaagucgaacaaguauaccaaaacauuucgaaagacauccuuucagacagcgacguaaaagccgagcugaaagaccuaaccaauaccgcgcucgcgaacacacgccuguuccucuauuucaugcaggguggacacgacauguacaccggcgagacccucaacauagaucgccuuagcgaauaugacaucgaucacauucuaccucaggccuucauuaaagacaacagccucgacaaccgaguacucgucucagccaaaaugaaucgcucuaaaagcgaccaaguaccacugaacgacuauaccgaagaaagauuuggauccaagaugcguguccaaugggagcagaugcucagagccggccucauaaccaaacgcaaauacgacaauuuaacccuaaacccagaccgaaucucgaaguacgcuaugaaaggauucaucaaccgucaacucguagaaacgcgccaagugaucaagcuagucaccaaucucuuaauggaccacuacgaggacgacgagguacaacuaauuaccgucaaguccggacuaauccaccaaaugcgagagauguucgacuuccccaaaaaccguaaccuaaacaaccaccaccacgcauucgacgcauaccuaaccgcauuugucgguaucuaccuccucaagcgguaccccaaacuaacgccauuuuucgucuacggcucguaccagaaaaacaacacgaacgacaaguggcgcaacuucaacuuccuaaaugaccucaaaaaggaggaagucaucgauucagacucccacgaagucaucuggaacaaagcacaggggcuaguagagcuagacaagaucuaccaguucaagaagauccuaguaacgagggaaguucacgaaaacacgggcgcgcucuacaaccagacccuauacuccgccaaagacgacaaagcauccggacaaggcggcaaacaacucauccccgccaaacaagaccggcccacugcgcuauacgggggauacagcgggaagaccguggccuauaugugcaucgugcguauuaaauccaagaaagaagacaccuacaaaguaugcggcgucaagacauccuggguagccgaacuagaacgacucuccgacagcaaugaacagcuagccagcuugaaggcgaaacugaugccaaaauucaccaaaaacaagaaacaaaaaggcaaaacuauucaagucacagaagacuuugagaucauuguaccccgcguacucaucaaccaacgcuucuacgacaacggucaagaaaucacucuaggaagcgcaaccuacaagcacaaugaacaagagcuaaugcuaaauaagaaagccguaaaauuacuuaauggacaacuuagccucguggaagcagaaacacuggcaccccaagucuacgacgagauauuaaaacaagucaugaaauacuucccucucuaugacacaaaccaauuuagaaccaaacuuaaaaugggcaaagagcaauucauaaaacuaccauggaaaaacaagugggacggcaacaaacucauacacgucggccaacagaccguccuagaccgaauacucauuggauugcacgcaaacgccgcgguuagcgaucuaagcacccuaaaaguaacgaccccauuuggcaaacuccaacagcccucagggauugcccuaucgcuaaacacaaaaauaaucuaccaaagccccaccggccuauucgagagacgcguugcccuccgcggacucuga

SEQ ID NO: 6601 - RNA, 4110 nt, Artificial Sequence
  Cas9 variant
auggauaaacccuacaacauaggccuagacauuggcagccacucaauaggauggacagucgucgacgacaacuccaaacucguacgaaucaaaggaaaauugggguacggugucagacuuuucgacgaaggcaagacagcugaagagagacgucaguuccgcacaacccgccgccgccucaaacgacgcaaauggcggcugcgacuuuuacgcgaaauuuucgaaccucacaucgcgccccucgacgagacauucuuccugcgacaaaaacagucaaaccuaguaccgacccaaaagaaacucccccaauuaucacucuucaacgaccggagcgacgccgaguucuaccacaaauaccccacgauauaccaccuccgaaacgcccucaugacagaaaaacgccaguucgaccuacgcgaaauauaccucgcgauacaccacaucgugaaauaucgaggacacuuccuaaacgccgcucccgccgccuccuucaaauccggcaaauucgaccucgaaaauaaauuugaccaacuaaaucuccucuucgcuuccgccuauucagaccucgacuucacacuucgcacagauaacguggaucaggucaaagcgauccuccuaaaugaagacuuauccgccagcacgcgccaacgucaagcacucccccucaucuaccaaacuuccgcggaccaaaaagccgccaagaaacucacgaaaucccuagcaaccgaacuccucaaagcuauacuaggccuaaaggcaaaauucgacguccucacaggaauagaaacagacgacaccaaagcauggaggcuaacuuucaacgccgaagacuucgacgacaaacuaaacgaacucaaugucacagacaacgaagcagcaacacaaauaaucgagauccuucgcgaacuguacuccuccauccuccuggcggcaaucguccccgagaacuauacccucucacaagcaaugauggcaaaauacaacgcacacaaacaacaccucucccuacugagacaaguaaaaaccaccuuaccagcaaagaagcagaaagaacugcaggccgccuacgacgacuacaucgaucaacaccucccacuugacaaauuuuaugcgaaguugacaaaaguccuacccaaagaaaaggacacagauaauccccaaauaauacagauacucaaccuaauagaccuagaccaauuccuuccgaaacagcgaacaaaagacaauggagcaauaccccaccaauuacaccaacaagaacucgaucagauaauagacaaccagaaggccuacuacccauggcuagcgcaacuaaaccccaacgagaaacgacagaaaauagcgaaguacaagcuggacgaacuggucgccuuccgcgugccuuacuacgucgguccguuaaucgaggccaagacucaacaaaagaccucaggcgccaacuuugcauggaugauacgaaaggaacccgguacaacaacgccaaucaccccauggaauuucgacgaaaaagucaaccggcaggcaucagcuaacgaauuuaucaaacgcaugaccacgacagacacguaccuccugggcgaagauguacuccccaaacacucgcuccuauaccaacgcuucgaaguccucaacgaacucaacggaauaaaaaucgaccaaaagcgcgucacgguccgccaaaagcaagccaucuuuaacgaccuguuccucaaacaaccgaacgucacagugaagaaacuccaacaauaccuccaagcgaagggcgaauaugccuccgcaccaauaauaaccgggcugucagaccccaagaaauuuaauucgcagcugucuacguaucacgaauacaagaagauauucggcggccucauagaugauccggauaagcaagcggacuuugaaaaaugcaucgaaugguccacaaucuucgaggacucucagauacuaaaagacaaacuaaaggaaaucaauuggcuaaccccggaacaacgacacaaagucgcaaacaagcgcuaucagggauggggccgccuauccaagaaacuccucacccagcugguugauuauaacggccaacgcauuaucgacauccuguggaauaccaccgauaacuucaugcaaaucguccacucggaagcguucgacaaagcuauaaucaaagaaaaccaggcccuccuuacgcaauacaacccacaggccgucaucgacgaccuuuacacgucaccccaaaacaaaaaggcacuuagacagauucuacucgucguuaacgacauacaaaaagcauuaaagggacaagcgccaagccgcauccuuauagaguucgcucgcgaggggcaagaaaacccccgguugucaacccaacgcaaacaacagguggaaaacgcauacaaagaggccucggacgcccuccuauccagcgccgaggugcgacaagaacucaagggccuggauaacaaagcacuggcaaacacccgacucuuccucuacuucaugcaaggaggccgcgacaucuauacaggaaagagucuaaacauagacgaccuaucaaaguacgauauugaccacauucugccacaagccuucaucaaagauaacucacuagacaacagaguccugguguccgcuaagaugaaccgcucaaaguccgaccaaguaccccucaacgauuucgccgaaauucgauauggaaaacagaugcgacaacagugggagaaaaugcugcgagccggccucaucacacgaaagaaauaccacaacuuaacccucaaccccgaaagcaucaacaaauacacagcaaaaggguucauaaaccgucaacucgucgagacccgccaagucaccaagcuagcaacgaaccuccucguggaccaguacgcugaggacgacguccagcucauuaccgucaaaagcaaucucacccaccaaaugcgugaagaguuugacuuccccaaaaaucgcaacgucaauaaccaccaccaugcguuugacgccuacuuaacagcauucgucgggcuguaccuacucaaaagauacccaaaacuagcuccuuacuucguauacggugacuaccagaagggcgccagccaaaacuccaaguggcgcaacuuuaacuuccuggguaaccuacaccgggagaaaguagucgacaagaacaccggcgaaaucauauggcagcgcgacgccgggcuaggcgaacuuaaccgcaucuacaauuucaaaaagauacucguaacccgcgcccuacgagucaaccgaggacccauguucaaacagacaauauauaaagcagaggaggacaaguccuccggacguggcagcaaacaacucauccccacuaagaaaaaccgcccgaccgagcuauauggcgguuacacuaauaaagaaacagcguacuuaugccucgucaaagaaccccauaaaaagggagacauauaccgcauauguagcgucuuaaacauguggcugaccgaacuugaccguauagcggacccaauugccaaagcccaaaaacucacggagcuacucacuccccaauuuaccaccacuaaaaagaaacaggggcaaaagauuccugucgucaaaccguuuaaagucguaauccccaaaauacuaauaaaccaacgcuucuucagccguggccaggagcucacggucgccuccccaauguacaugcacaaugagcaagaacucuuccucaacaagaaaacuauaaaacuucuaaacggccaauuagccaaaaacgaagcccacgaacucgcccccaaaaucuaccaacagauccucgaccaggucaaugacuauuucccccucuacgacauguacaaauuucgugauacccucaacgcgucaaaagaaaucuucgucaaccugcccuggcaggaucaaagacaggauaagaaaaucagccaaucaggucaaaaauccauccuuaacaaaauacucauagggcuacacgcaaacgccgcccgcauuaaacuaacagagcucaacuuuaaaagcgacuuuggccuccucucccaacgcuccggcauagccuucuccccugacgaccaaauaauauaucagucgccgaccggacuauucgaaaggcgcguaacccucaaagaccuguga

SEQ ID NO: 6602 - RNA, 4110 nt, Artificial Sequence
  Cas9 variant
augaaagugaacaacuaccacauagggcuagacauaggaaccuccucgauaggcuggguggccaugggggaggacgggaagccguuacgcgugaagggaaaaacagcgauaggcgcccgccucuuccgcgaaggaaaccccgccgccgaucgacgcauguuccggaccacuagacgccgccuaaaccgccgcaaauggcggcuaaaacuccuagacgaaaucuucgacccguacaucacaccgguggacucuaccuucuucgcacgccucaagcaaucaaacuggagccccaaagacagccggaaagcguucaaagauaguacucucuucccugaccucacagacaaacaauaccaccucgacuaccccaccaucuaccaccuaagacacgcacugaugacacaggacaagcaauucgacauaagaauggucuaccuagcgcuucaccauauaguuaaauauaggggcaacuuucucaauucgaccccggucgacagcuucaaggccucaaaaguaaauuucgacgaucaguucaaaaagcucaacgaacuguauaccgccaucaaucccgaagaauccuuccaaaucaacuucgccaacucagagaaaaucggacaacaauuccuagaccccucaauaagaaaauuugacaagaaaaagcagauaucaaaaauagucccagucaccauggacgacaaagcagucgacaaacuuaacggcaaaaucgcuucagaaauagugaacgccauccuaggcuacaaaucaaagcucgacguggccguacagugcgauccagaagauagcaagccgugggccguaaaauucgacgacgaagacauagacgcuaagcuacagaaaauauugccggaaauggacgaaaaccagcaaucuauuaucggaaucauacaagaccucuacucucaaguuacacugaaccaaaucgucccgaauggcaugucccucagcgaguccaugauaaagaaauacaacgaccaccacgaccaccucaagcuauacaagaaacugaucggacagaucuccgacucaaagaagaaaaccgcccucaagaaggccuacgaccaguacguagggaacgacgguaagguaaucgaacaggacgacuucuacagcagcgucaaaaagaaccuggacgauucggagcucucaaaacaaauaauggaccucaucgacgcggacaaauucaugcccaaacaaagaacgucccagaauggaguaaucccccaccaacuacaucaacgagaacucgaugaaauaaucgagcaccaaagcaaauacuaucccuggcuagcagaaucuaacccgaauaaacacgaccuacaccucgccaaguacaaaaucgaggaacucguagccuucaggauuccguacuauguuggcccuaugaucaccccagaggaccaaaagaaaagcggcgcagccguguucucauggaugaaaagaaaggaaccuggccaaauaaccccauggaauuuugaccaaaaaguugaucggauggaaucagccaacaaauuuauaaagcgcaugacaaccaaagacacauaccuaauaggugaggacguccuccccgacgaaucccuccucuacgaaaaguucaaagugcucaacgaacucaacauggugcgaguaaacggagacucacucaaagucgccgacaaacaagccaucuaccaagaucuguucgaaaacuauaaacacaucagcgucaagaaaaugcagaacuacaucaaggacaaaaccggccucccaaacaaucccgacauuagcggacuauccgaccccgaccacuucaacaacagucugggaaccuacaacgacuuuaagaaacucuucggcgacaaaguagacgaucccgaucuacaagacgacuucgagaaaaucgucgaaugguccaccguauucgaagacaagaagauacuccgcgcuaaacuuaacgagaucuccuggcucucggacaaacaaaaagacgaccuagaaucauccagguaccaaagaugggggcgucucagcaagaaacuacuaaccggcauaguaaacgaccaaggggaacgaaucauagaugagcuguggaauacaaacaaaaacuucaugcagauccagucggacgacgauuucgccaaacggauccacgaagcgaaugcagaccaaaugaaagccacagacgucgaagacguacucgccgacgccuacaccucaccccaaaacaagaaagccauacgccaggucguuaaagucgucgacgacauccaaagggccaugggcggcgucgcuccaaaauucaucuccaucgaguucacacgcuccgaagacagaaaucccaggcgcaccaucagcagagaaaggcagcuagaagacacccuuaaagacaccgccaaaacgcucgucaaaagcaugaaccccgacaucuuaucagaacucgacaacgcgagcaaaagcaagaaaggucugacggaccgucuauaccuuuacuuuacccaacucggccgagacauguauacaggcaaacccaucaacauagacgaaaucucgaacuacgacaucgaccacauccuaccacaagccuucauuaaagacgacucccuuaguaaccgaguucucgucagcaaagcaguaaacaacggcaaaucagcaaacgucccccucaaacucuucggagucaaaauggcgcauuucuggaaacaacucgcagaagccgggcuaauuaacaaacgcaaacucaaaaaccuacaaaccaacccagacacaauuuccaaauuugcgaugcacggcuucauacgacgacagcuagucgaaacgagccaagucaucaaacucgucgcaaauauucucggggacaaauaccguaacgaugacacgaaaauaaucgaaauaacagcgcggaugaaccaccaaaugcgggaugaguucgcguucaucaaaaaccgggagaucaacgacuaccaccaugccuucgacgcuuaccucacagccuuccucggccgcuauuuguaccaccgguacauuaaacuaagaccauacuuugucuacggcgacuucaagaaguuccgcgaagacaagguaacaaugagaaacuucaauuuucuucacgaccugaccgacgacacccaagcacguaucgcagacacugaaaccggggagguaaucugggaccgagaaacuuccauaaaacagcugcgggacguauaccacuacaaauucauguugaucagccaggaagucuauacccuccgaggcgccauguuuaaccagacaaucuaccccgccgacgaagccggcaggaagaagcucauccccacaaaagcggacaaggccguggacgucuauggagguuauagcggcuccaacgacgcguacauggccaucgugcggauccacgacaagaaaggcgacaaauacaagguugucgguguccccaugcgcgcacucgaccgccuuaacgcggccaaaaacguauccgaugccaaauacgaccaaguccucaaagauguccuaacaccacaauuuacuaaaucaaagaaaucccgcaaaacuggagaaauuucgcaaaccgucgaagauuucgaaguagugcuaggaaaaguuauguacagacagcuagucauagauggcgacaagaaauuuaugcugggaucgagcaccuaccaauacaacgcaaaacagcuuguccucuccgacgaaagcguaaaaacccucgcaagcaaagggaaacucgacgaagcacaagagagugcagccuacgacaacguguacgaugagauccuagacaaaguggacagguacuucgcccuguacgaucaacgaaacuacaggaccaaccugcacgaaggagaacaaaaauucaucggccuaccccuccacgacaccuucgacggcuccaagaaaguggcgaacggcaaacgggaaaccaucucugacauacuaaacggacuacacgccaacgccacgaugaccaaccugaaaguacucggcauauccucccccuucgggauguuccagucccaugggcccauaaaccuaaacccagaaaccauaauacugugccaaagccccaccggacuguucgagcggcgaaucauucuacgggaccuauga

SEQ ID NO: 6603 - RNA, 4113 nt, Artificial Sequence
  Cas9 variant
augaagaaacgcaacuauaacauaggacuugacauaggcacuucuagcauaggauggaccaucgucgacgauaacgcacagauuaugagagccaaagggaaaaacggcuacggcgugcgcaucuucgccgagggcaaaaccgcggcagaucggcgaggguucagaacgacccgcaggcgacuaaaacgccgaaaauggaggcugcggcuacuccaagaguucuuugaaccauauauccuaccaauagacgaaaacuucuucaugcgacaaaaagaaagcaaucuggucccgcaagacccaaacaaacauuucaaaggaaguauacuuuucaacgaccgcacagaccaggaguuccacgaacaguaucccaccauauaccacuugcgauaugcacuaaugaccgaacaucgacaauucgacguacgggaaauauacugggcaauccaccacauagugaaauaccggggacacuuccugaacagcacacuugccaguaaguucaagggcggcgaacuccgccuagcagacaaauuugagagccugaacaaacucuuccuccgaguccaagcagaaaccggauucgaacuaucugaggacaacguagacaagauaaaaaccguucuucuugauaacgguaaaucccgccuugacagacaaagggagguacuaaagauagucuaccuuacaagcgaggacaaagacaccgaaaagaaacgaaaagccguugccacagaguucauaaaagcaguacucggccuaaaaacgaaacucuuuaucguacuagccaaaaaucccacugcggaaaccgacuggaaauucaguuucgaugccgaagacauagacgacaaacucgacucgauuuccgaacaacuaaccgacgaugaccacgaaaucguugaacuaauaucagaaauacacagcaucaucacccuaacuggcgucguacccgaagggaugggccugagcgaauccaugauagccaaauacgaccaacaccaauuggaccuaaagaaacuaaaaucccucaugcgcgaccucgacguaaaacaagcccgcaaauuacaagacgcauacgacgaguauauagacggccugaaaccaagcgaggaggcauucuauucagcggugagcagcgucauacagaagauggacgacccccgugccaaaaagauaacagcagagaucgagcuggaagaguucaugccaaaacagcgaacaaaagcgaacggacagaucccccaccagcuacaccaacaagaacucgaccaaauaaucgaaaaccagaaagaauacuaucccuggcuggccgaagaaaaccccaacaagagagaacacaacgccgcaccccacaaacuagacggacuggucacauuccgaguccccuacuacgucgguccgcugauagaagccagcgugcagcaaaagacgagcaacucaaacuucgccuggauggagcgcaagguuaagaacgacaccagccgcaucacaccauggaacuucgaagaaaaaguagaccgcaaugcaucugcagaaaacuucauaaaaaggaugacaaccaaggacaccuaccugcucaacgaagacguucuuccgcaacaaucccuccuguaccagagguacgaagugcucaacgagcucaacaauguccgcgucaaugacaagaaacuugaaaacaacugcaaacaggacgucuacaaagaccuguucaaaaacaauacgacuguuucgaucaagaaauucaaagacuaucucguggccaacugcgaauacgccgauaaccccaaaauagaaggccuggccgacgaaucgaucuuccucuccucgcuaagcacugaaaacaaauucaaagacauauucggagcgcaaauagacgacccgaacuauuucgaagacuuugagcacaucaucgaaugggcuaccaucuucgaagacaauaaaauccuccgcgccaagcucgacgagauuucauggcucaaugagagucagaagaaagaacuagcgaaacuccggaugcgcggauggggccgacuuuccaggaagcuaauugccgaaauaaccgacgagaacgguagccggaucauagaccuucucugggaacacauggacaacuucauggucguaguaaaccaggacgucuucaaagagaaaauuguagccgaaaacaaacaggucuucaaagagcuuaacccacuggacauaaucaacgagcaguucaccuccccgcaaaacaaaaaggcacuccgucaaauccuauuagucgucgccgauauacagaaggccaugaacggugucacgcccuccaacaucuucauagaguucgcucgugaagacgaacguaauccacggcgaaguauacagcgccuacgccaaguggaaaauauguaucgagacaucuccgauacgguacuagccgacccagaagucaggaacgagcuaaguaacauaaagaacaccgagcucgcacgggacagggucuuucucuacuuccugcagggcggcagagacguguacaccggcgagccacucaacauagacaaacuaucggaguacgacaucgaccacauacucccacaagcauucaucaaagacaacucccucgacaaucgcguacucgucagcgcgagccuaaaccgcucaaaaagcgacucggugccccuggacgacuucaccucggaaauguucgggcguaaaauggagccccucugggaacaaaugcaacgcgccgggcuaaucuccaagaagaaacuagccaaucugaaauucaaccccgaaaacaucaauaaauauacccgaaacggguucauaaacagacagcuaguggaaacuagacaggucauaaaacuagccgcaaacauccugaaagaccacuauggcgaggaaacugaaaucguuaacgucaaagcaggacucacccaccaauuucgcaaggacuucgacuucccgaaaaaucgaaacguaaacaacuaucaucacgccuucgacgcauaccugacugcacugguaggcacguacuuacucaagaaauaccccaaacucgagagcuacuucguauacggcaaauucaaaaagggcgauggaaucacgaaccugaagaacuucaacuuccuucaugguuucaacaaaccaggaaagauaaucaacaaagaaacaggagaaauccuguuugaccgagauaaacagcucggguacaugaacucaaucuacgaccuacgaaaagugaucguaacccacgaacucuccacucgacacggagccauguacgaccaaacccucuacaaggcauccgacgacaaagacagcggcagaggagggaaacagcucauacgcaagaaagacaaccucccgaccgaaaucuacggcggauacacagggagcacagacgcauucaugucgauaauccgcaugaaaaagaaagauaagcucuauuacaaagucauaggcgugcccacucgagucgcgcaugagguccuccagucagacgguaaaaucaacaucuucacccucaacaaauucauagaacaaaaacucaccaaagaaaaaguaaacaaaaagaccggcgcgaucacccgcaucacggacugguucgagcucgucauugccaaggucauguacggccaagugauugaugacggaggccaacccuucauguuaggcucgagcacccuccccuacaacgugagagaacuauaccuugccaaagaccucguuaaaguaaucaacaaagguagcacaucgaaauccagcuaccucgauguauacgacgaacucgucaagagccucaauaaauauuuccccauguacgaccguaacauguuccgccagaaaaucaccgacgcaagagacaaauucgaaaaguuaccaaagagagacaaaguaucaaacggaaaacuccaacaaauagggcaaguuacgaucauagaccgaauacucauugggcuccacacuaacgcuggcgucagcaaccucaaagaccuaggaaucgccaccccguuuggauucaugcaacaaggaaacggaaucucacucaccuccacggccaaaaucaucuaccaaagcucgaccggccuguucgaaaaguccaaagcccuagacgaccuaaacccguuagcguga

SEQ ID NO: 6604 - RNA, 4113 nt, Artificial Sequence
  Cas9 variant
augaacaaaccauacagcauuggccuagacaucggcaccaauuccgugggauggucaauaauaacggacgacuacaaagucccagcgaagaaaaugagaguacugggcaacacagacaaagaauacaucaagaaaaaccucauaggcgcacugcuauucgacggcggcaacacugcagcagaccgaaggcuaaaacgaacugcccgacgacgcuauacccgccgucgaaaucggauacuauaccuccaggaaaucuucgccgaagaaaugagcaagguagacgauuccuucuuccaccgacuggaagacagcuuccuagucgaagaagacaaaagaggcuccaaguaucccauauucgcaacaaugcaagaagaaaaguacuaucacgaaaaauuccccaccauauaccaccuccgcaaggagcuagccgacaagaaagaaaaagcagaucuccgccugauauacuuagcacucgcgcacauaauaaaauuccgaggacacuuucuuaucgaagacgaucgauucgauguccgcaacacggacauccaaaaacaauaccaagccuuucuagaaauauucgacaccaccuucgaaaacaacgaccuacucucacagaacguggacgucgaagccauacuaaccgacaaaaucuccaagucagccaagaaagaccgcauucuugcccgauacccaaaccagaaaagcaccggaaucuuugccgaguucuuaaaacugaucguuggaaaccaagccgacuuuaaaaagcacuuuaaccucgaagauaaaacuccgcugcaguucgccaaagacuccuacgacgaagaccuggaaaaccuccucggucaaauaggcgaugaguucgccgacuuauucagcgcggccaagaaacuguacgacuccguccuccucagcggcauccucaccgucacagacuuaucgaccaaggcaccccugucggcauccaugauccagcgguacgacgaacaccgagaagaccuuaagcaacugaagcaauuugucaaggcgucccucccggaaaaauaccaggagaucuucgcugauuccagcaaagacggauacgcuggcuacaucgagggcaagaccaaccaagaagccuucuacaaguaccuaaguaaacuacucacgaagcaagaaggcuccgaguaucuccuugagaaaaucaagaacgaagacuuccuccgaaaacagcguacuuucgacaaugguagcaucccccaucagguccaccuaaccgaauugcgcgccaucaucagacggcaguccgaauacuacccauuccugaaagagaaccuagacagaaucgagaaaauacuaacauuccgcauccccuauuacgugggaccacuagcacgcgaaaaaucagacuucgcauggaugacucgcaaaacagacgacuccauccgccccuggaacuucgaagaucuugucgacaaagaaaagucggcagaagccuucauccaccgcaugacaaacaacgaccucuaccuccccgaagaaaaaguacuaccaaaacacuccuuaaucuacgagaaauucacagucuacaacgagcuaacaaaagugagauuccuagcagagggguucaaagacuuccaauuccuuaacaggaaacaaaaagaaaccauuuucaacuccuuauucaaggagaagcgcaaagucacggaaaaagacauuaucagcuuccuaaacaagguagacggcuacgaaggaauagccaucaaaggcauagagaaacaauucaacgccucguuauccaccuaccacgacuugaagaaaauccuaggaaaagacuuccuugacaacaccgacaacgagcuaauccucgaggacaucgugcaaacacucacacuauucgaagacagagaaaugauacguaaaagacucgacaucuacaaagacuucuucaccgaaucgcagcuaaagaaacucuaucgacgccacuacaccggauggggccgguuaagugcuaaacucaucaacggcauacguaacaaagaaaaccagaaaacgauccucgauuaucuuauagaugacggcagugcgaaccgcaacuuuaugcagcugaucaaagacgcgggucucuccuucaaacccauaauagauaaagcccgcaccgggucccacucagacaaucugaaagagguagucggugagcucgccggaucccccgccaucaaaaagggaauacuccaaucacucaaaaucguagacgaguuggucaaggucaugggcuacgaaccugaacagaucgucgucgagauggccagagagaaccagaccacagcaaaagggcucucccgacuacgacaacgacugacaacacuccgggagucguuagcgaacuuaaagucaaacauccuugaagaaaagaagccaaaauacgucaaggaccaaguugagaaccaucaccuaagcgacgaccgacuauuccuuuacuaccugcaaaacgguaaggacauguauacagacgaugaacucgacauugacaaccucucccaauacgacaucgaccucaucauaccacaggcauuuaucaaagacgacucaaucgacaaccgaguccucguaaguucagccaaaaaucgcggcaagucggacgacgugcccucaguugagaucguaaaggacuguaagguauucuggaaaaagcuccuagacgcgaaacuaaugagccaacggaaauaugacaaccucacaaaggccgagcgaggcggacugaccagcgacgacaaagcaagguucauccaacgccaacucguugagacccggcaaauuacgaagcacgucgcacgaaucuuagaugaacgguucaacaacgaacuagacagcaaaggacggcggauacgaaaaguaaagauagucacccugaaaucgaaucuaguuagcaacuuccgaaaggaguucggcuucuacaagauccgugaagucaacaacuaccaucacgcccacgacgcuuaucucaacgcgguggucgcaaaggccaucuuaacgaaguacccccaauuggaacccgaguucgucuauggcgacuacccaaaauacaacucauacaaaacccgcaaguccgccacagagaagcucuuuuucuacucuaacauaaugaacuuuuucaaaacuaaagugacucuugcggacgguaccguuguggucaaggacgacaucgaaguaaacaaugacaccggggaaaucgucugggacaaaaagaaacacuucgccaccguccgaaaaguacuaagcuacccacagguaaauauagucaagaaaacagaaauccaaacuggcggcuucuccaaagaaagcauacucgcccacggcaacagcgacaaacuaauaccaaggaaaacaaaggauauuuaccuagacccuaagaaauacgguggguucgacucccccauaguggccuacucuguccuagugguagcggacauaaagaaaggaaaagcccagaaacucaaaaccguuaccgaacuacuaggaauuacgaucauggaacgcucccgauucgagaaaaaucccagcgcuuuccuagaaaguaagggcuaccucaacauaagagacgacaaacucaugauccuuccgaaauacuccuuauucgaacucgaaaacggacguagacgccuacucgcguccgccgacgaacuccagaaaggaaacgaacucgcccuccccacgcaauuuaugaaguucuuauaccucgccagucgauauaacgaacuaaaaggcaaaccagaagagauagaacaaaaacaagaguucguaguccagcacguuuccuacuucgacgacauacugcaaaucaucaacgacuucuccaaccgggucauccuggccgacgccaacuuagagaaaaucaacaaauuguaccaagauaacaaggaaaacauaccaguggacgaacuagcaaacaacaucauaaaccucuucacauucacaucgcucggagcccccgcagccuucaaguucuucgauaagaucgucgacagaaaacgcuauacaagcacgaaagaagugcuaaacagcacccucauucaucaguccaucacgggacuauacgaaacgagaauagaccucggaaaacuaggagaagacuga

SEQ ID NO: 6605 - RNA, 4113 nt, Artificial Sequence
  Cas9 variant
augaccaagaaaaacuauuccaucggccuagacaucggaacuaacuccgucgguugggccgucaucaccgacgacuacaaaguaccagccaagaagaugaaggugcucgggaacacagacaagaaauauauaaagaaaaaucuccuuggggcccuacucuuugacagcggcgaaaccgccgaggcaacgcgccuuaaacgaacagcacgacgccgcuacacccgacgcaaaaacagacuacgauaccuccaggaaauauucgccgaagaaaugacgaaaguggacgaaucuuucuucuaccgccuagacgaguccuuccugaccacggacgagaaagacuuugaacgucacccaaucuucggcaauaaagcggaagaagacgccuaccaucagaaguucccaacaaucuaccaccuccggaacuacuuagccgacucgucagagaaagcggaccuucgauuaguauaccuggcucuagcccacaugauaaaauacaggggacacuucuuaaucgagggaaagcugaaugccgaaaacaccgacguccagaaacucuucacagacuuugucggcgucuaugaccgcaccuucgacgacagccaccucuccgaaauaaccguagacguagcgagcacacucacagaaaagaucucgaaaagccgccggcucgagaaucucauuaaguauuaccccacggagaaaaagaacacccuguucgggaaccucauagcgcucgcccuagggcugcaaccaaacuucaagaugaacuucaaacucucagaagacgcgaaacuccaguuuuccaaagacacguacgaagaagaccuggaagaacuccugggaaagauaggugaugacuacgcagaccucuucacuagcgcgaaaaaccuauacgacgcaauccugcucuccgguauccugacaguggacgacaacagcacaaaagccccgcucagugccucaaugauaaaacgguacguugaacaccacgaagaccucgaaaagcuaaaggaauuuaucaaagcaaacaagagcgagcuguaccacgacauauucaaagacaaaaacaagaacggguacgcgggguacauagaaaacggagugaagcaggacgaauuuuacaaauaccucaaaaacacgcuaucuaaaauagacgggagcgacuacuuccuagacaagaucgaacgugaggacuuccucagaaaacagagaaccuucgauaacgggagcaucccccaccagauccaccuccaagagaugcaugcuauacuacgacgacaaggcgacuacuaccccuuccucaaagaaaaacaagaccgaaucgaaaagauauuaacguuccggauccccuauuacguggggccacucguucgaaaagacucacgcuucgccugggccgaguacagauccgacgagaaaaucaccccauggaauuucgacaaagucauagauaaagaaaagagcgcggaaaaauucaucacgagaaugacgcucaacgaccuguacuuaccagaagaaaaggugcucccaaaacacucccacgucuacgagacguaugcaguauacaaugaacuaaccaagauaaaauacguaaaugaacaaggcaaggaauccuucuucgacuccaacaugaagcaggagaucuucgaucacgucuuuaaggagaaccgaaaagugacgaaagaaaaacuacuaaauuaccucaacaaagaauuucccgaauaccgcaucaaagaccucaucggacuggauaaagaaaacaaauccuucaacgcuagccucggaacauaccacgaccucaagaaaauccuggauaaagccuuccuagacgauaaaguuaacgaagaagucauagaagauauaauaaaaacccuuacccuguucgaagacaaagacaugauccacgaaagacuacaaaaguacuccgacaucuuuaccgcaaaccaacugaagaagcuagagcgacgucacuacaccgguuggggccgacuuucauacaaguugaucaacgggauacguaauaaggagaauaacaaaaccauuuuagauuaccucaucgaugacggcagugccaauaggaacuucaugcaacugauaaaugacgacacgcugccguucaaacagauuauucagaaaucccaggucguuggggacguggaugacauugaggccgucguccaugauuuaccgggcagccccgcaaucaagaaaggcauccuccaaaguguaaaaaucguagacgaauuaguaaaagucaugggagauaaccccgacaacaucguaaucgagauggccagagaaaaccaaacgaccaaccgcggacguucccaaagucaacaacgccucaagaagcuacaaucaucccucaaagaacugggcagcaacauccucaaugaagagaagccgaguuacauagaagauaaagucgagaacucccaccuccagaacgaucaacuauuccucuauuacauccaaaacggcaaagauauguacacaggcgaugaacucgacauagaccaccuauccgacuacgacauagaccacauaaucccacaagcguucauaaaggacgacaguaucgacaaccgaguccucaccucaucggccaaaaacaggggcaagucugacgacguaccaagccucgacauaguccgagcacgaaaagcagaaugggugcggcuguacaaauccggacucaucagcaagcgcaaauucgacaacuuaaccaaagcagaacgaggaggcuuaaccgaagcagacaaagcuggcuucaucaaacgccaacucguggaaacccgacaaaucacaaaacacgucgcgcaaauccucgacgcccgcuucaacaccgaacacgacgagaaugacaagguaauccgcgauguaaaagucauaacucuaaaauccaaccucgucagccaauuccgaaaagacuucgaguucuacaaaguccgagaaaucaacgacuaccaccaugcccacgacgccuaccucaacgcaguaguagggaccgcccuacucaagaaauaccccaaacucgcuagcgaguucgucuacggcgaauacaagaaauacgacauccggaaauucaucacaaacucuuccgacaaagccacggccaaauacuucuucuacagcaaccuaaugaacuucuucaaaaccaaaguaaaauaugccgacggcacagucuucgaacgaccgauaauagaaaccaacgccgacggcgaaauugccuggaacaaacaaaucgacuuugaaaaagucaggaaaguauuaagcuacccccaggugaacaucgugaaaaagguagaaacgcaaacaggcggauucagcaaggaauccauccucccaaaaggugacucugacaagcugaucccacgaaaaaccaaaaaggucuacugggacaccaagaaauacggcgguuucgacagccccacaguagcauacuccgucuuuguaguagcugacgucgaaaaagggaaggcaaagaaacucaaaacagucaaagagcucgucggaaucagcaucauggaacggagcuucuucgaagagaaucccguagaguuccucgaaaauaaaggguaccacaacauccgagaagacaagcugaucaaacuaccgaaauacucacucuucgaauuugaaggcggacgucgacgcuugcucgcauccgcauccgaacuccaaaaaggcaacgaaaugguauugcccggcuaccucgucgagcugcucuaccacgcccaccgagccgacaacuucaacuccacagaguaucugaauuacguaagugaacacaagaaagaguucgagaaaguauuaaguugcguagaagacuucgcaaaccucuacgucgacguagagaaaaaccuaucuaaaauacgggcagucgccgacucuauggauaacuucuccauugaagaaaucagcaacucuuucaucaaccuccucacccuaaccgcccucggugcaccggccgacuucaacuuccuaggcgagaaaaucccccgcaaacgcuacacgaguaccaaagaaugccuaacagccacgcuuauucaccaaucaauaacuggacuguacgaaacacggaucgaccuuucaaaacuuggagaagaauga

SEQ ID NO: 6606 - RNA, 4113 nt, Artificial Sequence
  Cas9 variant
augaagaacgcaaacaagguaaccggcaaauacuaccugggauucgauaucggcaccaacagcguagggugggcgguuacagacgaaaacuacaaucugugcaaguucaagaagaaaagcauguggggaauaagguuauucgaagacgccaaaacggcggaagaaagacgcggacaacgcgcaucucgcaggagacugcaacggcggaaacaacgcaucgaccucuugcaggagauauuugcggaagagaucaacaaaguggacgaaacguuuuucauaagacugaacgagagccgacugcaccucgaugacaagacaguuagcgagaagcauccacuauuuauuggaagcgaauauagcgaaaaagaguacuaccgcgaauaccccaccauauuucaccucagaaaagaacugauggagucgagcgaaccucacgauaucaggcuagucuaccucgcgauccaccacauacuaaagaacagagggcacuuccuaaucgacggagaacuaagcaaagccaacucguucgaugcagcauucuaccagaugaaggaggugcugugcaacgagcuagaucucgaaauugacggagaaaacaccacagaaguggagagaacacugcgggaccggaacaucucgaagucggacaagguaaagcuacuggccgcgcuccuagcaaugaaccaaaacgaaacggagucaaaggagacgaagaaaaagaucgaaaacaucugcaaacuacucgcaggaaacaagggagacauauccaagauauuuggacaaacaccagaaggagucgagaagacaaguuucagcuucggggaagcggacuacgacgaaucgauaagaccaaaucuugaggaguccaucccagaccagugcuucguaauagacucgauaaaggcgcuguacgacuggaacguccucgccgauauacugaacgggcagacauaccugucuugcgccaagguaaaccaauacgagacgcacaaaaauaacuuaaaggagcuaaaacugcuaguaaacagauacugcagccgagaggaguacaagcgguucuucaagagcgcggucgagaaggcgaacuauaguaacuacaucgggagcgccaagcagggaaacaaaaucauagacguaaagcgcugcgccgaggaggacuucuacaaagagcuaaaaauccucuuaucaaagauagagccagaggaagcggaccgcgaacucuacgaacggaucaagcgagaggcggaggagggcagccugcucccacuccagcgcaacaaagacaacagcguagugccaaaucaaaugcacaaggcagaacuagcauuaauacuagaaaacgcagggaguuaccugggcuuccuaaacgagaaggacgaagacggccucuccccagcagagaaaaucaucgaacucuucagcuucaggauaccauauuacguaggaccacuaagcgacagacacaaagaccgaggcucaaacgcguggauagucaggaaagcagaaggccguauccugccauggaacuucgaugagaaggucgacagagagaaaaguaaugaagccuucauagaacgcaugacaaacaaaugcacguacuugcucgggaaggacguaguagcgaagaacagccugaucuacagccacuucaugguccugaacgagcuaaacaaccugagcguaugcgguaacaagaucagcguccaagucaagcaggauauauaccgcgaauuguuccaaagacacacgaaggugagcaaaaagaugcuacuccaguacugcagggagaagaugaugaacaaagaccuagaagaggaagaccugucgggcuucgacggcgacuuuaaagccaaauuauccucauaccucgacuucgagaaaaagguauucggggcaaaaauggaagaagaccggauucguaagaucaccgaagacaucauccgauggaagacaaucuacggagacgacgguaagaugcuacaggcagucguagaaaaggaauaucccggggaacuagauuccgaccaacuaaaagccguuaagcaauuccgauauagcggauggggcaacuucuccgaagaguuccuaaacggcaucguaggcacagaaaagccgaccggacagauguucacgaucaucgaagcccucuggcaaacuaauuguaaccuaaugcaacuccucagcaaaaacuucacauucauggaagaaaucgaaaaacacaaccgcgaacuggcaggccaaaucaccgauauaaguuacgacaaauugguaaaggaccuauacauaagcccagcgaacaagcgagcagucuggcaaacggugcggaucgcggaagaagucaagaaaaucaugggaugcgaaccagcgaagauauucgucgaaauggcccggggcggagaaaaggaaaagaagcgaacuaucagcagaaagaagaaacugcucgagcucuacgcagcaugcaagaaagacgcacgagacuggaaccgcgaaauagaagaccgagacgagcgagaguucaauagcgacaaacucuaccucuacuacacccagaugggaaggugcauguacaguggugaaagaauagaucuccacgagcuaaugagugcaaacagcaagugggacaucgaccacaucuacccgcaaagcaaggugaaagaugauagccuugauaaccgcgugcucucacugaagaaaauaaacaaugagaaaggcaacaagccgcucagcagagacauacaacagucacagcaaaagugguggacggaacugcuacagcucgaguucauaaccaagaaaaaguacgaccgccuaaugcacagaggggaauuauccgaggaggagcuaagcggauucaucaaccgucaacucguagagaccaggcagucaaccaaggcggcggcggaacuacuggggaggauguacaacaacagcaagguggucuauguuaaagcuccgcuaguaucgcaguucagaaaagacgaccucaacauauuaaaaucccggcuggcaaacgacuaccaccacgcaaaagacgcguaccuuaacauugcagucggcaacguguacaacgaaaaguucacagacaacccacuaagguggaucgagaagcacgcgggcgaaaauuacucaauaaaccgggucuucgacuacgacaucguagcaggagacggggcgccaguaugggcggcgccacuacgagacgagaaaaacaaacuccgcaagaacgaagucggagaaaaguacggaggaacaaucgacguaauacguaagacggugaagcgcaacgacguacuauacacagagcauaccuacugcggcaagggagaacucuucaacgcaacaauugcuaagaaagacggaggagccgagauucccuuaaaggcaggacuccagacggggaaguacgguggguauaagucccccaacacaagcuauuucgcagcaaucgaguucgacggcaaaaagggagaacgagucaagaacauaauggaaguacccguguacaucgcgaauauccugcugcacgacaucgacgcauacauacgcuauugcgaaacagugaaaggccuaaagaacguaaaaauacugagacccugcauaaagaaaaaugcacugaucagugucgacggauaccccaugagaauacgaggugcgaacgagaaaaacauucuccugaaaaacaaccuacaaccaauauucggucggcaugaagaaacgguacgccgcauugagaaguauguagaaaagaaccaagaguucgaaguagacgaaaaguuugacggccucaacgaggcgaacuuaacugaccuauacgacgacaucaccgaaaagcuaugcggccccuacgucgaacggccaaguaaccaaggagaguaccuaauggagaauagggaaaaauuccugaacauaagccuaaaagaaaaggccaaauuacucgcccaaaugaucaaacuggucagaugcgauacggaaacgaaagccgaccugcgaagcauaggcgccuccaagaacgccggcgucauaagcguaaacaaaaacacgcugggaggcaaaaggcugauccuaaucaaccaaagcgugacaggccuguucgaaaaccggaucgaacucuga

SEQ ID NO: 6607 - RNA, 4113 nt, Artificial Sequence
  Cas9 variant
augaacaaaccauacaguauaggacuggacaucggcaccaacagcgugggauggagcaucauaacagacgacuauaagguccccgcuaaaaagaugagagugcucgggaacacagacaaagaauacaucaagaagaaccucauuggagcccuacuauucgacggagggaacacagcagccgaccggcgccucaaaagaaccgcacgccgccgcuacacucgccgacgcaaucggauccuguaccuccaagaaaucuucgccgaagaaaugucaaaaguggaugacagcuucuuccaccgucuggaagacuccuuccuagucgaagaggacaaacgcggcuccaaauaccccaucuucgccaccaugcaggaagaaaaauacuaccacgaaaaauuccccacaaucuaccaccuccgcaaggaguuagccgacaagaaagaaaaagcagaccuacgacugaucuaccuggcccuugcacacauaauaaaauuccgaggccacuuccuaauagaagacgaccguuucgauguccgaaacaccgauauccaaaaacaauaccaagcguuccucgagauuuucgacaccaccuucgagaacaaugaccugcucagccaaaacgucgacguagaggcaauccucaccgacaagaucagcaaguccgccaagaaagaccgcauccucgcccgcuaucccaaccagaaaaguacaggcaucuuugccgaguuccucaaacucauagucgguaaccaagcggacuucaagaaacacuucaaccucgaggacaaaacgccccuccaauucgccaaagacucauacgacgaagaccuagaaaaccuccuaggccaaaucggagacgaauuugcagaccuguuuagcgccgcgaaaaagcuauacgauucaguucuucugagcggcauacucaccgucaccgaucugagcaccaaagcaccacucucagccuccaugauccaacgcuacgacgagcaccgugaggaccuaaaacaacugaaacaauucgucaaggcgagcuuacccgagaaauaccaagaaaucuucgccgacagcuccaaagacggcuacgccggguauauugaagggaaaaccaaccaagaggcguucuacaaguaccucuccaagcuccucacaaagcaagagggaagcgaauaccuccuggagaagaucaaaaacgaagacuuccuccgcaaacaacguacauucgauaacggcucgauaccccaccaaguacaccucacagaacuccgugcuaucaucagacgacaaucagaauacuauccauuccucaaagaaaaccuugaccgcauugagaaaauacucacauuccgcaucccauauuacgucggcccccucgcccgagaaaaauccgacuucgcuuggaugacccgcaaaaccgacgacucaauucgccccuggaacuucgaagaccucguagacaaagaaaaauccgccgaagcguucauccaucgcaugacgaacaacgaccuauaccugccagaagaaaaggugcucccgaagcacucccugauuuacgagaaguucaccguuuacaacgaacuuaccaaaguccgcuuccuagcggaaggcuucaaagacuuucaauuccugaaccguaaacagaaggaaacgauauucaacagcuuauucaaagagaaacggaaagucaccgaaaaggacaucaucagcuuccucaauaagguugacgguuaugaaggcauagccauaaaagguaucgaaaaacaauuuaacgccucacucuccaccuaccacgaccugaaaaagauccucggaaaggauuuccuagacaacacagacaacgaacucauccuagaagauauagugcagacccucacacuauucgaagacagagagaugauccgcaaaagacucgacaucuauaaagauuucuuuaccgagucccaacugaagaaacuauacaggcgccacuacaccggcuggggcaggcucucggcuaaacuaauaaacggaaucagaaacaaagagaaccagaaaaccauccuagacuaucuaaucgaugacggcucugcuaacaggaacuucaugcaacucaucaaagacgccggacucucguucaagcccaucaucgacaaggcgcgaaccgggagccacucggacaaccuuaaggaggucguaggagaacuggcagggagccccgccauuaagaaaggaaucuuacaaucacuaaagaucguggacgaacucgucaaagugaugggcuacgagcccgaacaaauagucguggagauggcaagagaaaaccaaaccaccgccaaagggcuaucccgcucacgccaacgacuaaccacgcuacgagaaucccucgcuaaccuuaagucaaacauccuagaagagaagaaaccgaaauacgugaaggaccagguagagaaucaccaucucagcgacgaccggcuauuccucuacuaccuacaaaacggcaaggacauguacacagacgacgagcucgacauagacaaccugucacaguacgauaucgaucacaucaucccgcaggccuucauaaaagacgacagcauagacaaccggguguuagucucuagugcuaaaaaucgcggaaaguccgacgacguccccagcguggaaaucgucaaagauuguaagguauucuggaagaaacuccucgaugccaaauuaaugucccaaagaaaauacgacaaccugacaaaggcagaacggggcggccuaacauccgaugauaaagcgcgguuuauccaaaggcaacugguagagaccagacagaucaccaagcacguagcacgcauccucgacgaaagauucaauaacgaacuugacuccaaaggcagacgaauccgcaaaguaaaaaucguaacccugaaguccaaccucgucucaaauuuucgcaaagaguucggguucuacaagauccgcgaagucaauaacuaccaccacgcacacgacgccuaucucaacgcgguagucgccaaggccauccuuaccaaguacccgcaguuggaacccgaauuugucuacggagacuacccaaaguacaacuccuauaagacccgaaagagcgcaacagaaaagcuguucuuuuacucaaacaucaugaacuucuucaaaaccaaagugacgcucgccgacggcaccgucguagucaaagacgacauagaaguaaacaacgacaccggggagaucguaugggauaagaagaaacacuucgcgaccguacgaaaagugcuaucauacccccaggucaacaucgugaagaaaacagaaauacagaccggcggcuucuccaaagaauccaucuuagcgcacgguaacucagacaaacucaucccgcgcaagaccaaagacaucuaccuagaucccaagaaauauggcggcuuugacagcccgauaguagccuacagcguacucguugucgccgacauuaagaaaggcaaagcucaaaagcugaagaccguaaccgaacugcucggcaucaccaucauggagcgcucccgcuuugagaaaaacccgagcgcauuccucgaauccaagggcuacuugaacauccgcgacgacaaacugaugaucuuacccaaguacagccuauucgaacuggaaaauggacgccgacgccuacuagccucagccggcgaacuacaaaaagggaacgaauuggcccugccgacgcaguucaugaaauuccuguaucuagccucacgguauaacgagcuaaagggaaaacccgaagagauugaacaaaaacaagaguucgucguacaacaugucuccuacuucgacgauauacuccaaaucauuaacgacuuuagcaacagggucauccucgcagacgcaaaccuagagaaaaucaacaaacucuaccaagacaacaaagagaauauccccguagacgaacuugcaaacaacauaauuaaccucuucaccuuuaccagccuaggcgcucccgccgcuuucaaauucuuugacaagaucguagaccgcaaaagguauacaagcacgaaagagguacugaacucgacacuaauccaccaauccauaaccggccuauaugaaacacgcauagaucucggcaaacuaggagaggacuga

SEQ ID NO: 6608 - RNA, 4113 nt, Artificial Sequence
  Cas9 variant
augacaaaaaucaaggacgacuauauaguaggccuggacaucgggaccgacuccuguggcuggguagcgaugaacagcaacaaugacaucuugaaacuccaaggaaaaacagcaauagggagccgccucuucgaagggggaaaguccgcagcagaacgccgccuuuuccgcacgacucaccgaaggauaaagcgacgacgauggcgccugaaacuacucgaagaguucuucgacccauacauggcggaaguugacccguacuucuuugcccggcugaaggaaucaggucuuucgccucucgacaagcgcaaaaccgucagcagcauaguauuuccgaccuccgcggaagacaaaaaguucuacgaugacuacccaacgaucuaucaccuccgcuacaaacugaugaccgaagacgaaaaguuugacuuacgggaaguguaccuagcaauccaucacauuaucaaguaccgcgggaacuuccucuacaacaccucaguuaaggacuucaaggccucaaaaauagacgugaaguccuccaucgagaaacuuaacgaacucuaugaaaaccucgggcuggaccuaaacgucgaguucaacauaagcaacacggccgaaaucgaaaaaguucuaaaagacaaacaaaucuucaaacgcgacaaagugaagaagauagccgaacuguucgccaucaagacugacaacaaagagcaauccaaaagaaucaaagacauaucuaaacaaguggcaaacgccguucugggcuacaagacccguuucgacacaaucgcucuuaaagagaucuccaaagacgaacucucagacuggaacuucaaacucucagacauugacgccgacagcaaauucgaggcccuaaugggcaacuuagacgagaacgaacaagcgauccugcucacgauaaaggagcuauuuaacgaagucacacucaacgggaucguagaagauggaaacacacucucggagagcaugaucaauaaauacaacgaccaccgcgaugaccuuaaacuucuaaaagaaguaauagagaaccacauugaccgcaagaaagccaaggaacuagcucucgcauacgacuuguacgucaacaaccgccacggccgacucuugcaagccaagaaaaagcucggaaaaaucaagccacggucaaaagaagacuuuuacaaagucgucaacaagaaccuugacgacaguagagcuuccaaagaaauuaagaagaaaaucgaacuugacagcuucaugccgaagcagaggaccaacgcuaacggagucauaccguaccagcuccagcaacuagagcuggacaaaaucaucgaaaaccaauccaaguacuaccccuuccuaaaagagauaaaucccgugucaucgcaccuaaaagaggcccccuacaaacuagacgaacugauacgcuuccgaguccccuacuacgucggaccacugauaagcccaaaugaaagcacgaaagacauccagaccaagaaaaaccagaacuucgcauggaugauacgaaaagaggagggccgaauaacacccuggaacuucgaccaaaaggucgacagaauagagucagcaaacaaguucauaaaacggaugaccaccaaggacaccuaucuguucggcgaggacguacuuccagcaaacagccuucucuaccaaaaguuuacaguccuaaacgagcucaacaacauccgcaucaauggcaagcguauaagcguggaccuaaaacaagagaucuaugagaaccuauucaagaaacacaccaccguaaccgucaagaaacucgagaacuaccuuaaagagaaccacaaccuagucaaaguagagaucaaaggccuagcagacgagaagaaauucaacucaggccucaccaccuauaaccgcuucaaaaauuuaaauauauucgacaaccaaaucgacgaccucaaauaccgcaaugacuucgagaaaauaaucgaauggucgaccauauucgaagacaaauccaucuacaaagaaaaguugcgcagcaucgacuggcuaaaugaaaaacaaaucaacgcccuaagcaacauccgccuccaaggcuggggccgccuaagcaagaaacuucuggcgcagcugcacgaccacaacggccaaaccaucaucgaacagcuaugggacucacaaaauaacuucaugcagauagugacucaggcagacuucaaagacgcaaucgccaaagccaaccaaaaccuacucgucgcaaccucuguagaagacaucuugaacaacgcuuacaccagcccagcaaacaagaaggccauccggcaagugaucaaggucgucgacgacauagugaaggccgccuccgggaaagugccuaaacaaaucgcgauagaguucacccgcgacgcagacgaaaacccgaaacguucacaaacacggggaucaaaacuacaaaagguguacaaggaccucuccaccgagcuagcaucaaaaaccaucgccgaggaacucaacgaggcgauuaaggacaaaaagcuaguacaggacaaauacuaccuguacuucaugcaauugggccgagaugcguacacaggagaacccauaaacaucgacgagauccaaaaauacgacauagaucacauccucccgcaguccuucaucaaagacgacgcccucgacaaucgcguccuagugagccgugccgucaauaaugggaaaucggacaacguucccgucaagcuauucggcaaugaaauggccgcuaacuuaggaaugacuauccggaagaugugggaggaauggaagaacauaggccucaucagcaaaacgaaauacaauaaccuuuugacagaucccgaccacauuaacaaauacaagagcgcgggcuucauacgacggcagcuaguggagaccucacaaaucauuaaacuggucuccaccauacuccaaucgcgcuacccaaacaccgaaaucauaacagucaaggcgaaauacaaccauuaccuccgcgaaaaauucgaccucuacaagagcagagaggugaacgacuaccaucacgccaucgacgcauaccuuagcgcaaucugcggaaaccuccuguaccaaaacuaccccaaccuccgcccguucuucguauacggacaguacaagaaauucagcagugauccggacaaggaaaaggagauauuuaacaaaacccggaaauucucguucauaucccaaauccucaagaauaagucggaaaacucgaaggaaauugcagaaaagcucaaaagggccuaccaguucaaguacaugcuagugucacgagaaacggagacaaaagaucaggaaauguucaaaaugaccguauuuccuagagagacacccgguaaccucauaccgaaaaagaaaggcauggcucccgagauuuacggcggauacaccaaaaacucagacgccuacauggucaucgugaaaaucgacaaaaagaaagagacggaguaucgcauacugggcauccccacccgggagcucguaaaccucaagaaagcugaaaaagaagaccauuacgaauccuacuuaaaagaaauccuagccccgcgcauacuauacaauaaaaacggcaaacgagacaagaaaaucacuucauucgagauagugaaguccaaaauccccuacaaacaggucauucaagacggagacaagaaauucaugcucgggagcagcaccuacgucuacaacgcaaaacagcucacgcuguccaccgaaucgaugaaagcaaucaccaacaacuucgacaaggacucggacgaaaaugaugccuuaauaaaggccuacgaugaaauccuugacaaagucgacaaauaucucccccuuuucgacauaaacgcauuccgcaagaaacuccauucaggccgcgaaaaauucguugaacugucacucgaagacaagaaagacauuauccuaaaagugcucaucggccuacacgacaacccagcaaccucagaccugaaaaccuuaggguuuuccuccacagaacuaggaaaaaugcagaaaaacagcgggaucguacucagcggcaacgcgaaacucaucuaccaaucaccgacuggccuauucaagaaauccguaaaaauaagcgaccuguga

SEQ ID NO: 6609 - RNA, 4113 nt, Artificial Sequence
  Cas9 variant
augacuaaaaucaaagacgacuacaucguggggcuugacaucgggaccgacuccugcggaugggucgccaugaacuccgacaacgacauccuaaaacuccaagggaagaccgccauuggcucccaccuuuucgaggcaggcaagucagccgcagaccgccgucuauuccgcaccacucaccgccgaaucaagcgacgccgcuggcgacucaaacuccuugaagaguucuucgacccauacauggccaaaguggacccguacuucuucgcucggcucaaagaauccggccucucaccccuggacaagcgcaaaaauguuuucuccauaguauucccaacagcagccgaagacaagaaauucuacgaugacuauccgacaaucuaccaccuccgauauaaacugaugacggaagacgaaaaguucgacuuacgcgaaguguaccuagcaauacaccauauaaucaaauaccguggcaacuuccuauacaacaccuccgucaaagacuucaaagccaguaaaauagacguaaaaucaucaaucgaaaaacucaaugaacucuaugagaaccuaggccucgaccugaacguagaguucaacaucucuaacaccgccgaaauagaaaaaguccucaaagauaaacaaauauuuaagcgagacaagguaaagaaaauagccgaacuguucgcgauuaaaaccgacaacaaagaacaaagcaaaaggaucaaagacaucucgaagcagguagccaacgcgguccucggguacaaaacccgauuugacacuaucgcacugaaagaagucucuaaagacgagcuaagcgacuggaacuucaagcucucugacaucgaugccgacuccaaauucgaagcacucaugggcaaucuugacgaaaacgaacaggccauccuccucaccaucaaagaacucuucaaugcaguaacgcucaacggcaucguugaagacgggaauacccucucagaaagcaugaucaacaaauacaacgaccacagggaugaccuuaaacuacucaaagaagucaucgagaaccacauagauagaaagaaagccgucaagcuagccuuggccuacgaccuauacgucaauaaccgacaugggcaacucauacaggccaagaagaaacucgguaaaaucaaacccggcucaaaagaggacuucuauaaaguugucaauaaaaaccuugaugacagucaggcguccaaagaaaucaaaaagaagauugaacuagacuccuucaugccaaagcaacgaacaaacgcaaacggcgucaucccauaccaacuucaccaacuugaacucgacaaaauaauugaaaaccaaagcaaauacuaccccuuucucaaagaaauaaaccccgucucaucccaucugaaagaggcacccuacaaacucgacgaacucauacgguuccgagucccuuacuauguuggcccccucauaucaccaaacgaaucgacgaaggauauacaaacgaaaaagaaccagaacuucgcauggaugauacgcaaagaagaaggacgcaucacccccuggaacuucgaucagaaggucgaccgaaucgagagcgccaacaaauucaucaaaaggaugacaacaaaagacacauacuuauucggcgaaaacguacugccugcuaacucccuuuuauaucaaaaauucacagugcucaacgagcucaacaacauccgcaucaacggaaagcggaucucuguggaccucaaacaggaaaucuacgagaaccucuucaagaaacacacgaccguaaccgucaagaaacucgaaaacuaccugaaacagaaccacaaccucgucaaaguggagaucaaaggccucgcugacgagaagaaauucaacucaggccucacaaccuacaaccgcuucaaaaaucucaauauauuugacaaucagaucgacgaccucaaauaccggaaagacuucgagaaaauaauagaaugguccaccaucuucgaggacaaaagcauuuauaaagaaaaauugcguuccaucgacuggcucaacgaaaaacaaaucaacgcacuguccaacauccgccuacagggguggggccgcuuaucaaagaaacuuuuagcacagcuucacgaccacaacggacaaaccaucauagaacaacugugggacucacaaaacaacuucaugcaaauaguuacccaagccgacuucaaagacgcgaucgcgaaagcgaaccaaaaccuacucgucgccaccuccgucgaagacauauuaaacgacgccuauacgucccccgcaaacaagaaagcaauccggcaggucaucaaagucguugaugacaucguuaaagcagccagcggaaaagugccaaaacagauagccaucgaguucacaagggacgcagacgacaacccuaaacgcagccaaacccgaggcucaaaacuccagaaaguauauaaagaucugucaaccgaacuagcaucaaaagcaauagccgaggaacuaaacgaagcaauaaaagacaagaaacucguucaagacaaauacuaccucuacuucaugcaacuagggcgcgacgccuacaccggagaacccauaaauaucgacgaaauucaaaaguaugacauugaucacauacuaccccagaguuucaucaaggacgacgcacuggauaauaggguccuugucucaaaagcagugaacaacgacaaaagcgacaacguacccgugaaacucuucggaaacgaaauggccggcaaccucggcaucaccauacgcaaaaugugggaagaguggaagaacaucggccuaauauccaaaaccaaauacaacaaccuccucacagaccccgaccacaucaacaaauacgagucagcuggauucauacggcgccaacucguagaaaccucgcaaauaaucaagcucguauccacgaucuuacaaagucgcuacccaaauacugagauaauaacagucaaggccaaauauaaccacuaccuucgagaaaaauuugaccuuuacaaaucucgagaggucaacgauuaccaccacgcuaucgacgcauaucuuuccgccaucugugggaaccucuuauaccaaaacuacccaaaucuccgacccuuuuucgucuacgggcaauacaagaaauucucguccgaccccgacaaagaaaaagaaauuuucaacaaaacucgaaaauucagcuuuaucucccaaauacuaaagaacaaaucggaaaacuccaaagaaaucgcagaaaaguugaagcgcgcguaccaguucaaauacaugcucgucucccgcgagacugagacgaaagaccaagaaauguuuaaaaugaccguauucccgcgcgagaccccaggcaaucugauacccaagaaaaagggcauggcgaccgagaucuacggcggauauaccaaaaacucagacgcauacauggucauugucaagaucgacaagaagaaagaaaccgaauaccgcauucuagguauccccacacgcgagcuagucaaccuaaagaaagcagagaaagaagaucacuacgagucauaccuuaaagagauucuugccccacgcauacuauacaacaaaaacggaaaacgagacaagaaaaucaccaguuucgaaauagucaaauccaaaauacccuacaagcaggucauucaagacggcgacaagaaauucaugcucggcagcuccaccuacguauacaaugcaaaacaacuuacacucuccacugaaucaaugaaagcgauaacuaacaacuucgauaaagacagcgacgagaacgacgcccucauuaaagccuaugacgaaauccuagauaagguugacaaauaccucccccucuuugacaucaacgccuucaggaaaaagcuacacucagggcgagagaaauuuguagagcuuucccuagaagacaaaaaggacaucauccuuaaagugcucauaggacuacacgacaauccggcgacguccgaccugaagacccuaggauucuccagcaccgaacuggggaaaaugcaaaagaacagcggcaucguccucuccggaaacgcgaagcucauauaccaaagcccaaccggccucuucaaaaagucaguaaagauaagcgaucuguga

SEQ ID NO: 6610 - RNA, 4113 nt, Artificial Sequence
  Cas9 variant
augaacaaacccuacuccauaggacucgacauaggaaccaacucaguaggcugguccaucauaaccgacgacuacaagguacccgccaagaaaaugagaguccucgggaacaccgacaaagaauacauaaagaaaaaccuuaucggcgcccuacuauucgacggaggcaacacggccgcggaccgccgccuaaagagaacggcccggcgacgauacacgcggcgacgcaaccguauucucuaccuacaagaaauuuucgcagaggaaaugucaaaaguagacgacuccuucuuccaucgacucgaggacucuuuccucguggaagaggacaaacggggguccaaauacccgaucuucgccaccaugcaggaagaaaaauacuaccacgagaaauuuccgaccaucuaccaucugcgcaaagaacuggcagacaaaaaggaaaaggccgaccuacgccugaucuaucucgcacuugcucacaucaucaaguuccgcggacacuuccuuaucgaagacgaucgguucgacgugcgcaacacagauauccagaagcaauaccaagccuuucuggagaucuucgacaccaccuucgaaaauaacgaccuccucagucaaaacguagacguagaagcaauacuaaccgacaagauauccaaaagcgcaaagaaagaccgaauccuggcccgguacccaaaucaaaagucaacagguauauucgcagaguuccuuaagcucaucguaggcaaccaggcagacuuuaagaaacacuucaaccucgaagauaaaacaccccuucaauuugcgaaagacucauacgacgaagaucuugaaaaccuacuuggucaaauaggagacgaguucgcagaucuauucucggcagccaaaaagcucuacgacagcguccuccugagcgggauacucaccguaacagaccucagcaccaaagcgccacucucagcuagcaugauccaacguuacgacgaacaucgcgaagaccucaaacagcuaaagcaauucgucaaagccagccuuccagaaaaguaucaggaaaucuuugccgacucuucaaaagacggguacgccgguuauauagaaggaaaaacaaaccaagaagccuucuacaaguaccugagcaaacuucucacaaaacaagaaggauccgaauaccuguuagagaaaaucaagaacgaagauuucuuacgcaaacaacgaaccuucgacaacggcagcaucccccaucaaguacaccugacagaacuacgcgccaucauccgacgucagagcgaauacuaccccuuccucaaagagaaccuggaccgcaucgagaaaauauuaacauuucgcaucccuuauuacgucggcccccuagcccgagaaaagagcgacuucgcauggaugacacgcaaaaccgaugacucuauacgcccauggaacuucgaagaucugguagauaaggagaaaagugccgaagcguuuauucaccggaugacgaacaacgaccuauaccuacccgaagaaaagguacuccccaaacacucacugaucuacgaaaaauucacaguauacaacgaacucacaaaaguacgcuuucuggcugaaggcuucaaagacuuccaauuccuaaacaggaaacagaaggaaaccauauuuaacagccuguucaaggaaaaacgaaaagucacugagaaggacaucaucucuuuccucaacaaagucgacggcuaugagggcaucgcgaucaagggcauagaaaagcaguucaacgccucccugagcaccuaccaugaccucaagaaaauccucgguaaagacuuucucgacaacacugacaacgagcugauacucgaagauauaguacaaacccucacacuguuugaggaccgcgagaugauacgcaaaagauuagacauuuacaaagacuucuuuaccgaaucgcaacugaagaaacuauaccgacgccacuacaccggcuggggccgccucagcgccaaacuaauaaauggaaucagaaauaaagaaaaccagaaaacaaucuuagacuaccuaaucgacgacggauccgccaacagaaacuucaugcaacuaaucaaagacgcagggcuuagcuucaaaccaaucauagacaaagcacguaccgguucgcauagcgacaaccuaaaagaagucgugggcgagcuggcaggcucgcccgccaucaaaaaggguauacuacagucccucaaaaucgucgacgaacuuguuaaagugaugggcuacgagcccgagcagauaguaguggaaauggcccgcgaaaaucaaaccacagcgaagggccuuagccgaagcagacaacgccucacaacgcuaagagagagucucgccaaccucaaaucgaacauacucgaggaaaagaaaccgaaauacgugaaagaccaggucgaaaaccaccaucucagcgacgaccgacucuuccuguacuaccugcaaaacggcaaagacauguacacagacgacgagcucgacaucgacaaccugagccaauacgacaucgaccacaucaucccacaagccuucauuaaagacgacuccaucgacaaccgcgugcugguaagcuccgccaaaaaccggggaaaaucugaugacgugcccucugucgaaauuguaaaagacugcaaggucuucuggaagaaacugcuagacgccaagcuaaugagccagcgaaaauaugacaaccucacaaaggccgagcgaggcggccugacaucugacgauaaagccagauucauccaacgacaacucgucgaaacgcggcaaauaaccaaacacgucgcgcggauccuagacgagcgcuucaacaacgaacucgacagcaaaggccgccgcauacgcaaggucaaaaucgucacgcucaagagcaacuuaguuaguaacuuccgcaaagaguuugguuucuacaaaauccgcgagguaaacaacuaucaccacgcccacgacgcauaucuaaacgcugucgucgcgaaagcgauccugaccaaauacccgcaacuugaaccagaguucguauauggagacuaccccaaguacaacucauacaaaacucgaaaaucugcuacggagaaguuauucuucuacagcaauauuaugaacuucuuuaaaacgaagguuacccuagcagacggcacagucgucgucaaggaugacauagaaguuaacaacgacacuggcgaaauaguaugggacaaaaagaaacauuuugcaacaguacgcaaaguccucagcuacccgcaggucaauaucgugaagaaaacagaaauacaaacagguggcuucagcaaagaaucgauacuggcacacggcaauagcgacaaacucaucccccgcaaaacaaaagacaucuaccuagaccccaaaaaguacgggggauuugacucacccaagguagcauacucagugcucguuguggcagacauaaagaaaggcaaagcgcaaaaacugaaaacagucacagagcugcuaggaauaaccauaauggaacgcucgagauucgagaaaaacccgagcgccuuccucgaauccaagggguaccuuaacauccgggacgacaaacugaugauccucccuaaauacagccuguucgaacucgaaaauggcaggcgacgccuucucgccucggccggagaacuccaaaaagguaacgaacucgcccucccgacccaguucaugaaauuccuauaccuugccucccgauacaacgaacuaaaagggaagcccgaagagauagaacagaaacaagaguucgucgugcaacacguaucauacuuugacgacauacuucagauaauaaaugacuuuucaaaccgcguaauccuagcggacgcgaaccuagagaaaaucaacaagcucuaccaggacaacaaggaaaacauccccguagacgaacuggccaacaacaucaucaaucuuuuuacauuuaccagccucggugccccagcggccuucaaauuuuucgacaagauaguagaucggaagagauauacuuccacaaaagaaguacuuaacuccacccucauccacaaaucaaucacgggguuguacgaaacucgaaucgaccuagggaaacugggcgaggacuga

SEQ ID NO: 6611 - RNA, 4113 nt, Artificial Sequence
  Cas9 variant
augaacaaacccuacucgaucgggcuagacauugggacuaacagcgugggaugguccauaauaacggacgacuacaaagucccugccaaaaagaugcgcgugcuggggaauacugacaaagaauacaucaagaaaaaccugaucggagcccuccuauuugacggcgggaauacagccgccgaccgucgacucaaaagaaccgcgcgacgacgauacaccaggcgccgaaaccguauccuauaccuacaagaaaucuucgcggaggaaaugucgaaagucgacgacuccuucuuccaccgucucgaagacaguuuccucgucgaagaagacaaacgcgggagcaaauacccuauauucgcgacgcuccaagaagaaaaagauuaccacgagaaauucucaaccaucuaccaccucagaaaggaacucgccgacaaaaaggaaaaggcagaccuccggcugauauacauagcauuagcacacaucauaaaguuccgcggccacuuccucauagaagacgacucuuucgacguuagaaacacggacauaagcaagcaauaccaggauuuucucgagaucuucaacacaacauucgaaaacaaugaucuacugagccaaaacgucgacguggaagcaauccuuaccgacaaaauuuccaaaagcgcgaagaaagaccgcauauuagcgcaauacccaaaccagaaaucaacuggaauauucgcagaguuucucaagcuaaucgucggcaaccaggccgacuucaaaaaguacuucaaccucgaagacaagacaccucuccaauucgccaaagacagcuacgacgaagaccucgagaaccuccugggccagaucggagacgaguucgcagaccuauucuccgccgcgaagaaacuuuaugacagcguccuacuaagugggauacuaacggugaucgaccuguccaccaaagcaccccuauccgcauccaugauccagagauacgacgagcaccgagaagaccuuaaacagcucaaacaauuugugaaggcuucccucccggaaaaauaccaagaaaucuucgcugacagcucaaaagacggcuacgccggcuacaucgagggcaaaaccaaccaagaagccuucuacaaauaucuauccaaacuccuaacuaaacaggaggacucggaaaacuuccuggagaaaauaaagaacgaagacuuccuaagaaaacaacgcaccuucgacaacggaucaaucccacaccaaguccaccugacagaacuaaaagccaucauccgacgccagagcgaauacuaccccuuccugaaggagaaccaagacagaaucgaaaagauccucacuuuccgaaucccauacuacaucgguccauuggcacgagaaaaaucagauuucgcauggaugacccgaaagaccgacgacucuauccgccccuggaacuucgaggaccugguagacaaggaaaaaucugccgaggccuucauccaccgcaugacaaacaacgacuucuaucuuccagaagagaaaguccuccccaagcacucacucaucuacgaaaaauucacggucuacaacgagcugacgaaaguccgguacaagaacgaacaaggagagaccuacuucuuugacuccaacauaaaacaagaaaucuuugacggggucuuuaaggagcaccgcaaaguauccaaaaagaaacuccucgauuuccuagccaaagaauacgaagaguuccggaucguugacguuauugggcucgacaaagaaaacaaagccuucaacgccucccuggguacauaccacgacuuagagaaaauacuggacaaagacuuccucgacaaccccgacaacgaaucaauccucgaagauauagugcaaacccuuacccucuucgaagaccgggaaaugauuaagaaaagacucgaaaacuacaaagaccuauucacugaaagucagcugaagaaacuauaccgccgucacuacacaggcuggggacggcuauccgccaaacucauuaacggcauccgagacaaagaaagccagaaaacgauccuagauuaccucauagacgacggccgaagcaaccgcaacuuuaugcaacugaucaacgacgacggccuuuccuucaaauccauaauaagcaaggcccaagccgguucgcacagcgacaaccucaaggaaguagucggcgaacucgccggcagccccgccaucaagaagggcaucuuacaaucacucaaaaucgucgacgagcuuguaaaaguaaugggcuacgaacccgaacaaauaguagucgagauggcaagagagaaucaaaccacgaaccaaggcagaagaaacucacggcagcgcuacaaacuacucgacgacggggugaaaaaccuggcaucagacuugaacggaaacauacucaaggaauaucccaccgacaaccaagcccuacaaaacgaacgccuauuccucuacuaccuccagaacgggagagacauguacaccggugaagcgcucgacaucgauaaccucucacaauacgacauagaccacaucaucccccaggccuucaucaaagacgacuccaucgauaauagggucuuggugucaucagcaaagaaccgcggaaaaucagacgacguccccagccuggaaaucgucaaggacugcaaggucuucuggaagaaacuacuagacgcaaaacuaaugucccagaggaaauacgauaaccuuacgaaagccgaaagagggggacugaccucagacgacaaagcgcgauucauacaacgccaacucguugagacccgacagauaaccaaacacguagcacgcauccucgacgaaagauucaacaacgaacucgacaguaaggggcgcagaauacgcaagguaaagaucgucacacuaaagucgaaucucgugucgaacuuccgcaaggaguucgguuucuacaagauacgggaaguuaacaacuaccaccaugcacaugacgccuacuuaaacgcggucgucgcaaaagccauccucaccaaguacccacaguuggaaccggaguucguuuacggugauuaccccaaauacaacuccuacaaaacccgcaaauccgcuacggaaaaacuguucuucuacuccaacaucaugaauuucuucaaaacaaaggucacccucgcggacgggacuguaguugucaaggacgauaucgaggugaacaacgacaccggugaaaucgucugggacaagaagaaacacuucgcaacgguacgcaaaguccucucguacccacaaaacaacaucgucaagaaaaccgaaauucaaaccggaggguucucaaaagaguccauucucgcucacgguaauuccgacaaacugauaccccgaaaaaccaaagauaucuaccucgauccaaagaaauacggcggguucgacagcccaauuguagccuacucgguguuaguggucgccgauauaaagaaagguaaagcacagaaacugaaaacgguaacugaacuacucggcaucacgauuauggaaagaucacgauucgagaaaaacccauccgcauuucucgaauccaagggcuaccucaacauccgcgcagacaaauugauuauccuaccaaaguauagccucuucgaacucgagaacggacgaagaagacuacucgcuuccgcuggagaacuacaaaaaggaaacgaacucgcccuucccacgcaauucaugaaauuccucuaccucgcuucccgauauaacgaauccaaaggaaagccugaagaaaucgaaaagaaacaagaguucgucaaccagcacguuucauacuucgacgacauccuacagcucaucaacgacuuuucaaaacguguuauccucgccgacgcaaaccuagagaaaaucaacaaacuguaccaagacaacaaggaaaacauaagcgucgacgaacuggccaacaacauuauaaaccuauucaccuucaccucccuuggcgcgccggccgccuuuaaguucuuugacaaaaucgucgaccggaagcgauauaccuccacaaaagagguccucaauucgacccucauccaucagagcaucacaggccucuacgaaacucgcaucgaccucggcaaacucggagaggacuga

SEQ ID NO: 6612 - RNA, 4113 nt, Artificial Sequence
  Cas9 variant
augaacaagcccuacagcauaggacucgauauaggcacaaauucgguaggaugguccauaaucacagacgacuacaaggucccagcuaagaaaaugcgaguacucggcaauaccgacaaagaguacaucaagaaaaaucucaucggagccuugcuuuucgacggcggaaacacggccgcugaccgccgccucaaacgcacugcucgccggcguuacacucgacgccgaaaccgaauccuauaccuccaagagauuuuugcagaagagaugucaaaagucgaugacucguucuuccaccgccuagaagacagcuuccucguugaagaagacaaacgcggaucaaaguacccaauauucgcgacacuccaagaagaaaaggacuaccacgaaaaguucagcaccauauaucaccuccgcaaggagcucgcagacaagaaggaaaaagcggaccuccgccucaucuacaucgcgcuggcacacaucauaaaguucagaggucacuuccuaaucgaggacgacucauucgacguccgcaacaccgacaucuccaaacaauaucaggauuuccucgaaauauucaauaccacauuugaaaacaacgaccuacucagucaaaacguggacguggaagcaauucucaccgacaaaauuagcaaaagcgcuaagaaagaccguauccucgcucaguacccaaaccagaaaaguacuggaaucuucgcggaguuccucaaacucauagugggcaaccaagccgacuucaagaaauauuucaaccucgaagacaaaacgccccuacaauuugccaaagacucauacgacgaagaccuugaaaaccuccucggucaaauaggagacgaguucgcagaucucuucucagccgcaaagaaacucuacgacuccguauugcucuccggcauccuaaccguaauagacuuaucuacaaaagcgccacugucagccucgaugauccaaagauacgacgaacacagagaggaccucaaacagcucaaacaauucgucaaagccucacuccccgagaaauaccaagaaauuuucgcagacucaagcaaagacggauacgcaggcuacaucgaagggaaaacgaaccaagaagcguucuacaaauaccuaucaaaacuccuuacgaaacaagaagacagcgagaacuuccucgagaaaaucaaaaacgaagacuuccuacgcaaacaaaggacguucgacaacggauccauaccacaccagguacaccucacagaacucaaagcgauaauacgucgccaauccgaauacuacccguuccucaaggaaaaucaagacagaauugaaaagauccuaacauuucgcaucccuuacuacaucggcccccucgcacgcgagaaauccgacuuugccuggaugacccguaaaaccgacgacaguauacgacccuggaacuucgaagaucucguagacaaagaaaaaucagcagaggcguucauccaccggaugacaaacaaugacuucuaucugccggaagagaagguacugccgaaacauucacucauuuaugaaaaguucaccgucuacaaugaacuuacaaaagugagguacaaaaacgaacaaggcgagaccuacuucuuugacagcaacauaaaacaggagauauucgacgggguauuuaaggaacacagaaaaguguccaagaagaaacuuuuagacuuccucgccaaagaauacgaggaguuccguaucguugaugugauaggccuugacaaagaaaacaaagcauucaaugccucacugggcaccuaccacgaccuggaaaagauacuggacaaggacuuucucgacaaccccgacaaugaguccauccuggaagauaucguccagacacucacacuauucgaagauagggagaugauaaagaagagacucgaaaacuacaaagaucuguucacggaaucccaauugaaaaagcuguaccggcgacacuacacuggauggggacgccuaagcgccaagcucaucaacggaauccgcgauaaagaaucgcagaaaaccauacucgauuaccuaauagacgauggacgcagcaaccgcaauuucaugcaacuaauuaacgacgacggacugagcuucaagucaaucaucuccaaagcccaggcagggagccacagcgauaaccucaaagaggucguaggugaacuugcuggaucaccagcgaucaagaaaggcauacuacaaagccucaaaaucguagacgaacucgugaaggucaugggauacgaaccggaacaaaucgugguagagauggcaagggaaaaucagacgaccaaccaagggcgccgcaacuccagacaacgcuacaaacugcucgacgacggugucaaaaaccucgcaucagaccucaaugggaacauccugaaagaauaccccacagacaaccaggcacuccaaaacgaacggcuauuucuauacuaccuccagaacgggcgcgauauguacaccggcgaagcccucgacaucgacaaccucagccaguacgacaucgaucacauaaucccccaagcauuuauaaaagacgacucaaucgacaauagaguccuggugucuucugcgaagaaccgaggaaagucagacgacgucccaagucucgagauagugaaagacugcaaaguauucuggaagaaacuccucgacgcaaaacuaaugagccaacgaaaauacgacaaccucaccaaggccgaacggggaggccucacaagcgacgacaaagcccgauucauccagcgccaguuaguggaaacucgccaaaucaccaaacacguagcacguauucucgacgaacgcuuuaacaacgagcuagacagcaaggggcgacggauccgaaaggucaaaauaguaacccucaaaaguaaccucguaagcaacuuccgcaaagaguucggauucuacaagauacgcgaagugaacaacuaucaccacgcccacgacgccuaccucaacgccgucgucgcaaaggccauacucacuaaauacccccaacuagaacccgaguucguuuacggagauuacccgaaauacaacuccuacaagacccgcaagagcgccaccgaaaaacuguucuuuuauucgaacauaaugaacuuuuucaagacaaaagugacccuagcagacggcacagucguggugaaagacgauauagaaguuaacaacgauacaggagaaauaguaugggacaagaagaaacacuucgcgaccguacgaaaaguccucuccuacccacaaaacaacaucguaaagaaaaccgaaauacaaaccggcggguucucuaaggaauccauccucgcacacggcaacucagauaaacuuaucccccggaagacaaaagacaucuaccuagacccuaaaaaguacggcggcuucgacucaccgauaguugccuacagcguguuagucguagccgacauuaaaaagggaaaagcccaaaagcugaaaaccgucaccgagcuccuaggcauaacaaucauggaaaggagcagguucgaaaagaacccauccgcauuccuagaaucgaaagguuaccugaacauacgagacgacaaacucaugaucuuaccaaaauacucacucuucgaacuagagaacggacgccgccgacuacuagcaucggccggagaacugcagaaagggaacgagcuggcucuccccacccaauucaugaaauuuuuauaucuagcgucccgcuacaacgaaagcaaggggaaaccggaagagauugaaaagaaacaagaguucguaaaccaacacguaagcuacuucgacgacauccuccagcuaaucaaugacuuuuccaaaagggucaucuuagcggacgcaaaccuggagaaaaucaauaaacuauaccaagacaauaaagaaaauauaagcguagacgaacuagcaaacaauauaaucaaccuauucaccuucaccagccuaggggcaccggcagcuuucaaauuuuucgacaaaaucguagaccgcaaacgauacaccagcaccaaggaagucuuaaauuccacccucauccaucaaucgaucaccggucuauacgagaccagaaucgacuugggcaaacugggcgaagacuga

SEQ ID NO: 6613 - RNA, 4113 nt, Artificial Sequence
  Cas9 variant
augaacaaaccguacucaaucggacucgacauagggacaaacucaguaggcuggagcauaaucacggacgauuacaaggucccagcuaaaaagaugcgcguacucggcaacaccgacaaggaauacauuaaaaagaaccucauaggagcccuccuauucgacggcggaaauaccgccgcagaccgcagacuaaaacgaaccgcaagacgacgauauacgcguaggcgcaaccgaauacuguaccuccaggaaauauucgccgaggagaugucuaaaguggacgacucuuucuuccaccgccuggaagauucauuccucgucgaggaagacaaacgcggcuccaaauauccgaucuucgccacaaugcaagaggaaaaguacuaccacgaaaaguuccccaccauauaccaucuccgaaaagaacuagcagauaagaaagaaaaagcugaccuacgccuuaucuaccuggcacuggcccacaucaucaaguuccggggccauuuccucaucgaagacgacagguuugacguaagaaacacagacauccaaaagcaauaucaagcauuccucgagauuuuugacaccaccuucgagaacaacgaccuccucucacaaaacguagacguugaggccauacuuacagacaagaucuccaagucugccaagaaggaucggauccucgcgcgcuacccaaaucaaaaaucaaccggaaucuucgccgaguuccucaagcucauaguagggaaucaggccgacuucaaaaagcacuucaaccuggaggacaaaacaccacuccaauucgcaaaagacucauacgacgaggaccuggaaaaccuacuggggcaaaucggggacgaguucgccgaccuauuuucagcggccaagaaacucuacgacucaguccuacucaguggaaucuuaaccgucacggaccuaucaacuaaagccccacuauccgcuucaaugauccaaagguacgacgaacaccgugaagaccucaaacagcuaaaacaauuuguaaaggccagccuuccggaaaaguaccaggagauauucgcagacuccucuaaggacggcuacgccggcuauaucgaaggcaaaacaaaccaagaagccuucuacaaguaccuaagcaagcuacuuacaaagcaggaaggcucugaauaccuucuagagaaaauaaagaacgaagacuuccuacgaaaacagcgcacguucgacaacggaucaaucccccaucaagugcaccucacagaacugcgcgccaucauacgacggcaaucggaauauuacccgcucuuaaaggaaaaccuagaccgaauagagaaaauucugacauucaggauacccuacuacguaggaccacuagcccgugaaaagucagacuucgcauggaugacacgcaagaccgacgacagcauccgcccauggaacuucgaagaccuaguagauaaagaaaaguccgccgaagccuucauccacagaaugacgaacaacgaccuauaccuucccgaagaaaaaguucuaccgaagcauagccuaaucuacgagaaguucaccguauacaacgagcuaaccaaaguacgguucuuagccgagggcuucaaagacuuccaguuccuaaaucgaaaacaaaaagaaaccauauuuaacagcuuauucaaggagaagcgaaaaguaaccgagaaagacauaauaucguuucucaacaagguggacggauacgaaggcaucgcaauuaaagguaucgaaaaacaauuuaacgccagccucagcacauaccacgaucuaaagaaaauccugggaaaagacuuccucgacaacacagacaacgaacugauccuggaagacaucgugcagacccuaacccucuucgaagaccgagaaaugauuaggaaacgacuagacaucuacaaggacuuuuucaccgagucacaacucaagaaacuguacagacggcauuacacgggcuggggacggcucuccgcaaagcucaucaacggcauaaggaacaaggaaaaucagaaaacgaucuuagacuaccugaucgacgacggcagcgccaaucgcaacuucaugcaacuaaucaaggacgcaggccucucauucaagccaaucaucgacaaagcgagaaccggcagccacagcgacaaucugaaagaagucgucggcgagcucgcaggcucgccagcaaucaaaaagggcauacuucaaagccugaaaauagucgacgaacugguaaaagucaugggcuacgaaccagagcagauagugguggagauggcccgcgaaaaccaaaccacagcaaaaggccuaucccgcucacgacagcgucuaacgacacuacgcgaaagccuugcaaaccucaagagcaacauauuggaggagaagaaacccaaauaugucaaagaucagguagagaaccaccaccugucugacgaccgccucuuccuuuacuaccuucaaaacggcaaagacauguacaccgacgacgaacucgacauugacaaccucucacaauacgauauugaccacaucaucccccaagccuucauaaaagacgacuccaucgacaaucggguacuggucuccuccgccaaaaaccgaggcaaauccgacgacgucccgagcguggaaauuguaaaagacugcaaagucuucuggaagaaacugcuggacgcaaaacucaugucacaacguaaauacgacaaccucacgaaagccgaacgaggcggacuaacaucggacgacaaggcccgauucauccagcgacagcucgucgaaacgcgccaaaucacaaaacauguagcccgaauacuagaugaacgcuuuaacaacgaacucgacagcaagggucguagaauuaggaaagucaaaaucgugacauuaaaguccaaucucgugagcaacuuucgaaaggaguucggauucuacaagauccgagaaguaaacaacuaucaccacgcccacgacgcauacuuaaacgcugucguagcgaaagccauacuuacaaaguacccgcagcuagaaccagaguucguauacggcgacuacccgaaguacaacuccuacaaaacccgcaaaucagcgacggaaaaacuuuucuucuacagcaauauaaugaacuucuucaaaacaaaagucacgcuagcagacggcacggucguugugaaagacgacauugaggucaacaacgacaccggagaaaucgugugggacaaaaagaaacauuuugcaacaguccgcaaaguccucucauacccccagguaaacaucgugaaaaagacggaaauccaaacgggugguuucucgaaagaaucaauucuagcccacggaaacagcgacaaacugauaccacggaaaaccaaagacaucuaccucgaucccaagaaauacggcggguucgacucaccuaucgucgccuacuccguccuaguugucgccgacaucaagaaaggcaaagcacaaaaacuaaaaacugugaccgaacugcucgguauaacuauaauggagaggucgcgauucgagaaaaaucccuccgccuuccuggaguccaaaggcuaccucgacauccgagacgacaaacuuaugauacugccaaaauacucacucuucgaacucgaaaacggccgccggagacuacucgcgagugcgggagaacuccaaaaaggaaacgaacuggcgcugccgacgcaauucaugaaauuccucuaccuggcaucucgcuacaacgaacuaaaagggaaaccggaagaaaucgaacagaaacaagaguucgucguacagcacguauccuacuucgacgacauucuacagauaauaaacgacuucuccaacagggucauauuagccgacgcaaaccuagaaaagauuaauaaacuuuaccaggacaacaaggaaaauaucccggucgaugaacuagccaauaacauaaucaaccucuucacauucaccucccugggugcgccagcagccuucaaguucuucgacaaaauagucgaccgcaaacgguacaccucaacaaaagaaguucucaacuccacccugauccaccaaagcaucacaggacucuacgagacgcgcauagaccuugggaagcucggagaggacuga

SEQ ID NO: 6614 - RNA, 4113 nt, Artificial Sequence
  Cas9 variant
augaagaaaccguacucgaucggccuagacaucggcaccaacagcgugggcugggccgucguuacugacgacuacaaaguucccgccaaaaagaugcgcguguucggagacacggaucgcucacacaucaagaaaaaccugcucgggacccuucuguucgacgauggaaacaccgcagagagccgccgccucaaaagaaccgccaggcgccguuacacacgccggcggaaccgcauacuauaccuucaggaaaucuucacugaauccaugaacgaaauagacgagagcuucuuccaccgccuggacgacuccuucuuagugccagaagacaaacgcggcagcaaauaccccaucuucgccaccuugcaagaagaaaaagaauaccacaaacaguucccaacaauauaccacuuaaggaagcaacucgcugacucaaaagaaaaguccgacgugcgccucaucuaccuagcacucgcacacaugauaaaauaccgaggccacuuccucuacgaagaaacauucgauaucaagaacaaugauauacagaaaauauucaacgaguucaucaacaucuacgacaauaccuucgagggcucgucccugaguggccaaaacgcacaggucgaagccauauucacugacaaaauaucuaaguccgcuaaaagggaacguguucucaaacuauuccccgacgaaaagagcaccggccuauucagcgaguuccucaaacucaucgucggcaaccaggccgacuucaagaaacauuucgaccuggaagaaaaagcgccacuacaauucucaaaagacaccuaugaugaggaacucgagaaucuccucggccagaucggcgacgacuucgcugaccuuuuccuaaucgccaagaaacucuacgaugcaauccuccuuuccgggauccucacggugacagacccaagcacaaaagcaccccuaagugccucgaugaucgaacgcuacgaaaaccaccaaaaagaccucgccgcacugaaacaauucauuaaaaacaaccucccagagaaauacguagaagucuuuucagaucaaucaaaggacggauacgccggauacauagacggcaaaacaacacaggaggccuucuacaaguacaucaagaaccuccuaagcaaguuugaaggagccgacuacuuccuagacaaaaucgaacgcgaggacuuccuacgcaaacagcgcacguuugacaacgguagcaucccccaccaaauccaucugcaagagaugaacgcaauccuacgccggcaaggagaacauuacccguuccuuaaggagaauagggagaaaaucgaaaagauacuaaccuuccgaaucccguacuacgucggcccccuggcccgcgacaaucgagauuucucuuggcuaacccgcaacucagacgagccgauucgcccauggaacuucgaagagguaguagauaaagcgagaagcgcugaggacuucauccaccgcaugaccaacuacgaucucuaccucccggaagaaaaaguccucccuaaacauuccuuacuauacgagacguucgcugucuacaacgaacuaacaaaggugaaguucaucgcagaaggccuccgcgauuaccaauuccuugacucaggccagaagaaacaaaucguaaaccaacucuuuaaagagaaacgaaaaguuacagaaaaagacaucauccauuacuuacacaacguagacgguuacgacggaauagaacugaaaggaaucgaaaaacaauucaaugccaacuuauccaccuaccacgaccuucugaaaaucaccaaagacaaggaguucauggacgacccaaagaaugaagaaaucuuagaaaauauagugcauacacucacgauauucgaagaccgcgaaaugaucaaacaacgccucgcucaauacgacacccuguucgacgaaaagguaauaaaagcccucacccgccgucacuacacuggcugggguaaacuuucggccaaacugaucaacggcaucagagacaaacaauccgguaaaaccauacuggacuaccuaauagacgacgacaaaaucaaccgaaauuucaugcaacugauaaacgacgacggucugagcuucaaagagauuauccaaaaagcccaggucguagggaagacagacgacgucaaacagguaguccaagagcuaccaggaagccccgccauuaagaaaggaauacuacagucaaucaaaaucguagacgaacucguaaaggucaugggcuacgcccuagaaucaaucguaauagaaauggcacgggaaaaccagacaaccgcccgcggcaagaaaaacucccaacaacgcuauaagcggauugaagacgcacuaaagaaucuagcacccggccuagacucgaauauauuaaaagaaaaccccaccgauaacauccagcugaaaaacgaucgacuauuccuuuacuaccuccaaaacggcaaagauauguacacgggcaaaccauuggacauaaaccaacucucaagcuacgacaucgaccacauaauuccccaagcguuuauaaaagacgauuccaucgauaaucgcguacuuacaucaagcaaggacaaccggggcaagagcgacaacguccccucccucgagguaguccagaaaagaaaagcguucuggcaacagcuacuagauucgaaauugauuucggaaagaaaauuuaacaaucugacaaaggcagaacgcgguggacucgacgaacgagacaaaguaggcuucauccgccgucagcucguggagacucaacaaaucaccaagaacguagcgcagaucuuggacgccagauucaacacggaagucaaggagaagaaucagaaaauccggacugucaaaaucaucacacuuaaauccaaccuagucucuaacuuucgaaaagaguucgggcucuauaagguacgcgaaaucaacaacuaccaccacgcacacgaugccuaccuaaacgcggucguagcgaaggccauacucaagaaauauccaaaacucgaacccgaguucgucuauggcgacuaccagaaauacgaccucaaaaaguacauaucgcgcuucaaacccuccaaagaaaucgaaaaggccacggaaaaauacuucuucuacuccaaccuacucaauuucuucaaagaagaaguauuguacgcagacggcaccauccgaaaacgagaaaacaucgaauacucuaaagacacuggugagaucgcuugggacaaagagaaagacuucgccaccaucaaaaagguacuguccuacccgcaggucaauauagucaaaaagcgcgaaguccaaaccgggggcuucucuaaagagucgauccugcccaagggaaacucugauaagcuaaucccacgcaaaacuaaggacaucuuaugggauacuacaaaauacggcggguucgacagcccuguaaucgcauacuccauacuccucaucgcagauaucgaaaaaggcaaagcaaagaaacucaaaaccgugaaaacgcucgugggaauuaccaucauggaaaaagcugcuuuugaagaaaacccaaucaccuuccuggaaaacaagggcuaccauaacgugcgaaaagaaaacauccuuugccuacccaaauacucacucuucgaacucgaaaacggccggagacgccuacuagcauccgcaaaggaacuccagaagggaaacgaaaucguccuucccgucugcuuaaccacccuccuauaccacucgaaaaaccuacacaagcuggacgagcccgaacaccuugaauacauccagaaacaccgaaacgaguucaaggaccuacucaaucucguauccgaguucagccagaaauacauucuugccgaagccaaccucgagaaaaucaaggaccuuuacgcagauaacgaacaggccgacauagaaauacuggccaauucuuucaucaaccugcuaaccuucaccgcucuuggagccccagcggcguucaaauuuuucggcaaagacgucgaccguaaacgauacaccaccgugucugaaauccugaacgccacacugauccaccaaucaauaaccgggcuuuaugaaacaagaauagaccuaucaaagcucggcgaggaauga

SEQ ID NO: 6615 - RNA, 4113 nt, Artificial Sequence
  Cas9 variant
augaagaagccauacuccauaggccuggacauuggcaccaacagcgucgggugggccguaauaaccgaugacuacaaagucccugccaagaagaugaaaguacuaggaaacacagacaaaaacuacauuaaaaagaaccuccuaggggcacuccucuucgacagcggaaacaccgcagaagaucguagacugaaacguaccgcacgucgccgcuauacccgccgucgaaacagauuacucuaccugcaagacauauuuucugacgaaaugaacaagguagacgagagcuucuuccaccggcucgaagacagcuuucugguaucugaagacaaaagaggagaccaccacccgaucuucgguaacgucguagacgaagucaaguaccacgaacaguucccaacaaucuaccaccuccgcaaauaccuggcugacacucccgaaaaggccgacuuacgacucguguaccucgcacucgcacacaugaucaaauuucgcggacacuuucuaaucgacgacccaaaacuggacgucaagaacaccgacagccaggaacucuucagccaauuccucaccgcauacgacgugacccaggaggacucccaccucgccgacgucaagaucaacauauccgacaucaucacagagaaaaugaacaaaucacgcaaaguagaagcccuacuauuucacuuccccucccagaagaaaaacagcuucuucggcaaucuuguaagucucgucuucggccuacucccuaacuuuaaaacgaacuucaauuuggccgaagacgcaaaacugcaacuguccaaagacuccuaugacgaagaccuagagaaucuccugggccaaauuggcgacgaguauaccgacguguucguugcagcccgcaaacuguacgacagcauccuccucuccggcauacucacaguuaacgaccugucaacaaaagccauucucucagcaagcauggugcgacgauacgaagaacauaacaaagaccucgccaaacuaaaggcuuucgucaaagcgaacuucacccacgauguauucaaagagguauuuucggacgccuccaaaaacgguuaugccggcuacaucgagggcaagacaucacaagaggacuucuacaaauacguuaagaaccucauagggaaaguugacggcuccgccgacuuuaucgaaaagaucgaucgcgaagacuuccuucgcaaacaacgcacauucgauaacggcucaaucccacaucaaguccaccuagcugaaaugaaggcaauccuccgucggcaaggagaauacuacccguuccugaaagaacacgccgaaaagauccagcaaauccucacguuccgaauacccuacuacguaggaccccuagaccggcacggucacucagacuucgccugggccagcuucaacuccgaggagaaagucaccccauggaacuucgaagagauaaucgacaaaaacaagagcgcacaggcauucauugaacgcaugacuaaccaagaccucuaucucccaaacgaaaaaguccuaccuaagcacuccccacucuacgaaaaauacaccgucuacaacgaacucaccaaaauaaaauaugucacugaaacagggaccgccaaauucuucgacgccaaccuaaaacaggagaucuuugacggccuuuucaagaaggaacgcaagguuacaaaacgaaaacuacucacauucuuagagaaaaacuuugacgaguuccguauaguggauauccaagggcucgacaaagaaaccgaaacguucaacgcaucguacggaaucuaccaggaccuguuaaaaaucaucaaggacaaggcauucauggaugacucugaaaaugcggacauccuagaagacaucguccucacccugacccuauucgaagacagagaaaugaucaaacagagacuagccaaauacgccgaccucuuugauaagaaagucaucgacaaccuggcccgccgccgauauaccggguggggccgacugucagcaaaacuccucaacggaauacgagacaaacgaagccgcaaaacgaucauggacuaccucgucgaugacggccgauccaaccgaaaccucaugcaacucaucacagaugacaaccuuaccuucaaagaugaaaucgccaaggcccaauacuccgacaacuccgaugaccugcaccaaguaguacaagaccucgcggggucccccgcaaucaagaaagggauacuccagagcgugaaaaucguggacgagcuagugaaaguaaugggcuaugagccugagcaaauagucgucgagauggcgcgcgaaaaccaaacaaccgcgaaaggaagacgaaacucccaacaacgcuacaaaagacucgaggaagcaauuaaaaaccuagaucgagaccuuaacuacaaaauacuaaaggaacaccccaccgacaaccaagcccuucaaaacgauagacucuuccucuacuaucugcagaacggccgagacauguacaccggcgagucacuugacaucaaccgacucucagauuacgauaucgaccacauaauaccucaagccuucaucaaagacaacagcauugacaauaggguacuugugucuucagccaaaaaccgaggcaaaucugacgacguccccucggaggacgucguaaaccgcaugcgacccuuuuggaacaaacuacucaacugcgggcucaucucccagcgaaaguacucaaaccucacgaagaaagaacuaacccccaacgacaaggcuggcuucauuaaacgucagcuagucgaaaccaggcaaaucaccaaacacguagcgcgaauacuagacgaacacuucaacaaagaguucgacgaagacaagaaacgcauccgaaaaguaaaagucgucacucucaaaucuaaccuagucagcaauuuccggaaagaguuugagcuguacaaggugcgcgaaaucaacgauuaccaccacgcgcacgacgccuaccucaacgccguugucgcaaaagcgcuccuaaugaaguacccaaaacucgaaccagaguucguuuacggggaauacccaaaauacaacuccuacagagaaaggaaaaccgcaacacaacgaauguucuucuauucaaacauuaugaacauguucaaaagcaaaguaaaacuggccgacgaacgaaucaucgaacggccuaugaucgaagucaaugacgagacaggugaaaucgccugggacaaaaccaaacauauagcaaccgucaaaaagguccucucauacccgcaaaucaacaucgucaagaaaguagaagaacagaccggcgggcuaaccaacgagaccaucuauccccgcggaucguucgacaaauuguuaaaccgcaaaaacacacucgaggcaagcaaauacgggggcuuugguagcccaacaguagcauacugcguacucguagucgcggacuccaaaaacgagaacggaaaagucaaaaagcugaagcucggcuccgagcuccuaggcaucacaauucuagagaaaaacgacuucgaaaacaacucgcuggacuucuugagccgaaaaggcuaccaaggcguccaagaaaagaagaucauaaagcuccccaaauauucacuauucgaguuccaagaugggagcagacgcaugcucuccucggugauggcaaacgacaauaaacggggcgaccuacagaaggccaacgaaaugauccucccggccuaccucgucaagcuccucuaccacgccaaacauaucaacuccgucggugaaccggcgcacaagaacuacauaaacgaacauugcucagaguuccaagaccuccugaacuacaucagacaguucgccgacaaauucguagacgucgacaaaaauuugagcaaaauacggucgcucuccaagucaauggccgaauacuccguuuccgaaauaugcucaucguuuguaaaccugcucacccuaaccgcccuuggagcccccgcagacuucaaauucuucggcaccacaaucccgagaaaacgguacggcucgccccagucgauacuauccgccacccugauacaccaaaguauaaccggacucuaugaaacccgaaucgaucucagcaaacucggggaagauuga

SEQ ID NO: 6616 - RNA, 4113 nt, Artificial Sequence
  Cas9 variant
augaacaaaccguacucgaucggccuugacaucggcaccaauucagugggcugguccauaaucacggacgacuacaagguaccggccaagaaaaugagaguccuaggaaacaccgacaaggaauacauaaagaaaaaccuaauuggggcgcuccuuuucgacggcgguaacaccgcggcagaccgcaggcuaaaacgaaccgcucgacgccgcuacaccaggagacgaaaccgaaucuuguaccuacaggaaauauucgcggaagaaauguccaaagucgacgauaguuucuuccaccgccucgaagacagcuuccucguggaagaggacaaacgaggaucgaaguacccgauauuugcaacaaugcaggaggagaaguauuaccacgaaaaauuccccaccauauaccaccuccgaaaagaacucgccgacaagaaagaaaaagcugaccuacgccuaauauaccuagcgcuggcacauaucauaaaguucagaggacacuuucuaaucgaagacgaccgguucgacguacggaacacggacauccaaaaacaguaccaagccuuccuagaaaucuucgacaccaccuucgagaacaacgaccugcuaagucaaaacguggacguugaggccauacugacggacaagaucagcaagagugccaaaaaggacagaauccuggcgcgcuacccgaaccaaaagagcacagguauuuuugcggaguuccuaaagcucaucguaggaaaccaagcugacuucaagaaacacuucaaccucgaagauaagaccccgcuacaauucgcuaaagacucauaugacgaagaccuagaaaaccuccuaggacagauaggagacgaguucgcugaccuuuucucugcagccaagaaacuuuacgauucuguacugcuaagcggcauccucacaguuacagaucuaucaacaaaagccccgcuaagcgccucaaugauccaacgcuacgacgaacaccgagaagaccuaaagcaacucaagcaauucgucaaggccagccugccggagaaguaccaagaaauauucgcagacaguuccaaggacggcuaugcaggcuacaucgaaggaaagaccaaccaagaagccuucuacaaauaucucuccaaacuacucaccaaacaagaaggcagcgaauaccuccuagagaaaaucaaaaacgaagacuuccuacguaaacagcgcacauuugacaacggaucaauaccacaccagguccaccucacugaacuccgcgcgaucauccgcaggcagucggaauacuaccccuuucucaaagaaaaccucgaccgcauagagaaaauucuaaccuuccgcaucccauacuacgucggcccccuagcccgugaaaaaucugacuucgccuggaugacgcgcaaaaccgacgacagcaucaggcccuggaacuucgaagacuuaguugacaaagagaaaucugccgaggcguucauccaucguaugacuaacaacgaccuauaccuacccgaagagaagguauuaccaaagcacucccuaaucuacgaaaaauucaccguuuauaacgagcuaaccaaaguucgcuuccuagccgagggauucaaagacuuucaauuucucaacagaaaacagaaagaaacgaucuucaacagccuauucaaagagaagcgcaaggucaccgaaaaagacauaauauccuuccucaacaaaguagacggcuacgaggggaucgcuauaaaaggaauagagaagcaauucaacgcauccuuguccacauaccacgaccuuaaaaagauacuaggaaaagauuuccuagauaacacagacaacgagcucauacuggaagacauaguucaaacgcucacccucuucgaggaccgagaaaugauacgaaagcgccucgacauauacaaagacuucuucacggaaucucagcucaaaaagcucuaccgccggcacuacacgggcuggggccgccuaagugccaaacucaucaacgggauucgcaauaaagaaaaccagaagacaauccuagacuaccucaucgacgacggauccgcuaaccgcaacuuuaugcaacuaauaaaagacgcaggccucucauucaaacccaucaucgacaaggcacgcacgggcucccacucagacaaucuaaaagagguagucggagagcuagccgggucacccgcaauaaagaaagguauacugcagagccucaaaaucgucgacgagcuggucaaagucaugggcuacgaacccgaacaaaucgucguagaaauggcccgugagaaccagacuacggccaaaggauuaucacgacugcgccaaaggcucaccacguuacgcgaaucucucgcaaacuuaaaaucuaacauacuagaagagaagaaacccaaguacgucaaagaccaaguagaaaaccaucaccucuccgaugaccgccucuuccuguacuaucugcaaaacgguaaagacauguacacagacgacgaacucgacauagacaaccucucccaauacgauauagaucacauaauaccacaggcauucauaaaagaugacucaaucgacaaccgaguucucgucuccucagcgaaaaaucgcggaaaaagcgacgaugugcccagcguagagauaguaaaggacuguaaggucuucuggaaaaagcuccuggaugccaaacuaaugucacagcggaaguacgacaaucugaccaaggccgaacguggaggccuaacuucugacgacaaagcacgcuucauccagagacagcuagucgaaacccgccagauaaccaaacacgucgcgcgaauccuggacgaaagguucaacaacgaacucgauuccaagggacgacggauucgaaaaguaaagauagucacgcuaaaaaguaaccuugucagcaacuucagaaaagaguucggcuucuacaagauccgggaagugaacaacuaccaucacgcacacgacgcguaccuaaacgcugucgucgccaaggccauucucacuaaauauccccagcuagagcccgaguucguguauggcgacuaccccaaauacaacuccuauaaaacccgaaagagcgccacagaaaaacucuucuucuacucaaacaucaugaacuucuucaagacgaagguaacccuugcugaugguacggugguagugaaagacgacaucgaagucaacaacgacacaggagaaaucgugugggacaaaaagaaacacuucgccaccgugcgcaaaguccucucguacccucaagucaacauaguuaagaaaaccgagauccagaccggaggguucucaaaagagucaauccucgcccacggaaauuccgacaaacugauaccacggaaaacaaaggacaucuacuuagacccgaagaaauacggcggcuucgacucaccgaucguagcauacagcguccuaguugucgcagacaucaagaaaggaaaagcccaaaagcugaaaacgguuacagagcuauuagggauaaccaucauggaacgaagucgcuucgagaaaaacccaucagccuuucucgaaagcaagggauaccucaauauccgcgacgacaaacuaaugauacucccgaaguacucccucuucgaacucgaaaacggaagacggaggcuccucgcaucugccgacgaacuccaaaaagggaacgaacuagccuuacccacccaguucaugaaguuccucuaccuggccucacgcuacaacgaacucaaaggcaagccagaagaaaucgagcagaaacaggaguucgucguacagcacgucuccuacuucgacgacauacuacaaaucaucaacgacuuuagcaaccgcgucauuuuagcagacgccaaccucgagaaaaucaacaaacuuuaccaggauaacaaagagaacauacccgucgacgaacucgcaaauaauaucauaaaccucuucacauuuaccucucucggcgccccggccgcauucaaauucuucgacaaaaucgucgaccguaaacgcuacaccuccaccaaggaaguccuaaacagcacacugauacaccaauccauaacgggacuuuacgaaacucggauagaccuuggcaaacucggcgaagacuga

SEQ ID NO: 6617 - RNA, 4113 nt, Artificial Sequence
  Cas9 variant
auggaaaagaauaaagaauacguaaucggccuagacaucggcaccgggucgguuggcuggucagcaaucuccacggacaacuaccagcucaucaggcagaaaggcaaaaaccuuaucgguguccgauuauucaacucagcugaaacugcggaggaacgacgcggcuauagaacgacaagacggcgucucuccagacgucgauggagaaugucacugcucaacgacaucuuccgcccagagcucaacgaaaucgacgaaaacuuucuggcacggcuuaaguauucguggguguccccgcuggaccagaaaaacccccaacuuaacgagcaaggcacaaacgccucccuuuacggagacaucgaggccgaucaagccuuucacagggccuacccaacaaucuaccaucugcgcaagacccugauggaggacaaccagaagcacgaccuacgugaaguauaccucgcaauacaccacaucguaaaguaucggggacacuuccuaaccccggacuucgacgcaaauucgcaaacgauagacaucaaaggacuguucaagcaacugggagacgugagcgggagcaucgaacugcaagccgaccagacaagcacagucaucgccgcauuccaauccauacugcuggacuucacgaagacgccaacugagucgggucggcuggccgggcagcuauucucagaucagaacaaggauaaacaggccaaaaagcaaguagaggaacuguucaagcuccucaggggcggcaaaggaagccucgcugacauguuucuccucaccgaccucgacaaaguggucaaaaaccaauuaaaauucgcguucgaugacgccguggaugaaaaccuaaaccuuaucagcaaucuaauaaacgaggagcaauacgaacuccuccucaauauccaaaaacuccgaggaaccaucauacucaaacaaauacucggcgacgacgaaaccguaucagacgcgaaagucagaucauaugaagaacacgcacaccagcugaaggagcuaaaagcacaagugcugaccaaagacaacaaagaaaaauucgaagaggcuuaucaacucauacaaaaaggagaugccagcaggaucgacggccucaagaaacucaaaacgaucaucaaucaagaacacgaggcgcuaaggcuggacaaauacgaagccgacaaacuccugaagcugauagaacucgaccagcuacuaccagugcaacgauccaaacguaauggcgaaaucccgcaccaacugcacgaguucgaacugaagaaaaucauugaaaaacaagggagguacuacccguucuuaagagaaaccuucgaacgagacggccaggaguucaacaaaaucggucaacucgucaacuuccgcauuccguacuacgucgggccacuugucgacccacgccuggccggcauccaaucgggcgaccagaccaaccacuggaugacccagaaaaaggcgggcaagaucacucccuggaacuauacagaauugaucgacaucgacaaaucggcugcagaguucauuaaaagaaugaccggaacggacacauaccucgugggggaacccucccuacacaaagccucacuaauauaccaagacuacaacguucuccaagaacucaauaaccuccgauaugacggaaaaccgcugccgguagaugcaaagcaggaaaucuacucgaacuuacaggugucccuaaagaacgccacgaaaaacaaaauuaacuccuuccuaaucucagaagguuaccuccaagacggcgaagaacuaacaggauuugcaggcaaagaacucaaaaacaagcuaaguuccuuccacuauuucaaaaacaucuuuggaccagaaagaaugaacacccugggcaccgacaaccucgagaaaauaaccgaacugcaaacuguauucgaagaccgacacaugcugaaacgccaauuacaaaaacucggcuucuuagacgaugacgaaugcgaaaaacucgcgggcaaacacuucaccgguugggggaaccugagcaagaaacuccuuaacaccccggcaaucaucgaccccgaaauaaaugaaaauaaaaucuccuuaaucgacgcccuauauaaaggccaacgcaaccuguccuucuacgucaacaacauggacgacaaauaccaauuccgcgacuggaucgaaucagaaaaccaaucccagcaaguagaaaucagccuagacgagaaaaucaaaaaccuggcggggucccccgccaucaaaagaggcaucacucaaucuauggcuguaauccaagacauaauacgugccaauaacggcaucuccccaaaaaggaucuaccuggaguucgcacgagaaagccagaacagcuaccaaccgaacagccgcaucaaacagaucgagaaaaucuacgaccaaaacaagaaagaacuaaugaaagucuacccagacguauucaaagacguccaaggcguacucaacaacgucgaugaaaacaacagccuuuccgaaaaagccuuccucuacuucaugcaguuggggaaagacauguacaccggagaagcccuagauuucgacaaacuauacaccuacgacaucgaccacaucaucccacaagcgaugacaaaagacaauaguugggacaacaaaguccuaguaacagcaaucaaaaaccgggaaaaauccaaccaaguccucgacaacgcgauacaagcaaaaaugcacaacuucuggcugcagcucaaaaaggugaaccuacuaagccagcguaaauacgacacccugaugaagacaaacuucucaaagggugacgaaaagaaguucauagcuaggagccucguagaaacacggcaaaucaucaaaaacgucgccgaacugauaaaaucagaguucgaccauguggaagcgauacccauacgccaggaacucaccagugacaugcgccaacucauggacuauaagaaaaaccggcuaguaaacgacuaccaucacgcccacgacgcguugcuaauugccacggugggagaauuuaugcaaaagcgcggcuucaugcagggaaugaaccccucccaaaacguuuaucacggcuacacccaguacgucaaaaaguggcucagcauggccaaaaaggcacggagcgccgaaaaacccgaacgaaucuuccccuuacaauucgucguaggauccaugcggauggcagugcgugacggccaggucgacaaagucacacacccagcgacgggcgagaucugcuggaccgcugacaacgaagcguaccuccgaaagguccucggauacaagaacauacugguuacccgaaaggucaaaaacgccggaaaacuguaccagcgaguaacaguaaaaccaaaaggcuccggggaagcccccguaaaucaccaaaaaucagacauaaacaucuacggaggcguuacgagcgagcaggccgcagaacucguacucauacgcaucaaagccaaaaacaacgcuaaaaacaugguaaucaagauucccacagccaucgcgaaccagguugccaacaaaacgacaaccuacgacgccuacguuaggucacucaacauaccuaauuacgcaggcaucauacuggaccaaaucccgcucgggcagcuagucuucgacgagcggaccaguuucuaccucgcgagcgccgaaauuaaacacaacgcccgccaacucuggguaaaccaacacauaaauaacguccuuaccaaaaagaacaucaacgacgaagaacgcgauaacauccucaaccuacucacaaacgagaaaaaccuggaaagauucaaacuacuagaaccagaccucaaacgcgucaaggccgccaagcagcagugggcguccugcgacgaccaagaacagaugcaaauccuccgcaucaucauuaacaagaugcacgacgacgcgaguccccaaaucccaggaaaaauugaucccuucaaaaacuaucuugacaaacaagggaagggcuggcgcgaccuccgcaccaaaaagggaaugaaacuuagcgacaacgccgaauuuguguaccagagccccacagggcucuaccaccgaaagauuucaaucaacgaacuccuaaagcaaaaacagcuugaauga

SEQ ID NO: 6618 - RNA, 4113 nt, Artificial Sequence
  Cas9 variant
augaacaaaccauacagcaucggacuggacaucggaacuaacuccgugggcuggagcauaaucaccgacgacuauaaaguccccgcuaaaaagaugcgaguacuagggaacacggacaaagaauacaucaagaaaaaccuaaucggcgcccuccuauucgacggaggcaacaccgccgcagacagaagacugaaacgcaccgcaaggcgaagguacacccggcgccgcaaucgcauccucuaccuccaagaaaucuucgcagaagaaaugucgaaaguggaugauagcuucuuccaccgacucgaggacucauuucucguagaagaagacaaacguggaucgaaauacccgaucuucgcaaccaugcaagaggaaaaauacuaucacgaaaaauucccgacaauauaccaccuucgaaaagaacuugccgacaagaaagagaaagcggaucuacggcugauauaccuugcccuagcccacauaauaaaauuccgcggacacuuccucauugaagacgaccgauucgacguccgcaacaccgauauccaaaaacaauaccaagcauuccucgagaucuucgacaccacauucgagaacaacgaccuguuaucacaaaacgucgaugucgaagcgauccuuaccgacaagaucucaaagagcgcgaagaaggacaggauucucgccagauacccuaaccaaaaauccaccggaaucuucgccgaguucuugaaacucauagucggaaaccaggcggacuucaagaaacacuucaaccucgaagauaagacaccccuucaauucgcaaaagacuccuacgacgaagaccuagaaaaccuucuugggcaaaucggagacgaguucgcggaccuauucagcgccgccaagaaacuauacgacucgguccugcucagcgggauccugacggucacggaccuaucaacgaaagccccacucagugccagcaugauacaacgcuacgacgaacaccgcgaagaccugaaacaacucaaacaauucgucaaagccucacuucccgaaaaguaucaagagauauucgccgacagcagcaaagacggguacgcuggauacaucgaaggcaagaccaaccaagaagcauuuuacaaauaccucuccaagcuacucaccaaacaagaaggaagcgaauaucuccuagaaaagaucaaaaacgaagacuuccucaggaaacaacgcacauuugacaacggauccauaccccaccaaguacaccugacagaacugcgugcaauaauacgacgacaguccgaauacuaccccuuccuaaaggagaaccuagacaggaucgagaaaauacucacguuccgcauccccuacuacguagggccccuagcacgggaaaagucggacuucgcauggaugacccgaaagacagacgacagcauacgccccuggaacuucgaagaccucgucgacaaggaaaaauccgccgaagccuucauacacagaaugaccaacaacgaccuguaccuccccgaggaaaagguccuccccaagcauagucugaucuacgaaaaauucacgguauauaacgaacucaccaagguuagauuccuagcggaaggcuucaaggacuuucaauuccuaaaccgcaagcagaaggaaacaauauucaacucccuauuuaaagagaaacgcaaagucaccgaaaaagacauaaucucauuccuaaacaaggucgacggguacgagggcaucgcgaucaagggcauugaaaagcaguucaacgcaagccucucaacguaccacgaccuaaagaaaauccugggcaaagacuuccuagacaacaccgacaacgagcuuauccuggaagacaucguccaaacgcucacacuuuucgaagaccgugagaugauccgcaagcgccuagacauuuauaaggacuucuucaccgaaucacaacugaaaaagcuguaccgcagacacuauacaggauggggccgacuaagcgcaaaacucauaaauggcauacgaaacaaggagaaucagaaaaccauucucgacuaccugauagacgacggcucugcuaaccgcaacuuuaugcagcuuaucaaagacgcgggccugucguucaaacccaucaucgacaaagcaagaacaggaucccaccucgacaaccucaaagaaguggugggggaacuggccggcuccccggcgaucaagaaaggaauuuuacaaucacuaaaaaucguagacgaacucguaaaaguaaugggcuacgaaccagaacaaauaguagucgaaauggcucgcgagaaccaaacuacagcaaaaggucucagccgaucacgccagcggcuaacaacacuuagagaaucacucgcaaaccucaaaucuaacauccucgaggagaagaaaccaaaauacgucaaagaccaagucgagaaccaccaccugagugacgaccgccuauuucuauauuaucuccaaaauggcaaagacauguacaccgacgaugaguuagacaucgacaaucuaucgcaauacgacauagaccauauaauaccgcaagcauucaucaaggacgacuccauagacaaccggguccugguaucguccgcgaaaaaccgaggaaaaucagaugacgucccgucacucgagauagucaaagacugcaagguauucuggaagaaacuucucgaugccaaacugaugagucaacgcaaauacgacaacuugacaaaagcugaaaggggcggccucacaucggaugacaaagcccgcuucauacaacgacaacucguagagacacggcaaauaacaaaacacgucgcacgcauacucgacgagcgcuucaacaacgaacucgacagcaaagggcgccggauccgaaaagugaaaaucgucacccucaaaagcaaccucgucagcaauuuccgcaaagaguucggauucuacaaaauaagagaagucaacaacuaccaucacgcacacgacgcauaccugaaugcugucguagccaaggcuauccuaaccaaguacccgcaacuagaaccggaguucguuuacggggacuacccaaaguacaacagcuacaaaacccgaaaaagcgcuacggaaaagcuguucuuuuacagcaacaucaugaacuucuucaaaaccaaagucacccuggcagauggcacggucgucgucaaagacgacaucgaaguaaacaacgacacaggagaaauagucugggauaaaaagaaacauuuugccaccgugcgcaaagugcucuccuacccacaaguuaacauaguaaagaaaaccgaaguccagacugggggcuucuccaaggaauccauccucgcacacggcaacucagacaaguuaaucccacguaaaacaaaggacauauaccucgauccgaagaaauacggcggcuucgacuccccaaucgucgcauacucuguccugguuguagcggauauaaagaaaggcaaagcccagaaacucaaaaccgucaccgaacuccucggaaucacaauaauggaacggucgcgauucgaaaagaaccccagugcauuucuagaauccaagggcuaucuuaacaucaggacagauaaacuaaucauacucccaaaauacagccuauucgaguuggaaaacggacgacgccgccuauuagcuagugcaggcgaacuccaaaagggaaacgaacuagcccugccgacccaauacaugaaguuccucuaccuagccucacgauacaacgaacuaaaaggaaaaccagaagagaucgaacaaaagcaggaguucgucguucaacacgucucuuacuuugacgauauacuccaaauuaucaaugacuucucgaaccgagucauccucgcagaugcaaaucuggagaaaauaaacaaacucuaccaagacaacaaagaaaacauuccgguggacgaacuagcaaacaacauaauaaaccuauucaccuucacgucucucggcgcaccggccgcauucaaauucuucgacaaaaucguagaccggaaaagauauaccagcacgaaagaaguacugaacuccacccucauccaccaaucaaucacagggcuauacgagacccgcauagaccuggggaaacugggggaagguuga

SEQ ID NO: 6619 - RNA, 4113 nt, Artificial Sequence
  Cas9 variant
augaacaaaccuuauucaaucggccuugacauaggaacuaauaguguaggcuggagcaucauaacggacgacuacaaaguaccggccaagaagaugaggguacugggcaacaccgacaaggaauacauuaagaaaaaccuaauuggcgcacuccucuucgacggaggcaacacagccgccgaccgccgccuuaaaagaaccgcacgccgccgcuacacucgacgccgcaaccgcauuuuguaccuucaagaaauuuucgccgaggaaauguccaaagucgacgacuccuucuuccaucgccucgaggauagcuuccuagucgaagaggauaagcgcggcagcaaauaccccaucuuugcgacucuccaagaagagaaagacuaccacgaaaaguucuccacgauuuaccaccuacggaaagagcucgccgacaagaaagagaaggcagaccugcgacuuaucuacauagcccucgcacacauuauuaaguucagaggacacuuccuuaucgaggacgacuccuucgacguccgcaacacagacauaaguaagcaauaucaggacuuuuuagaaaucuucaacaccacauuugaaaacaacgacuuacugucccagaacguagacguagaagcaauucucaccgacaaaauaucaaaaucagcaaagaaagaccgcauacucgcacaauaccccaaccagaaauccaccggaauauucgcagaguuccucaaauuaaucgucggcaaucaggccgauuucaaaaaguacuucaaccuggaggacaaaaccccacuacaauucgccaaagacagcuacgacgaagauuuggaaaauuuacuaggccaaaucggagacgaguucgcggaucucuuuucugcagccaagaaauuauacgacuccguccuucucuccggaauacuaaccguaauagaucuuuccacuaaagcaccccuuuccgccucuaugauccaacgauacgacgaacaccgcgaagacuugaaacaacucaaacaauucgucaaagccucgcuccccgaaaaauaccaagaaaucuucgccgacuccuccaaagacggguacgccggguacauagaaggcaaaacgaaccaggaggcauucuacaaauaccugucgaaacuacucacaaaacaagaggacagcgagaacuuccuagagaaaaucaaaaacgaagacuuccuccgcaagcaaagaacauucgacaacggcuccaucccacaucagguccaccucaccgaauugaaggcaaucauacgucgucagucggaauacuacccauuccuaaaagagaaccaagacagaaucgaaaagauccuuaccuucaggauccccuacuacaucggcccccuagcacgcgaaaaaucagacuucgcauggaugacccgcaagaccgacgacucaaucaggcccuggaacuuugaagacuuagucgacaaagaaaaauccgcagaagccuuuauccaccggaugacuaacaaugauuuuuaccuuccugaagagaaggugcuaccaaagcacucccucaucuacgaaaaauucaccguauacaacgaacuaaccaagguccgcuauaaaaaugaacaaggcgaaacauacuucuucgacuccaauaucaaacaggaaaucuucgacggaguauuuaaagaacaccgcaaagucuccaagaaaaagcuacuagacuuccucgccaaagaauacgaggaguuccggauagucgaugucauaggucuugacaaagaaaacaaagcauucaacgccucccucggcacuuaccacgaccuagagaaaauccuagauaaggacuuccuagacaacccggacaacgaaucaauacuggaagacauuguacaaacacuaacccucuucgaggaccgagagaugaucaaaaagcgccucgaaaauuauaaagaccucuucaccgaaucgcagcucaagaaacuuuaccgccgacacuacaccggauggggccgccucagugcaaaacucauaaacgguauucgugacaaagaaucacagaaaacuauacucgauuaucucaucgaugacggacgcuccaacagaaauuucaugcaacucauaaacgacgacggacuauccuuuaaaagcaucauauccaaggcacaagcaggaagccacagcgacaaccuaaaagagguggucggagaacuagccgguucccccgccaucaagaagggcauccugcaaucacucaagaucgucgacgaacucgucaagguaaugggcuaugaaccagagcaaaucguggucgagauggcaagagaaaaccaaacgacaaaccaaggaagacgcaacucacgacagagauauaagcuccuggacgacggcgucaaaaaccucgcgagcgaucuaaauggcaacauauuaaaagaauaccccacugacaaccaggcacuccaaaacgagcgacuuuuccucuauuaucugcaaaacggccgcgacauguacaccggcgaagcacuagacauagacgaccucucacaauacgacaucgaccacauaauaccgcaggccuucauaaaggaugacuccauagacaaccgcguacucguauccagugccaaaaaucgaggcaaaucugacgacguccccagccuagaaauaguaaaagacugcaaagucuucuggaagaaacuacuagaugccaagcucaugucgcaacgcaaguacgauaaccucacaaaagccgagaggggcggccuaacuucagacgacaaagcacguuucauacagcgccagcuaguggaaacacgccaaaucacuaagcacguugcccgcauccuagacgaacgguuuaacaacgaacuggacagcaaaggccggcgcauccgcaaaguaaaaauagucacgcucaaaucgaaucucgucagcaacuuccggaaagaguucggcuucuacaaaauccgggagguaaacaacuaccaccacgcccacgacgccuaccucaaugcggucgucgcgaaagccauccucacaaaguauccucaacuagagccggaguucgucuacggcgacuauccuaaauauaauuccuacaaaacuagaaagagcgcuaccgaaaagcuauucuuuuacuccaauaucaugaacuucuucaagaccaaaguuacgcuggccgacggaaccgugguaguaaaggacgacauagaaguaaacaacgacaccggggagauagucugggauaaaaagaaacacuucgccacggucaggaaaguauuaagcuacccccaaaacaauauaguaaagaaaaccgagauucaaacaggaggcuucagcaaagaauccauccuagcacacggaaauuccgacaaacuaaucccucgcaaaacaaaggacaucuaccuagauccuaagaaauacgggggauucgacucacccaucguagcauacucgguacuggucgucgcugacaucaagaaaggaaaagcccaaaaacucaaaaccguaacggagcuacugggcaucacaauaauggaacgcucccguuucgagaaaaacccauccgcauuccucgaaagcaaaggcuaccucaacaucagagcagacaaacuaaucauacugcccaaauacucucucuuugagcuggaaaacggacggcgccgacuccuagccuccgccggagagcuccagaaaggaaacgaacuggccuuacccacgcaauucaugaaauuucuauaccuugccucgcgcuacaacgaauccaagggcaagccugaagaaaucgaaaagaaacaagaguuuguaaaccagcauguaucauauuuugacgacauccuccagcuuaucaacgacuucuccaagcgcgucauacuagccgaugccaaccuugagaaaauaaacaaacuauaucaggacaacaaagaaaacaucuccgucgacgaacucgcaaauaacaucauaaaucuauucaccuucaccagccuaggcgcuccggcggcguucaaauucuucgacaagaucguagaucgcaaaagguacaccuccacaaaagaagugcuaaacucgacacugauccaccagucuaucacgggacuuuacgagacgcgaaucgaccucggcaaacugggggaagauuga

SEQ ID NO: 6620 - RNA, 4113 nt, Artificial Sequence
  Cas9 variant
augaacaagccauacaguauaggacuggacaucggcacaaacucaguaggguggucaaucauuaccgacgacuacaaaguaccagccaaaaagaugcggguacuuggcaacacagauaaggaauacaucaagaagaaccugauaggcgcacugcuauucgauggcggcaauacagccgccgaccgucgacuuaagcggaccgcaaggcggcgcuacacccgccgacgaaaccgcauucucuaccuccaagaaauuuuugcugaagaaauguccaaaguggacgacucauucuuccaccguuuggaggacagcuuccucgucgaagaagauaaaagaggaagcaaauauccgaucuucgccacccuacaggaagaaaaggauuaccacgaaaaauucucgacaaucuaccaucugcgcaaggaacucgccgacaaaaaggagagggccgaccuucgccugaucuacaucgcgcucgcacacauuauaaaauuccguggucacuuccuuauagaagacgacucauucgacgucaggaacaccgauaucuccaaacaguaucaggacuuccucgagaucuucaacaccacguucgaaaacaacgaccuccucagccaaaacgucgacgucgaggccauccuaaccgacaaaauaagcaaauccgcuaagaaagacagaauccuagcacaauacccuaaucaaaagucuacaggcaucuucgccgaauuucucaaacugaucguagguaaccaagcugauuucaaaaaguacuuuaaccucgaagauaagaccccgcuccaauucgcgaaagacagcuaugacgaagaccuugaaaaccugcuaggccaaaucggcgacgaauuugccgaccuuuucagcgcugcaaagaaacuuuaugacucaguacuccuaucaggcauccucacagucaucgaccucagcaccaaagcaccccuuucugcuagcaugauacaacgguacgacgaacaccgcgaagaccugaaacagcuuaaacaauucguaaaggccucccucccggagaaauaccaagaaaucuucgccgacagcuccaaggacggcuacgccggauacauagaaggaaagaccaaccaagaagcauucuacaaguaucuaucgaagcuacugacaaaacaagaggacucagaaaacuuccuggaaaagaucaaaaacgaagacuuccuccgaaaacaacgcaccuucgacaauggauccauaccccaucagguccaccucacggaacucaaggccauaauccgcaggcaguccgaauacuaucccuuccuaaaggagaaucaggaccggauagagaagauacuaaccuuccgaauccccuacuacaucggaccgcucgcacgugagaaaucugacuucgccuggaugacgcgcaaaaccgacgacagcauccgccccuggaacuuugaggaccucguugacaaggagaaaagcgccgaagccuucauacacaggaugaccaauaacgacuucuaccuuccggaggagaaagugcucccaaaacacucgcugauauacgagaaguuuaccguauacaacgaacuaaccaaaguacgcuacaaaaaugaacaaggcgaaacauacuucuucgacuccaacaucaaacaggaaaucuucgacgggguauucaaagagcacagaaagguauccaagaaaaaguuacuggacuuccuggcaaaggaguacgaggaguucaggauaguggacgucaucgggcuugacaaagaaaacaaagcauucaacgcaucgcucgguacuuaccacgaccucgagaagauccucgacaaagacuuccuggacaacccagacaacgaaagcauacuagaggacauuguccaaaccuugacccucuuugaagaccgugaaaugaucaagaaacgacucgagaauuacaaagaccuauucaccgagagucagcuaaagaaacucuaccgacgccacuacacaggauggggccgccucagcgcuaaacucaucaacggaauccgagauaaagaaucccagaaaacaauccucgacuacuugauugacgacggucggucaaaccguaauuucaugcaacugaucaacgacgacggacugucauucaaauccauuauaucgaaggcgcaggcggguucccacagcgauaacuugaaagagguugugggcgaacucgcgggaucacccgccaucaagaaaggcauccuacagagccucaaaaucguugacgaacucgugaaggucaugggcuaugaacccgaacagaucguaguagaaauggcgcgcgaaaaccaaaccacgaaccaagggagacgcaacucgcgacaacgauacaaacuacucgacgacggcgucaagaaucucgccagcgaccuaaacggcaacauacuuaaagaguaccccaccgacaaucaagcccuucaaaacgaacgacucuuccucuauuaucugcaaaacggccgagacauguacaccggggaggcauuagacauagacgaccuuagccaauacgauauagaccacauaaucccacaagccuuuaucaaagaugacagcaucgacaaccggguccuaguaagcuccgccaagaaccgagguaaaagcgacgacgugccgagccucgaaaucgucaaagacuguaaaguuuucuggaaaaagcuccuagacgcaaaacuuaugucacagcgaaaguacgacaaccucacaaaggcggaaagaggcggcuuaaccucagacgauaaggcccgguucauccaaagacagcucguagaaacacgccaaauaaccaaacaugucgccagaauacucgacgaacgauucaauaaugagcuugacagcaaaggccgccguauucgcaaaguaaaaauagucacacuaaaaaguaacuuggucuccaacuuccguaaagaguucggguucuacaagauccgcgaggucaacaauuaccaccacgcacacgacgcauaccuaaacgccguaguagcaaaagcaauacucaccaaauacccacaacuagaaccugaguucgucuacggagacuacccaaaauacaacucguacaagacgcgcaagagcgcaacagaaaaacucuucuucuacuccaacaucaugaacuucuucaaaaccaagguaacacucgccgacggcaccguugucguuaaggacgacauagaaguaaacaacgauaccggugagaucguaugggacaaaaagaaacacuuugccacgguacgcaaaguccucucguacccccaaaacaacaucguuaagaaaacggagauccagaccgguggguucucaaaagaauccauccucgcacauggcaacagcgacaaacucaucccacguaaaaccaaagacaucuaccucgacccuaaaaaguacggaggauucgacagccccaucguagccuacagcguacuggugguagccgacaucaagaaagguaaagcgcagaaguugaagaccgucaccgagcuccucgggaucacgauaauggaacgcucccgcuucgagaaaaaccccuccgcguuccucgaaucaaagggguaccucaacauacgcgcagauaagcucaucauucuaccgaaauacucccuguucgaacuugaaaacggcaggcgccgacuccucgcaucggccggugaacuacagaaaggcaacgaacuagcacuacccacccaauucaugaaauuccuauaucucgcuucccgcuauaacgaaucgaaaggcaagccagaagaaaucgaaaagaaacaggaguucgucaaucagcacgucagcuauuucgacgauauacuccagcuaauaaacgacuuuuccaaacgcgucauacuggccgacgccaaccucgagaaaauuaacaaacucuaucaggacaacaaagaaaacaucuccguagacgaauuagcgaacaacaucauaaaccucuuuacguuuacaucgcugggcgcacccgcagccuucaaauucuucgacaaaaucgucgacagaaaacgauacacuucaaccaaggaagugcucaacuccacgcugauccaccaaucaaucaccggccucuacgaaacccggaucgacuuaggcaaacuuggagaagacuga

SEQ ID NO: 6621 - RNA, 4113 nt, Artificial Sequence
  Cas9 variant
augaacaagccauacucgaucggccucgacaucggaacgaacagcguaggauggagcauaaucacagacgauuacaaagucccagccaagaaaaugcggguucucggaaacacggacaaggaauacaucaagaaaaaucucaucggugcacuccucuucgacggcgggaauaccgcaucggaucgccgacuaaaacgcacggccagacgucgcuauacccggcgccgaaaccggauacucuaccuacaagagauuuucgcagaagaaauguccaaggucgacgacuccuucuuucaccgucucgaagacucauuccuagucgaagacgacaaacgaggauccaaauauccaauauucgccacaaugcaagaagaaaaagacuaccacgagaaauucccaaccaucuaccaucugcguaaagaacuagccgacaaaaaggaaaaagcagaccuccgacucuucuaccuagcgcuugcccacaucaucaaauuccgcggccacuucuuaaucgaagacgacucguucgacgucaggaacacggacauccaacggcaguaccaggccuuccucgaaaucuucgacaccaccuucgaaaacaaucaccuacucucccaaaacaucgaugucgaaggaauacuuaccgauaagaucuccaaaagcgcuaagaaagaccgcauacuagcccaguaccccaaucagaaaucaaccgggauauucgcggaguuccugaaacuaauagucggcaaccaagccgacuuuaagaaacauuucaaccucgaagacaaaacaccccuccaguucgccaaagacucauacgaugaagaucuugaaaaucuccucggacaaaucggcgacgaguucgccgaccuauucucaguagccaagaaacuuuacgacucagugcugcugagcggcauuuuaaccgucaccgaccuaucaacgaaagcaccccugucagccuccaugauucaacgauacgaugaacaccgggaagaucucaaacagcuaaagcaauucguaaaggccagucuacccgaaaaguaccaagaaaucuucacagacagcagcaaggacggauacgccgguuacaucgaaggaaaaacuaaccagggagccuucuauaaauaccuaucgaaauuacucacaaaacaggaagggucagaauacuuccucgaaaagaucaaaaacgaagauuuccuacgcaaacaacgcacauucgacaacggcuccaucccccaucaaguccaucuaaccgaacugaaggcaaucauccgacggcaaucugaauacuacccauucuuaaaagaaaaccuggaccgaaucgagaaaauacucacuuucaggauccccuacuaugucgggccccucgcucgugaaaaaucagacuuugcauggaugacccgcaagacggacgauagcaucagacccuggaacuucgaagaacucguugacaaagaagccuccgccgaagcguuuauccaccggaugaccaacaacgaccucuaccugcccgaggagaaagugcuacccaaacacucccuaaucuacgagaaauucaccguauacaacgaacucacgaaaguucgcuacaaaaacgaacaaggagagacguacuucuucgacucaaacauuaaacaagagaucuucgauggcguguucaaagaacaccgcaagguuuccaaaaagaaacuccucgauuuccucgcaaaagaguacgaagaguuccgaaucguagacguaaucgggcucgauaaagaaaacaaagccuuuaacgccucacuaggcaccuaccacgaucugaaaaagauacuagacaaagacuuccuugacaacccugacaacgaauccauacuggaagauaucguacagacgcugacccuauucgaagaccgcgaaaugaucaaaaagcgccuggagaacuacaaagaucuauucaccgagucacaacucaaaaagcuauaccgccggcacuacacgggauggggaagguuguccgccaaauugaucaauggcauucgcgauaaggaaucgcagaaaacaauacuugauuaccuaaucgacgacggaaaauccaaccgcaacuuuaugcaacucauccacgacgacggacucaguuucaaauccaucaucagcaaggcccaggccggcagccacucugacaaucuaaaagagguaguaggcgaacucgcagggucccccgcgauuaaaaagggcauacuacaaucgcucaaaauagucgacgaacuugucaaagucaugggauacgagccagagcaaaucgucgucgagauggcucgcgaaaaccaaacgacaaaccagggccgacggaacucgagacaacgcuauaagcugcucgacgacggcgucaagaaucucgccuccgaccucaacggaaacauccucaaagaauacccuaccgacaaccaggcccuacaaaacgagagauuauuccuauauuaucuccagaacgggcgagacauguacacaggcaaggcccucgacaucgacaaccucucacaauacgacauagaccauaucauuccgcaagcauucauaaaggacgacuccauagacaaucgaguucuaguguccagugccaagaaucgaggaaagagcgacgacgucccuucccuagagauagugaaggauugcaagguauucuggaagaaauugcuggacgccaaacuaaugagucagcgcaaauacgacaaccuuaccaaagccgaacgagguggccugacuucugacgacaaggcaagguucauccaacgacagcucgucgagacccgacagauaacaaaacacguggccaggauccucgacgagcgauucaauaacgaacuggacucaaagggacgccgcauucgaaagguaaaaauagucacacucaaaagcaaccuugucuccaacuuccgaaaagaguucgguuucuacaagauacgcgaagucaacaauuaccaccaugcacacgacgccuaccucaaugcagucgucgccaaagcuauccugacuaaauacccgcaacucgagccagaguucguguacggcgacuauccuaaauacaacuccuauaaaacgcguaaauccgcaaccgaaaaacuuuucuucuacuccaacauaaugaacuucuucaaaaccaaaguaacccuggcugacggaaccguagucguaaaagacgacauagaggucaacaacgacacuggugaaaucguuugggacaaaaagaaacacuucgcaaccgugcgcaaaguccugaguuacccacaagugaacaucgugaagaaaacagaaauacaaaccgggggauucuccaaagaaucuauccuagcccacggcaacagcgacaaauuaauaccccgcaaaaccaaagacauauaucucgaucccaagaaauauggcggauuugacuccccaaucgucgccuacagcguccucguagucgcggacauaaagaaaggcaaagcacaaaaacucaaaacagucaccgagcuacuaggaauaaccauaauggaacgaucccgcuucgagaaaaaccccucugccuuccucgaaagcaaaggguaccucaacauccgugacgacaaacucaugauacugcccaaguacagccucuuugaacucgagaacggacgccgacgccuccuagcguccgccggagagcuccagaagggcaacgaacuggcauugccaacccaauuuaugaaauuccucuaucucgccucucgauacaacgaacucaagggcaaacccgaagagauugaacagaagcaggaguucguuguccaacacguaucauacuucgacgauauccuccagaucauaaacgacuucucaaaucgugucauccuggcggacgccaaccucgagaaaauaaacaaacucuaucaagacaauaaggaaaacaucagcguagacgaacucgcaaacaacaucauuaaccuauucaccuucacgucacucggagcccccgccgcauucaaguucuuugauaaaaucgucgacaggaaacgauacacgucaaccaaagaaguucucaacagcacacucauccaccagagcauaacgggacuauacgaaacgcgaauagaccuaggcaaacucggggaagacuga

SEQ ID NO: 6622 - RNA, 4113 nt, Artificial Sequence
  Cas9 variant
augaacaagcccuacucaaucggccuagacaucggcaccaacucagugggauggucuaucaucaccgacgauuacaaagugcccgccaagaaaaugagaguacucggcaacacagauaaagaauacauaaagaaaaaccuuauaggcgcacugcuauucgacggaggcaacacugcugccgaccgacgccugaaacguaccgcacgaagacgcuacacaagacggcguaaccgcaucuuauaccuccaagaaaucuucgcagaggaaaugagcaaaguggacgacagcuuuuuccacagacucgaagacagcuuccuggucgaagaggacaaacgagguuccaaauacccaauauucgcaacuaugcaagaagaaaaauacuaccacgaaaaguuccccacgauauaucaucucagaaaggagcuagcggacaaaaaggagaaggcagaccuccgacucaucuaccucgcauuagcacauaucaucaaguuccggggccacuuccucaucgaggaugaccgcuucgacguucggaacaccgacauacaaaaacaauaccaggccuuucuggaaauauucgacacaaccuucgaaaacaacgaccuccuuucccaaaacgucgacgucgaggccauccucacggacaaaauaagcaagucggccaagaaagaccgcauccuagcccgauacccaaaccagaaaagcaccggcauauucgccgaauuucuuaagcucaucgucggcaaccaagcggacuucaaaaagcacuuuaaccucgaggauaaaacaccccuacaauucgcgaaggacagcuacgacgaagaccuagaaaaccuccuggggcaaauaggggaugaguucgcagaccuguucucugccgccaagaaacucuacgacucaguacuacucuccggaaucuuaaccguaacugaccuuucaacaaaagcaccccucucagccuccaugauccagcacuacgacgagcaucgagaagaccucaaacaacuuaaacaguucguaaaagccucccugcccgaaaaauaccaagaaauauucgcagacuccucuaaagauggcuacgcaggauacauagaggguaaaacaaaccaagaagcauucuacaaauaccucuccaagcuacucacaaagcaagaggggagcgaguaccuacuugagaaaaucaaaaacgaagacuuccugcgaaagcaaaggacguucgacaacggcagcaucccccaccaaguccaccuuaccgaacuuagagcaaucauccgacggcagagcgaauacuacccauuccuaaaagaaaaccucgaccggauagagaaaaucuuaacauuccgaauacccuacuacguaggaccccuagcccgggaaaaaucagacuuugccuggaugacgcgcaaaacagacgacucaauccgcccguggaacuucgaagaccuaguagacaaggaaaaaucggcggaagcguucauccaucggaugaccaacaacgaccuauaccuaccagaagaaaaaguccuaccgaagcacagccuuauauacgaaaaauucaccguauacaacgaacuaaccaaaguacguuuccucgcugagggauucaaagacuuccaguuccucaaucgcaaacagaaggaaacgaucuucaacucccuauucaaggaaaagaggaaggucaccgaaaaagacaucaucaguuucuuaaauaagguugacggcuaugaaggcauagcaauuaaaggcaucgagaagcaguucaaugccucccuauccacauaccacgaccuaaagaaaauacugggaaaagacuuccuugacaacacggacaacgaacucauccuggaagacauugugcaaacacuaacacuauucgaagaccgcgaaaugauccgcaaaaggcuugacaucuacaaagacuucuucacugaaucccagcucaagaaacucuaccgccgccauuacacaggauggggccgacucucagcaaaacucaucaaugggauucgcaacaaagaaaaccagaaaacaauccuugacuaucuuauagacgacggaucagcgaaccgcaacuucaugcaguuaaucaaagacgcuggacuguccuucaagcccaucaucgauaaggcccgaacuggaucccauagcgauaaucucaaggaggucgucggggaacucgccggcagcccagcuauaaagaagggcauccuacagagucucaaaauugucgacgagcuaguaaagguaaugggcuaugaaccggaacaaauaguaguagaaauggcccgggagaaccaaaccacugcgaagggauuaucccggucccggcagcgccuaaccacuuuacgcgagucccuagccaaccucaagagcaacauacucgaagaaaagaagccaaaauauguaaaagaucaggucgaaaaccaccaccucuccgaugaucggcuuuuccucuacuaccuccagaacggcaaagacauguacaccgacgacgagcucgacaucgacaaccucucccaauaugacaucgaccacaucaucccccaggcguucauaaaagacgacucaaucgacaauaggguccuaguuuccagcgcgaaaaaccgaggcaaaucagacgacguuccaucagucgaaauagucaaagacugcaaggucuucuggaagaaacuacucgacgcaaaacugaugucccaacguaaauacgacaaccuuacaaaagccgaacgcgguggacuuacgagcgacgauaaagcacgauucauccaacgccagcuagucgaaacgaggcaaaucacaaaacacguagcgcggaucuuagacgaaagguucaauaacgaauuggacagcaagggccgcagaauacggaaggugaagaucgucacccucaaauccaaccucgucuccaacuuccggaaggaguucgguuucuacaagaucagggaagugaacaacuaccaucacgcccacgacgccuaccucaacgcugucgucgccaaggcgauacuaaccaaauacccccaacuggagccagaguucguguacggcgacuacccuaaguacaacucauacaagacacggaaaucugcaaccgaaaaacuauucuucuauucgaauaucaugaacuucuucaagacuaaggucacccucgccgacggaacugucguagucaaggacgacaucgaagugaacaacgacaccggagaaauaguuugggacaagaagaaacauuucgcaaccguccgcaaagugcuauccuacccucaagucaacauagugaagaaaacugaaauccaaacagguggcuucuccaaagaaucaauccucgcccacggcaacucggacaaacucaucccuagaaaaaccaaagacauuuaucuugacccuaagaaauacggaggauucgacagcccgauuguagccuacuccguccucgucguugccgacaucaagaaaggcaaagcacaaaaacucaaaaccgugacagaacuccucggcauaaccauaauggagcggucacgcuucgagaaaaacccaagugcuuuccuugaaagcaagggcuaccugaauauccgcgacgacaagcucaugauucuccccaaauacucucuuuucgaacuagaaaacggcagacgacgguuauuagcaucugccggcgaacuucaaaaaggaaacgaauuagcccucccuacacaauuuaugaaguuucuauaccuagcgucucgcuacaacgagcucaaaggaaaaccugaagaaauagaacaaaagcaagaguucgucguacagcacgucucuuacuucgacgacauccuccaaaucauaaacgauuuuucuaaccgugucauccucgccgacgccaauuuagagaaaauuaauaagcucuaccaagacaacaaagaaaauaucccuguagacgagcuagccaacaauauaaucaaccuguucacauucacuagccucggcgccccugcagcauuuaaguuuuucgacaagaucguggaccggaaacgcuauacaucaacaaaggaggucuugaauagcacacucauacaccagucuaucacaggccuauacgagacccggauagaucucggcaaacugggcgaagacuga

SEQ ID NO: 6623 - RNA, 4116 nt, Artificial Sequence
  Cas9 variant
augaagguaaacaacuaccacaucggccuugauauaggaaccucaucgaucggcuggguagcaaucggcgaggacgggaaaccccuucgaauaaagggcaaaacugccauaggcgcgcgacuauuccaagaaggcaaccccgccgccgacaggcgcauguuccggacgacaaggcgccgccuaagccggcguaaauggcgacuaaagcugcucgaagaaaucuucgacccauacaucacccccguggacucuaccuucuucgccaggcucaaacagagcaaucuguccccuaaggauagcagaaaggaguucaaaggcagcaugcuguucccagaccucacagacaugcaguaccauaaagacuacccgacaaucuaccaucuuagacacgcgcucaugacgcaggacgaaaaauucgacauacgcaugguauaccuugccauucaccacauagucaaauacagagggaauuucuuaaacuccacaccagucgacagcuucaaggccucuaaggucaacuuuguggaccaauucaaaaagcucaacgaacuauacacggcaauaaaccccgaggagagcuuccagauaaaucucgcuaacagcgaagacaucggccaccaauuccucgaucccuccauccgcaaauuugacaagaagaaacaaauaccuaaaaucguacccgucucugucgacgacaaagccacagacaaaauaaacggaaaaauugcaagcgaaauaaucaacgcaauccugggauacaaaagcaaacucgacguagucguccagugcacucccguagacuccaaaagcugggcgcucaaauucgacgaagaagacauagaugcaaaacuccagaaaauccuccccgaaauggacgagaaccaacaauccaucaucgcuauucuccaaaaccucuauucccaagugacccucaaucaaauuguacccaacggcaugucacuguccgaguccaugaucgaaaaauacaacgaccaccacgaccaccuaaagcucuacaagaaaauaauagaccaacuagccgacccgaaaaagaaagccgcccuaaagaaagccuauagccaauacgucggagaugacggaaaaguaaucgagcaagcagauuuuugguccagcgucaaaaagaaucuugacgacagcgaccucuccaaacagaucauggacuuaaucgacgccgagaaauucaugccaaagcagcgcaccagccaaaacggugugaucccacaccaacuccaccaacgcgagcucgacgaaaucauugaacaccaaagcaaauacuacccguggcucgcggaaauaaaccccaauaagcacgaccugcaucucgccaaguauaaaauagaggagcuaguugcuuuccgcguaccauacuacguuggucccaugaucacccccgacgaccaagccaaauccgcggaaacaguuuucaguuggauggaacgcaaagguaaagaagccggccaaaucaccccguggaacuuugacgaaaaaguggaucgcaaugcgucggccaaccguuucauaaaaagaaugaccaccaaagacacuuaccuaaucggggaggacguacugcccgacgagucccuccuauacgaaaaauucaaaguacucaacgaacuaaacaugguacgcguaaacggcaaacuccuuaaagucgccgacaaacaggccauauuucaagaccuauuugaaaacuacaaacacaucagugucaagaaacuccaaaacuacauaaaaagcaaaacagggcuaccgagcgacccggagaucucgggacuaagcgauccagaauacuucaacaacucccuuggcacguacaaugacuucaagaaacucuucgguaacaaagucgacgaacccgaccuacaggaugauuucgagaaaauaguugaauggagcacaguguuugaggacaaaaggauacuccgcgagaaacuaaacgaaaucaccuggcucuccgaccaacagaaagacguccucgaguccagccguuaccagggcuggggccgccucuccaagaaacuccucaccggaaucguaaacgaccagggagaacgcaucauagacgaacucuggaauacaaacaaaaacuucaugcaaauccaguccgacaacgacuucgccaaacguauacacgaagcaaacgccgaccaaaugaaagcaguugauguagaagacgucuuggccgacgcauacacaucaccccaaaacaagaaagccaucagacaggucguuaaagucguagacgacauccaaaaagccaugggaggcgucgcaccaaaauacaucuccauagaguucacucgcucugaagaccgcaauccucgcaggaccaucagccgacagcgacaacuagaaaacacccucaaggauacugccaaaucccucgccaaaagcaucaaccccgaacuacucagcgagcucgauaacgccgccaaaucaaagaagggauuaacggaccgacucuaccucuauuucacacagcuuggaaaagauaucuacacuggcaagccuaucaacauagacgaaaucagcacauacgacaucgaccacauacuaccacaagcguucguaaaggaugacagccucaacaaucgcguccucgucagcaaggccauaaacaacgguaaaagcgauaacguccccguccaacucuucggcgcuaaaaugggacacuucuggaaacaguuggcggaagccggacugauaaguaaacgcaaauugaaaaacuuacagacggaccccgacaccaucuccaaauacgcaaugcacggcuuuauaaggaggcaacucguagaaacgucccaagucauaaaacuggucgccaacauacuaggggacaaauaccgaaacgacaacacgaagauuauagaaauaacugcacgaaugaaucaccagaugcgugacgaguucggauucauuaaaaacagggaaauaaacgacuaccaccacgcauucgacgccuaccuaaccgcguuccuaggccgauaccuauaccacagguauaucaaacuacggcccuacuucgucuacggcgacuucaaaaaguucaaggaagacaaagugacgaugaggaacuucaauuuccuacacgaucuuaccgacgauacgcaagagaaaauugccgacgccgaaaccggugaaguaauaugggaccgcgaaaacagcauacaacaacuaaaggacguauaccacuacaaauucaugcucaucucacacgaagucuacacgcuaagaggcgccauguucaaccaaacugucuacccagcuagcgacgcgggcaaacgcaaacuaauucccaucaaggcggaccgccccauaaacgucuacggcggcuacuccggcucugcggacgcauacauggcaaucguucgcauccacaacaagaaaggcgauaaauaccggguagucggcgucccaaugcgggcccgagaucgucuagaugcggcaaagaaggucucagacgcagacugcgaccgcgcucugaaggauguccuaacaccgcagcucaccaagaccaagaagucccgcaaaacuggggaaauuacccaagugguugaagacuucgaaaucguccugggaaaagucauguaccggcaacucaugaucgacggugacaaaaaguucaugcucgggucgagcaccuaccaauacaacgccaagcaacucguccucagugaucaaucggucaagacccuagcaucaaagggccgccuagacccacuacaagaaagcauggacuauaacaauguauacacagaaaucuuagacaaggucaaccaauacuucagccuauacgacaugaacaaauuuagacauaaguuaaaccucggauuuagcaaguucaucucuuuucccaaucacaaugucuucgacgggaacacaaaagccuccuccggaaaacgagagauccucgaagaaguccuaaacggccuccacgcuaaccccaccuuuggcaaucucaaagacauaggcauaacgaccccauucggacaacugcagcaacccaacggcauacuccucagugaugaggccaaaauccgcuaccagucuccaaccggucucuucgaaagaaccgucagccucaaggaccuguga

SEQ ID NO: 6624 - RNA, 4116 nt, Artificial Sequence
  Cas9 variant
auggacaagaaauacucaaucggucucgacaucggcacaaauagcgucggaugggccgucaucaccgaugacuacaaaguuccaagcaagaaauucaagguccucggcaacaccgacaggcacagcauaaagaaaaaccuuauuggggccuuauuguucgacuccggugaaacagcugaggccacgcgccuuaaacgcacagcucgcaggcgguacacgcgcaggaaaaaccgcauacgcuacuuacaggagauuuucagcucggagaugagcaaaguagaugacagcuucuuucacaggcucgaagaauccuuccucgucgaagaggacaagaagcacgaacgacaccccaucuuuggaaacauagucgacgagguggccuaucacgaaaaguaucccacgauauaccaucugcgaaagaagcuagcggacucaacggacaaagcggaccuacgucuaaucuaccuagcccuggcccacaugauaaaguuccgcggacacuuccuuauagaaggcgaccuuaauccggacaacagcgacauggacaaguuauucauucagcugguccaaacguacaaccaacucuucgaggaaaauccgauaaacgccagccgcguggacgccaaagccauacucagcgcccgcuuaagcaaaagccggcgccuagaaaaccucauagcgcagcuaccaggagaaaagagaaacggucucuuuggcaaccucaucgcacugucacuugggcuaaccccgaacuucaaguccaacuucgaccuagcagaagacgcgaaacuacagcucucuaaagauacuuacgacgacgaccucgacaaccuacuagcccaaaucggugaccaauacgccgaccucuuccucgcugcgaaaaaccuaagcgacgcaauccuacucagugacauacuccgugucaacucugaaauaacgaaagcaccccuauccgcaucgaugauaaagagauacgacgagcaccaccaggaccucacauugcucaaagcgcuaguacgacaacaacugccggagaaauacaaggaaauauucuucgaccaauccaaaaauggauacgccggcuacaucgacggaggggcgagccaagaagaguucuacaaguuuaucaaaccuauccuagaaaagauggacgggacagaagaguugcucgccaaacugaaccgggaggaccuacuacgcaaacaacgcaccuucgauaauggcaguauaccacaccaaauacaccucggcgagcuccacgcaauccugcggcggcaagaggacuucuaccccuuccugaaagacaaucgcgagaaaaucgaaaagauccucacauuccgcauaccguauuauguugggccgcucgcaagaggcaauucccgauucgccuggaugacacgaaagucagaagaaaccaucacuccguggaauuuugaggaggucguagacaaaggggcgucagcacagagcuucauagaacgaaugaccaacuuugacaaaaaccuacccaacgaaaaaguccugcccaagcacagucuucuguacgaauacuucacgguauacaacgagcugacaaaaguaaaguacgucaccgaaggcaugcgaaaacccgaguuccuaucagggaagcagaaagaagcgauuguggaccuccuguucaagaccaaccggaaagucaccgugaaacagcuaaaggaagacuacuuuaagaagauagaaugcuucgauuccguagaaaucucaggcgucgaagaucguuucaaugcaagccucggcacauaccacgaccuacuaaaaaucaucaaggacaaggacuuccuggauaaugaagaaaacgaggacauucuagaggacauaguccuaacacuaacauuauucgaagacaaagagaugauagaagaacgacugaagaaauacgccaaccuguucgacgacaaaguaaugaaacaacuuaaaagacgccacuacacagguuggggccgccuaucacguaaacugaucaauggcauacgugauaaacagucgggcaaaaccauacuagacuuccugaaaucagacgguuucgcgaaccggaacuucaugcaacucauaaacgacgacagccugaccuucaaggaagccauacagaaagcacaagucagcggacaagggcacagucuacacgagcaaauugccaacuuggcgggauccccggcgaucaagaaagggauacuccaauccguaaaaguugucgacgagcuagucaaagucaugggccacaaaccagaaaacaucguaauagaaauggcgcgggaaaaccaaacaacccaaaaaggccagaaaaacucccgugaacggaugaaacgaaucgaagaagggaucaaagaacucggcucccaaauacuaaaggaacacccggucgaaaacacacaacuccaaaacgaaaaacucuaccucuacuaccuccaaaacgggcgcgacauguaugucgaccaagaguuggacauaaaccgccucucagacuacgaugucgaccacaucguuccccagucguucaucaaagacgacagcauagacaacaagguacucaccagaagcgacaaaaaucgaggaaaauccgacaacgucccaucggaagagguagugaagaaaaugaaaaacuacuggcgccagcuccuaaacgcgaaauuaaucacccagcggaaauucgacaaccugaccaaagccgaaagagguggucuaagcgaacuagacaaagccggcuucaucaaaagacagcuugucgagacacgccaaaucacaaaacacgucgcacaaauacuagacagccgaaugaacaccaaguacgacgaaaacgacaaacucauccgcgaagucaaagucaucacccucaaaucaaaacuuguaagcgauuucagaaaagacuuucaauucuauaaggucagggaaauaaacaacuaucaccacgcgcacgacgcauaccucaacgcagugguuggaacggcgcuuauuaagaaauacccaaaacuggaaagcgaguucguguauggagacuacaagguuuacgacguaagaaagaugaucgccaaaucggaacaggaaauaggcaaagccaccgccaaacgcuucuucuacagcaacaucaugaacuucuucaagacggaaaucacccucgcaaacggggaaauccguaaacgcccccugaucgaaacgaacgaagaaaccggcgagaucguaugggacaaaggccgggauuucgcaaccgucagaaaaguccuauccaugccucaagugaacauagucaagaaaacagaaguucagaccggcgccuuaacaaacgaaucgauauaugcacgcggcucguucgacaaacuaaucucacgaaaacaccgauucgaguccucaaaguacggaggauucgggucccccacggucacauacagcguauuaguaguggcaaaaucuaaaguacaggacggaaaggucaaaaagauuaaaacaggaaaagaacucauugggaucacacuccucgacaaacuuguauucgaaaagaacccccuaaaauucaucgaagacaaaggcuacggaaacguucaaaucgacaaaugcaucaagcuaccaaaauauucucucuucgaguucgaaaacggaacuagacgaaugcucgccuccgucauggccaacaacaacucccgcggcgaccuccaaaaagccaacgaaauguuccucccggccaaacucgucacccucuuauaccacgcccacaagauagaaaguuccaaagaacuugaacaugaagcauacauuuuggaccacuauaacgaucucuaccaacugcucagcuacauagaaagauucgcaagccucuacgucgauguagagaaaaacaucagcaaagucaaagagcucuuuagcaacauugaauccuacucaauaagugaaaucugcagcucuguaaucaaccugcucacacuaaccgcuucgggcgcccccgccgacuucaaguuccucggaaccaccauacccagaaagagauacggcagcccccaaucaauccuaagcucaacgcucauucaccaguccaucacaggacucuacgagacccgaauagaccugagccaacugggcggcgacuga

SEQ ID NO: 6625 - RNA, 4116 nt, Artificial Sequence
  Cas9 variant
auggacaaaaaguacuccauaggacuagacauaggcacaaacucuguaggaugggcgguaaucaccgacgauuauaagguaccauccaagaaguucaaaguccucggcaacacagaccgacacuccauaaagaaaaaccucauaggcgcccuucuguucgacuccggcgaaacagccgaagccacacgacuaaaacgcacggcucgccgccgcuacacccggcggaaaaaucgaaucagguaccugcaggaaauauucagcuccgaaaugagcaaaguggacgauucauucuuccacagacucgaagaauccuuccuugucgaggaagacaagaaacacgagcggcaccccauuuucggaaacauaguggaugagguagccuaccacgagaaauacccaacgauauaucaccuucgaaagaaacuugcagacucaaccgacaaagcugaccugcgacuaaucuaccucgcccuugcucacaugaucaaauuccgcggccacuucuugaucgaaggcgaccucaaccccgauaacucagacauggacaaacuauucauccagcuaguacagacauacaaccaacucuucgaggaaaaccccauuaaugccucacgaguagacgccaaggcgauccuaucggcaaggcugucuaagagccgacgccucgaaaauuuaauugcccagcuuccgggugagaaaagaaacggacuauucgggaaccuaauagcccugucucuaggccuaacacccaacuucaagucaaauuucgaccuggccgaggacgcaaagcuccaacugagcaaagacacauacgacgacgaucucgauaacuugcucgcacaaaucggagaccaauaugcagaccucuuucuugcagcaaagaaccuauccgacgccauccuacugucagacauccugcgggucaacuccgaaauuaccaaagcaccacuguccgcgucaaugaucaagcgcuacgacgagcaccaccaagaccucacccuccucaaagcacucguccgccaacaacugccagaaaaauacaaggaaaucuucuucgaccaaucgaaaaacggauacgcuggcuacaucgacggcggugccucgcaagaagaauuuuacaaguucauaaaacccaucuuagagaaaauggacggcacggaagaguuacucgcaaagcucaaccgagaggaccuccuccgcaagcaacggaccuuugacaacggaagcaucccgcaccagauccaccuaggcgaacuacacgcaauacucagacgccaagaggacuuuuacccuuuccuaaaggacaaccgcgaaaagaucgagaaaauacuaacguuccgcauucccuacuacgugggcccccuagcgcgcggcaacagccgguucgcguggaugacccgaaaaucggaagaaacaauaacccccuggaacuuugaagaagugguagacaaaggcgccagcgcccagucauucaucgaacgcaugaccaacuucgauaaaaaucuccccaacgagaaaguccucccaaaacacagccuacucuaugaauacuucaccgucuacaacgaacucacgaaggucaaauacgucaccgaaggcaugcgcaaaccggaguuccucagcgggaaacaaaaagaggccaucgucgaccuucuguuuaaaacaaaccgcaagguaacugucaaacaacuaaaggaggacuauuucaaaaagauugagugcuucgacagcgucgagaucucaggaguagaagauagauuuaacgccucacucgggacguaccacgaccuauuaaaaaucauaaaagacaaggacuuccucgacaacgaggagaacgaggacauacucgaggacauaguucucacacuaacauuauuugaggacaaggagaugauugaagagaggcucaagacguacgcccaccucuucgacgauaaagucaugaagcagcugaaacgccgacacuauacgggaugggggagauuaagccgcaaacuuauaaacgggaucagagauaagcaguccggcaagacgauccucgacuucuuaaaauccgauggcuucgcgaaccgcaacuucauacaacuaauccacgaugacagucucacauucaaggaggccauccagaaagcucaaguaagcggccaagggcacucccuccacgagcagauugcuaaucucgcaggcagcccggcaaucaagaaaggcauccuacagagcgucaagguggucgacgaacuggugaaggucaugggacacaaaccugaaaacauagucauugaaauggcccgggaaaaccaaaccacucaaaaaggacagaagaauagccgcgaacgaaugaagagaauagaagaaggcaucaaggaacugggcucccaaauacucaaagagcaccccguagaaaacacccaacuacagaaugagaagcucuaccucuauuaucuacagaacggcagggacauguacguagaccaagaacuugacauaaaccggcuaucggacuacgacguugaccacauaguuccgcaaucguucauaaaagacgacagcaucgauaacaaaguccucacaagauccgacaaaaacagaggaaaauccgaugaugucccaagugaagaagucgucaaaaagaugaaaaacuauuggcggcaacuccucaaugccaaacuaaucacacagcgcaaauucgacaacuuaaccaaagccgagcgcggcgggcugucagaacuagacaaggccggguucaucaaaaggcaacucguagaaacccgucaaauaaccaagcacguagcacaaauccucgacucacggaugaacacgaaauacgacgaaaacgacaaacuuauccgagaagucaaaguaaucacacucaaaucaaaacucgucucggacuucaggaaggauuuccaguucuacaagguccgagagaucaacaacuaccaccacgcccacgaugccuaccuaaacgcaguaguaggcaccgcgcuaaucaaaaaguacccaaaacucgagagcgaguucguuuacggcgacuacaaggucuacgacgucagaaaaaugauagcgaagucggaacaagaaaucgggaaggcaacagccaaacguuucuucuauucaaacauaaugaacuucuucaagacggaaauaacccucgcaaacggcgaaauacgcaaacgaccauugaucgaaaccaacgaggaaaccggugaaauagucuggaacaaagggagagacuucgccaccgucagaaaaguuuuauccaugccccagguaaacaucgucaagaaaaccgagguccaaacgggcgcccucaccaacgaaucaauauaugcuaggggcucauucgacaaacucauaagcagaaaacaccgauucgaauccagcaaauacggaggcuucggaucaccaaccgucacauacucaguccuagugguugccaagucaaaaguccaggacggcaaaguuaagaagauaaaaacuggaaaagaacuuaucggcaucacucuccucgacaagcuagucuuugagaaaaacccccucaaauuuaucgaagacaaaggauacggcaacguccaaauagacaaaugcaucaaacugccuaaauacucguuguucgaauuugaaaacggaacacgacguaugcuggcguccguaauggccaacaacaacagccgaggcgaccuacaaaaagcaaaugaaauguuccuuccagcaaaacucgugacacuccuuuaccacgcccacaaaauagaaucaucgaaagaauuagagcacgaagcguacauccucgaccacuacaaugaccucuaccaacugcuaucguacaucgaacgcuucgcaagccucuacguagauguugagaaaaacaucucaaaagucaaagaacuauucucgaacaucgaaagcuacagcaucuccgaaauaugcucaagcgucauaaaucuucuuaccuuaacggccaguggcgcuccugcggacuucaaguuccucggaaccacaauaccgagaaaacgauacgggaguccccaaaguauccuguccucaacacuaauccaccaauccauaacgggccucuacgaaacacguaucgaccucagccaacugggaggcgacuga

SEQ ID NO: 6626 - RNA, 4116 nt, Artificial Sequence
  Cas9 variant
augaacaacaacaacuauucaaucggccuagacauuggaacuaacagcguuggaugggccguuaucacagacgacuacaagguaccaucuaagaaaaugagaguccucggcaacacagauaagagguucaucaagaaaaaccugaucggcgcauuacuauuugacgaaggcacgaccgccgaggaccgacgccuuaaacggacggcacggcgccgcuacacgcggagaaagaaccgacuacgcuaccuccaagagauauuugcagaggagauguccaaaguagacuccucguucuuucaccgacuagacgacuccuuccucguacccgaagacaaaagcggaucgaaauacccaauauuugccacccucgcugaagagaaagaguaccacaagaaauucccgacaaucuaccaucuccgcaaacaccuggccgacucaaaagagaaagcagaccuaaggcucaucuaucucgcacuagcgcacauaacaaaauaccgcggucacuuucuauacgaagaggccuucgacaucaaaaauaaugacauacagaaaauauuuaacgaguucauaaacauuuacgauaacaccuucgagggcagcucgcugucuggacaaaacgcccaagucgaggcaaucuucacagggaaaauaucaaaguccgugaaacgugagcacgucuuaaaacuauuccccgaugaaaagagcacaggacuauuuuccgaguuccucaaacugauuguuggcaaucaagccgacuucaaaaagcacuucgaccucgaagaaaaggcuuccuuacaauucucgaaagacacguacgacgaggaccuggaaaaccuccucggacaaaucggagaugacuucgccgaucucuuccucguagccaagaagcucuacgacgcgauccuacuuagcggaauccuaaccguaaccgaccccaguacaaaagcaccccucagugcgagcaugauagaacgcuaugagaaccaucaagaggaccuggcagcccucaaacaauucaucaaaaacaaccuacccgaaaaguacgcggaaguuuucagugaccaguccaaagacggauaugcuggcuacauagaugguaaaaccacccaggaagccuucuacaaguacaucaagaaccuccucucaaaauucgaaggcgcagacuacuuccucgauaaaauagaaagggaggauuuccucagaaagcagagaaccuucgacaacgguuccauuccgcaccagauccaccuccaagaaaugaacgcaauacugcgacgccaaggcgagcacuacccccuccuaaaggaaaacaaagaaaagauagagaaaauucuaacauuccgaauaccauacuaugugggcccccuagcccgugguaaccgagacuucgcaugguugacgcgcaacucggaccaagcgauccgacccuggaauuucgaagaaauaguagacaaagcgaguucugcggaauccuucauaaacaaaaugaccaacuacgaccuguaucucccugaggaaaaaguccuaccaaaacacucucuacuuuacgaaacguuugcaguguacaacgaacugacgaaagugaaauucauugccgagggacugcgcgacuaccaauucuuugacucuggucagaaaaagcaaaucgucaaucaacuauucaaagaaaaacguaaagucacggagaaagacauuauacacuaccuccacaacgucgacgguuacgacggcauagaacuaaagggcaucgagaaacaguucaaugcaagccucaguacauaccacgaccuacugaaaaucaucaaggacaaggaguucauggauaaccacaaaaaccaagaaauccuggagaacauaguccacacccuaacgaucuuugaagaccgggagaugaucaagcaacggcuagcacaauacgacucaaucuucgacgaaaaaguaaucaaagccuuaacccgacggcacuacaccggcuggggcaaacuauccgccaaacucaucaacggcaucugcgacaagaaaaccggcaaaacuauacucgacuaucuaauagaugauggguacaacaacagaaauuucaugcaguugauaaacgacgacggacucucguucaaagaaaucauccagaaagcacaaguagucggcaagaccgacgaccugacacaggugguacgggagcuguccggaagucccgcaaucaaaaagggcauccuccaguccaucaaaauaguagacgagcuaguaaagaucaugggcuacgcuccagaguccauugucaucgaaauggcccgggaaaaccaaaccaccgcaaaagguaagaaaaacucacagcagcguuacaagcgcaucgaggacgcccucaagaaccuagccccgggacuagacuccaccaucuccaaagagaaucccaccgacaacauacagcuccaaaacgacagacuuuuccucuacuaucugcaaaacggcaaagauauguacaccggcgaggcgcucgacauaaaccaacuuucaagcuacgauaucgaccacauaauaccacaagccuucauaaaggacgauagccucgauaaucgaguccuuaccaguagcaaagacaaccgcggaaaauccgacaacgugccaagucucgaaguagucaagaagcguaaagccuucuggcaacaacuccucgacagcaagcucaucagcgagaggaaguucaacaaccuaaccaaagcggagcgcggcggccucgacgaacgagacaaggucggguucaucaagagacaacucguagaaacccgacaaaucaccaagcauguagcacgcauacucgacgcacgauucaauacggaagucagcgagaaaaaccaaaagauucguagcgucaaaaucauuacccucaagaguaacuuaguguccaauuuccgaaaggaguucaaacuguacaagguccgagaaauuaacgacuaccaccacgcccaugaugcguaccucaaugcaguagucgcaaaagccauccucaagaaauacccuaaacuagaacccgaguucguauacggggacuaccagaaauacgaccucaaacgauacauaucaaaaucaaaagacccaaaagaaguugaaaaagccaccgaaaaauauuucuucuacagcaaccuacucaacuuuuucaaagaagaaguccacuacgcagacgguacaaucguaaaacgggaaaauaucgaauacucaaaagacaccggcgaaaucgccuggaacaaagaaaaggacuucgugacaauaaagaaaguucugucguacccacaagucaacaucgucaagaaaagagaaguccaaaccggaggauucagcaaagagucgauccugcccaaaggcaacagcgauaaacucaucccccgcaagaccaaagacauacucugggauacgaccaaguauggaggguucgacuccccaguaauagcauacuccauccugcucauagccgacaucgagaaaggaaaagcaaagaaacucaagacugucaaaacccuuguuggaauaaccauaauggaaaaagcagcauucgagaaaaacccaauaacauuccuggaaaacaagggguaccauaacgucagaaaagaaaacauuuuaugccucccaaaauauucacuauucgagcuagaaaacggcagacgucgccuucuggcaucggccaaagaacuacagaaagggaaugaaaucguccuccccgucuaccugaccacucuauuguaccacagcaaaaacguccauaaauuagaugaaccagaacaccuugaauacauccaaaagcacagauacgaauuuaaggacuugcucaaccugguauccgaguucucgcaaaaauauguacuagcugaagccaaccucgagaaaauaaagagccuuuaugucgacaacgaacaggcagacaucgaaauccucgcaaacuccuucauaaaccuacucaccuuuaccgcauuaggagcacccgcggccuuuaaauucuucggcaaggacgucgaccgcaaacguuacaccaccguuuccgaaauccucaacgccacacuaauccaccagagcauaacaggucucuacgaaacccgcaucgaccuaagcaagcuaggcgaggacuga

SEQ ID NO: 6627 - RNA, 4116 nt, Artificial Sequence
  Cas9 variant
augacggagaaaaacuacagcauaggacucgacaucggaaccaauagcguaggaugggcugucauaaccgacgacuacaaaguccccgccaagaaaaugaaagugcuagggaacacagacaaaaaguacaucaaaaagaaccuauuaggcgcccuccuauucgauaauggcgaaaccgccgaagccacgcgccuaaaacggacggcccgccgacguuauacaagacgcaaaaaccgacugcguuaccuccaagaaauauucgcagaggaaauggccaaggucgacgaaucauucuucuaccgccuggacgaguccuuccucacaaccgacgacaaggauuucgagagacaccccauuuucggaaacaaggccgacgaaaucaaauaccaccaagaguuccccacgaucuaucauuuacgcaaacaccucgcagacagccacgaaaaagcagaccuccgccucaucuaccuagcucucgcacacaugauaaaguuccggggccacuucuuaaucgagggagagcugaacgccgaaaauacggacguccaaaaacucuucgaagccuuugucgagguauacgaucgcacguuugacgacaguaaccuaagugagaucacggucgacgccagcucaauacugacagaaaaguucuccaaaucacgccgccuugagaaccugauaaagcacuacccuacagagaaaaagaacaccuuguucggaaaccuaguagcacucgcacugggccuccaacccaacuucaaaacgagcuuuaaacuuagcgaagaugcuaaacuccaauucuccaaagacacauacgaagaggaccuggaggaacucaucggcaaaaucggcgacgaauacgccgaccuauucaccagcgcgaaaaaucuauaugacgccaucuuacuuuccggaaucuuaaccguggccgacaacaccacaaaagcaccucuauccgccagcaugaucaagagguacaacgaacaucaggucgacuugaaaaaguuaaaagaguucaucaaaaacaacgcuagcgacaaauacgaugaaauauuuaacgacaaagacaaaaacgguuacgcaggcuacauagaaaacggcgucaagcaagaugaguucuacaaauaucugaagacgaccuuauccaaaaucgacgguuccgacuacuuccucgauaaaauagaacgagaagacuuccuccgcaagcagcgcacauucgacaacgguuccaucccccaccagauucaccuccaggaaaugcacgcaaucuugcgcaggcaaggcgaacacuacgccuuccucaaggaaaaccaagcgaagauagagaaaauccuaacauucagaaucccguacuacgucggcccacucgccaggaaaaacagccgcuucgcaugggcggaauaccacagcgacgagaaaaucaccccauggaauuucgacgaaaucauugacaaagagaaaagcgccgaaaaauucauaacccggaugacccuaaaugaccuauaccugcccgaagaaaagguccucccaaagcauagccuaguguacgaaaccuacacggucuacaacgagcuaaccaagguaaaauacguaaaugaacagggaaaaucaaacuucuuugaugccaacaugaaacaagagaucuuugagcacgucuuuaaggaaaaccgaaaggugaccaaggacaaguuccucaacuaccugaacaaggaguuccccgaauaccggauacaggaucucaucggccuggacaaggaaaacaaaucauuuaacgccagccuuggcacauaccacgaccucaagaaaauccucgacaagagcuuucucgacgacaaaaccaacgaaaccauaauugaggacaucauccaaacccucacccucuucgaggaccgcgauaugauucgccaacgccuacaaaaauacuccgacaucuucacgccacagcaacucaagaaacuagaacgacgacacuacaccggguggggccggcugucguauaaacuaaucaacggaauacggaacaaagaaaacggaaaaagcauccuggacuaucucaucgacgacggcuacgcaaaccgcaacuuuaugcaacugaucagcgacgacacccuaccuuuuaaacaaaucauaaaagaugcgcaaauaauaggcgacaucgacgacgugaccucggucguacgugaacuaccaggaagcccagccaucaagaaaggcauacuucaaaguguaaaaaucgucgaugagcucgucaaaguuaugggccauaaccccgacaacaucguuaucgagauggcgcgagaaaaucaaaccacaaaccgaggacgcaaccaaagccagcaaaggcucaaaaagcuacaagacagucucaaggaacugggcagcaacauccugaacgaagagaagccaagcuacauagagggaaaaguggagaacaaccaccuacaagacgaccggcuuuuccuauacuacauccaaaacggcaaagacauguauacaggcgacgaacucgacauagaccaccuguccgacuacgauaucgaccacaucauaccgcaggcauucauaaaagacgacucuaucgacaaccgggugcuaacguccucagccaaaaaccgcggaaaaucagacgaugugcccagucuagacauaguccaugaccgaaaagcagauuggauacgacuguacaagucggggcugauaagcaaacgaaaauucgacaaccuaacaaaagcagaaagaggaggccugaccgaaaacgacaaggccggauuuaucaaacgacaacucguagagacucgacagaucaccaagcacguagcccaaauacuagacagcagauucaacaccgagcgcgacgaaaacgacaaaguaauacgcaacgugaaagucauaacgcuaaagagcaaccucgugucccaauuucgcaaagacuucaaauucuacaaagucagagagauaaaugacuaccaucacgcgcacgacgccuaccuaaacgccguagucgguacggcccugcuuaagaaguaccccaaacuagccccagaguucgucuacggagaauacaaaaaguacgacauacgcaaauucaucacgagcuccggcgauaaagcaaccgccaaguacuucuucuacuccaaucucaugaauuucuucaaacgcgugauaagauacagcaacggcaaggucgucguaagaccugucaucgagugcucuaaagacacuggcgaaaucgccuggaacaagcagaccgacuucgaaaagguacguagaguacucagcuauccccaggucaacauagugaagaaaguagagacccagaccggaggauuuucgaaagagagcauccuacccaaaggcaacagcgacaaacuaauaccccgaaaaacaaagaaauuccgaugggacacaccaaaauacgggggauucgauucuccgaauauagcauacucaguauucguaaucgccgacguggaaaaagggaaagcgaaaaagcugaagacaguaaaggagcuaguaggcauaucgaucauggaacguagcuccuuugaagaaaacccggugguauuccucgaaaagaaaggauaucagaacguccaagaagauaaccuuauaaaacuccccaaguacagccuauuugaguucgaaggugggcgacgccgauuacuagccucugcaagcgaacuacaaaaaggaaacgaagugguccucucccggcaucucgucgagcuucuauaccaugcccaccgcguaaacucauuuaacaacucagaacaucucaaguacguuucagaacacaagaaagaguucggagaaguccuauccugcguggaaaacuucgccaaaucauacgucgacguagagaaaaaccucggcaaaauacgcgccgucgcagacaaaauugacaccuucagcaucgaagacauuucgauaucguucgucaaccuccuaacacuaaccgcacucggagcccccgccgacuucaacuuucuaggcgagaaaauaccgcgcaaaagauacacgagcacaaaagaaugccuuaaugccacccucauucaccaguccaucaccggacuauacgaaacgcggauagaccuaucaaagcuaggcgaagaauga

SEQ ID NO: 6628 - RNA, 4116 nt, Artificial Sequence
  Cas9 variant
augaacuuacgcaacguagaauccuaccaaguaggacuggacauagggacaggcaguguaggcugggcggugcuagacgacaacggggaccucugcagguucaaaggcaagccuacauggggaagccguguguucccuacagccgagacggcagcggaagcaagagugcacaggggacaacgacgacgcuacgaccgacgcagacagagaaucgaucugcuccagcgguucuucgcggaugaaguggccaaaguggacccagaguucuucauacggcucaaucaagccagacugcaccccgaaaaccgggacccagcccacgccgauuaccgcuggccgcuauucaacgggagcaacuucaccgaaaaagacuacuaccgccaauucccaacaaucuaccaccuccgagcacaccuacucaagagcgacgaaccggccgacauaaggcuagucuaccuggcguugcacaacauagucaagcaccgagggaacuuccugcaccaagacaacccauccuuaagcgcaaggaaugcuaacguaggcgacgccguagaagcacucugucuugcacuggacgaauggugcggcgcgcacgacguagaaugcgccugcgacgaagcagcucucgcagaagcacucggugacgccagccuccgaccaggugagaaaagggagcgggcggaagcagcacucggagucgaaaaagcccacaagaaacucgccaaagccguaucaucagcaguuguaggauacgcagcagaguuuggacacguguucuucgcagagagcgaaggaagcaaauucgcacuaagcaacgacgagaaaguagaagccuacgucuguccagacgaaggaagagaccucuuugacgcaaugagagcaguacauuccaguuacgugcugauggguauauuaagcgaagcacaaggcgaacuccucucaguaugcaaagucggcgaauacgaaagauauaaaagagaucuggagacgcucaaaagccucguccgcgcguaugggccagaaagauacgacgaguucuucugcggccccuucuacgaagguaccagagacuacgacccugggaaagcccagggguauacaaaauacaaucuaggggccagcaaacucagccacgaagacuuccucaaagaaguacagaaacuccuaaaagacauaggcgcccaggcagacgaacgauacgcggacaucgaacgagccauagaagcaggagcguuccuaagaaggcucaaaaccagcgauaacgggaccauaccguaccaacuacacuuggaggaaauggacgccauuauagagcggcaagcagccuucuaccccuuccuagcccaagaaaaagauaaacugaaaagccuagugagcuuucgcauacccuacuacguagggccacuaacacagaaaaacgcagcacgagacggaaaaggcgaagcgcgcuucgcguggucaucgagaaaacccggcauggaagacgcaaggguauacccauggaauugggaagacgucauagacaaagaccaauccgccgaggacuucauacgacggaugaccgguacgugcacauaccuaaaaggcgagcccguccucgcuagaugcagccucgacuacgaacuauucugcgugcugaacgaacuagcaggagcaagguggacacaagacggggacaagagcuaucgauucgacgcagcagacagacuagguauuguagaagaccucuucaaaaagcggaagcggguaacguacgaggcagcagaaaaguggcuggcacgaacacauggcccagaauccggaaaaucagccggaggggccuaccauguaagcggcggccaaggagaagaugcauucgaaagucaacucucgagccacuacgacuuuugcaaaauucugggggucgacgaacucucugacgcggacgaagcaauggccgaagauaucauacuauggaacacaguauuugaggaccgauccauccugaagcgaaagaucaagcuggccuacggcgacagacuuggagacgcucaaguacgaaaacuaugccaaaagagguacaccggguggggacgccuaagcggagaacucuuacgcggccuacgauccgcaacggacaauggaccaaaaacgaucauggacauacuacuggaaggggacccgaaucacgcaaggaggaugggagcagccaugaaccuuauggagauacuucacgacgaccucuuagaguuccaagcaaaaaucgacgaacacaauagagaacgagcacuggccgugggcggaaugagcgucgacgagguaaccggcuccccggcgcucagacgaggcaucaaucaagcacugagagugguagacgagauagcagggauagcaggaaaaccgccagcccacauauacgucgagguaacaagagaugagggcgcccggaacaaagggagaaggacaaccucaagauaccgugcccucgaggcagcucuuagcuccaucaaagcacaaugugcggaugucuacgcggagcuaaaagaacgggaucccagagcccuagacgacgagagacuaacacucuacuucaugcaaugcggaaaaugcauguacucaggcgaugcccucgacauaaacaagcuccaaaccuaucaaguugaccauauccuaccccaaucauacgucaaggacgacaguuucgaaaacaaaguuuuagugagaccagacacaaaccaaagaaagggugacacacuccuacuagacgaaagacuaauagcacgaaugcgaggauucuggcgaacacuaagggacgcggaacuaauaggggagaaaaaguucaacaaccuaacgcgaaccagcguaucggacgaacaaaugaagaaguucguaagucgacaacuuguagaaacaggacaaaugguaaaacaaguccagcaacuacuccaagcccgauaccccgaaucagaaguacagccgguuaaagcugggguaucacaccaacucaggguagggugcgcgcuagcgaaaagcagggaaauuaacgacuuccaccacgcccaugacgcguaccuagccugccagguagguagguucguacaauaccgccacucagccguguauagcgagcccgucaaaauggccgccgucguaaaacaauucauaaagaaacaagcagaagauuaccgaagaacaagggaguuaccuggaucagacgguuuuaucguauccucauucaugacgccaggauucgaugugaagacaggcgaggucuuccgcgacgcaugggaugccggagcagaaauugacagaauacggcgcugcuucgacuacaaagacugcuucauaucacgcaugccagaggagacccacggggcauucugggacgcgacgauauacucaccucgagccgcagguaagacacuaucccucccacugaaaaggggacuggacccaagaaaguacgguagcuacagcagagaacaguucgcguauuucuucguguaugaagcagugaaaccaaagaagaaacagcggguacuagaguuugccccgguaccggugcggguugcuucagccuuagccaacgaccccgaugcccuugaggacuacgcgcgcgaauuagcagaagcagaagggcuaguauucgagcgcauaagaaggcgaaaaguauacaaauaccaacaaaucaucgucggagauagccgacuguacgucacaggaagagaggagguccgcaacgcccggcaauuagccuuuagccaggacgaaacaaaacugauaugccggaucgaacaaggagaagaaugugaagaaggggaauugcuggaccucuuccgcucgaugcagcgcaaauaccuagcgugcgcgccgcgguuagcgcggcucaugaaaguagcagaaauggaggaaggcuucauagcagcaaccgccagcggcaagagagaaguacugcugucacucaccuccaucgcugcagcacaccgaaacagcauugaccucaagccgauaggacgcaaagggucgagcggacaaaugaaaauaacguucagcaaagagcuaagcacgaacgggauacucuucguagacaguuccguaaccggaauguucgaacggcgcugccgacuaggccucuga

SEQ ID NO: 6629 - RNA, 4116 nt, Artificial Sequence
  Cas9 variant
auggaaaacaagaacuauaguauaggccucgauauaggcacaaacagcgugggguggagcguaaucacagacgauuauaagguccccagcaagaaaaugaaaguccuggguaacacagacaaacguuuuaucaagaaaaacuugaucggagcucucuuauucgacgaaggcaccacggccgaagccagacgccuaaaacgcacugcccggaggagauauacgcggcggaaaaaccgcuuaagauaccuacaagaaaucuucgcagaagagaugagcaaggucgacagcucauucuuccaucgacucgaugauagcuucuuaauuccagaagacaaacggggcucaaaauaccccaucuucgccacccucgcagaggaaaaggaguaccacaagcaauucccgaccauauaccaccuccgcaagcaacuagcagauucgaaggagaaaaccgaccuccgcuuaauauaccucgcacuagcacacaugauaaaguaccgaggucacuuccuauacgaagacaccuucgauaucaagaauaaugacauccagaaaauuuucagcgaguucaucagcauauacgacaacaccuuugaagggucaagccuauccggacaaaacgcgcaagucgaggccaucuucaccgacaaaauauccaaguccgcaaaacgcgaacgaguucuuaaacucuuccccgacgaaaagaguaccggauuauuuuccgaguucuuaaaacuaauagucggcaaccaggccgacuucaaaaagcacuucgaccugggggaaaaagcgccccuacaguucucgaaggacaccuaugacgaagaucuugaaaaccuccucggccagauaggcgaugacuucgccgaccucuuccuagucgccaagaaacucuacgacgcaaucuuacugagugggauccucaccguaacggaccccuccacgaaagcgccacucuccgccuccaugauagagcgauacgaaaaccaccaaaaagaccuugcagugcucaaacaguuuauaaagaacaaccuuccagaaaaauaugacgaagucuucuccgaccaguccaaagacggauacgcgggauacauagacgguaagaccacacaagaggccuucuacaaguacauuaaaaaccuccuaaguaaauucgagggcacagacuauuuccuagaaaagaucgaacgagaagacuuccuccgaaaacaacgaacguucgauaacggaucuaucccgcaccagauccaccuacaagagaugaacgccauccuacgcagacagggagagcacuaccccuuccugaaggacaacaaggagaaaauagagaaaauacucacguuccgaauacccuacuauguaggaccccucgcccgcggcaaccgcgacuucgccuggcugaccagaaacagcgacgaagccauacgcccauggaacuucgaagaaaucguugacaaagcaucgagcgccgaagacuucaucaacaagaugacgaacuacgaucuauaccucccagaagaaaaagugcucccaaaacacucccuacuuuacgaaacauucgccgucuacaacgaacucaccaaggucaaguucaucgccgaaggacugcgcgauuaccaauuccuugacuccggccaaaagaaacaaauagucacgcaacuauucaaagaaaagcgcaaagugaccgaaaaggacauaauccaauuccuccacaauguagacgguuacgacggaauagagcugaaaggcauagagaaacaauucaacgccucccuaucaacguaccacgacuugcucaagaucauuaaggauaaggaguucauggaugacuccaagaacgaggaaauccucgaaaauauaguccacacccugaccaucuucgaggaucgcgaaaugauaaagcagaggcuagcgcaguaugacucgcucuuugacgaaaaagucauuaaagcucucauccgccgccacuacaccggaugggguaaacuuagcgcaaaacuaauagacggcauuugcgacaagcaaacgggcaacaccauccuagauuaucugauugacgacggcaaaaacaaucggaacuucaugcaacuaaucaacgaugacggacuuuccuucaaagaaauaacccagaaagcccaggucgucgggaaaaccgacgacgucaaacaagucguccaagaacugcccggcucccccgccaucaagaaaggcauacugcaguccaucaaaauugucgacgagcuaguaaaagugaugggccacacacccgaauccauaguaaucgagauggcacgggaaaaccaaaccacggcgcggggcaagaaaaacucucaacagcguuacaaacgcaucgaggacgcucucaaaaaccucgccucugggcucgacagcaacauacucaaagaacaccccacgaacaacauccagcugcaaaacgaccgucucuuccuuuacuaccuacagaacggcagggacauguacaccggcaaaccgcuggacaucaaccaacugagcagcuacgacauagaccacauugugccgcaggcauucauaaaagaugauucauuagauaaccguguccucacaucacucaaagacaaccgcgguaaaagcgacaauguaccuuccauagaggugguacaaaaacgcaaggcuuucuggcaacagcuccucgacucaaaacuaauaagugaacguaaauucaacaaucucaccaaagcagaacgugguggacuugacgaacgagacaaaguagguuuuaucaagcgccagcuagucgaaacccggcaaaucacgaaacacgucgcccaaauauuagacgcgcgcuucaacaaagaaguuaacgagaaagacaagaaaaaucgcaccguuaaaaucauuacccuaaaaagcaaccuagucaguaacuuccgcaaagaguuccgucucuauaaggugcgagaaauaaacgacuaucaccacgcccacgacgcauaccucaacgcagucgucgcgaaagccauccugaagaaauacccaaagcuggaacccgaguucgucuacggagauuaucaaaaauacgaucucaaacgauacauaucccgaagccgcaacccuaaggaaguugaaaaagccaccgaaaaauacuucuuuuacagcaaccucuugaacuucuucaaggaggagguacacuacgccgacgggacaaucguaaaacgcgagaauaucgaauacuccaaagacaccggagagauagcguggaacaaggaaaaagauuucgcgacgaucaagaagguucuaucauacccccaagucaacaucgucaagaagcgcgagguacagacaggcggauucuccaaagaaucgauacugcccaaagggaacagcgauaaacuaauaccgagaaaaaccaaagacauccugugggaaaccacuaaguacggaggcuucgacagccccgugauagcauacaguauacucuuaauugccgacaucgaaaagggcaaggccaagaaacucaaaaccguuaagacccuggucggcaucacgauuauggaaaaggccgcauucgaagaaaauccaaucacuuuccuagaaaauaaagguuaccauaacguucgcaaggagaacauacuuugccugccaaaauacucccucuucgaacuugaaaaugggcggaggcgacuccuagccagcgcgaaagaacuccaaaagggaaacgagauuguccuuccaguauaccuaaccacacugcucuaccacagcaaaaacguucacaaacuagacgaaccggaacaccuagaauacauccaaaagcaccgcaacgaguuuaaggaccuccucaaccucguauccgaguucagccagaaguacguccucgccgacgccaaccucgagaaaauacaaaaccucuacgccgacaacgaacaagcugauauugaaauacucgccaacuccuucauaaaccuacuaacauucacagcuuuaggcgcccccgcagcuuuuaaguucuuuggaaaagacaucgaccgaaaaagauacaccaccgucucagaaaucuuaaaugcaacccuuauccaccaaucgauaacgggacuauacgaaacucggaucgaccuaagcaaacuaggcgaagacuga

SEQ ID NO: 6630 - RNA, 4116 nt, Artificial Sequence
  Cas9 variant
auggacaagaaguacagcauaggccuggacauaggaaccaacucggucgggugggccgucauaacggaugacuacaaagucccgagcaagaaauucaaaguacugggaaacaccgaccggcacagcaucaaaaagaaccuaauaggcgccuuacuauucgacuccggagaaaccgcugaggcgacacgccuuaaacgcacggcccgacgacgguacaccaggcgcaagaaccgaauacgguaccuacaagagauauucuccucagaaauguccaaaguagacgacucuuucuuccaucgccuagaggagagcuuccucgucgaagaggacaagaaacaugaaaggcaccccaucuucgguaacaucguagacgaaguggccuaccacgaaaaauaccccacaaucuaccaucugcggaagaaacuagccgauuccaccgacaaagcagaccuccggcuaauauaccuagcccuggcgcacaugauaaaauuccgggggcacuuccuaauugagggagaccucaacccagauaacagcgacauggacaaacucuucauccaacuuguacaaacauacaaccaacuguucgaagaaaacccuaucaacgccagccgcguggacgccaaagcaauacucucggcacgccuauccaaaucccgccgacucgagaaccucauagcccaacucccaggcgaaaaacgcaacggauuguucggaaaccuaauugcgcuaucccuaggccuuacccccaacuucaaaucaaacuucgaccuagccgaggacgcaaaacuacagcuauccaaggacaccuacgaugacgaccuugacaaccuacucgcgcagaucggcgaccaguacgcagaccuguuccuagccgccaagaaccucuccgacgccauccuccucagcgacauccuucguguaaauucagaaauaaccaaagccccucucucugcauccaugauaaaacgguacgacgaacaccaccaagaccuaacccuccuaaaggcacugguacgucaacaacucccggaaaaauacaaagaaauuuucuucgaccagagcaaaaacggauacgcaggauacauugacggaggagccagucaagaagaguucuacaaguuuaucaaacccaucuuggagaaaauggacgggacagaggaacuacuagccaaacuuaaccgcgaagaccucuuaagaaagcaacgaacauuugacaacggcaguauaccccaccaaauucauuuaggagaacuccacgccauacuacgccgccaggaggacuucuacccauuccucaaagacaaccgggagaagauagagaaaauacuuacauuccgcauucccuacuacguagguccacucgccagagguaacuccagauucgccuggaugacccgaaaguccgaggaaacaauaacccccuggaauuucgaagaagucguggacaaaggcgcgagcgcacagucguucaucgagagaaugaccaacuucgauaagaaccuaccaaacgagaaaguccucccaaagcacucacuucuuuacgaauacuucacagucuacaacgaacucaccaaagugaaauacguaacagagggaaugcgaaaacccgaguuccuauccggcaaacaaaaggaggccauagucgaccuccuauucaaaaccaaccggaaagugaccgucaaacaacuuaaagaagacuacuuuaagaaaauugaaugcuuugacagcgucgaaauaagcggagucgaagaccgcuucaacgccagccugggaaccuaccacgaccuacuaaaaaucaucaaagauaaagacuuccuagacaaugaagagaaugaagacauccuugaggacaucguccuuaccuuaacauuauucgaagacaaagagaugaucgaggaacggcucaagaaauaugcaaaccucuucgaugacaaaguuaugaaacaacucaaacggcgccacuacacgggcugggggaggcuuagucgaaaacuaaucaaugguauccgagacaagcaaagcggcaagacuauccucgacuuucuaaaguccgacggcuucgccaaccgaaacuuuaugcaacucaucaacgacgacucccuaaccuucaaagaagccauccaaaaggcccaggucuccgggcagggccauagccuccaugaacaaauagccaaccuggccgggagcccagccauaaagaaagguauacuacagagcgugaaaguagucgacgagcuagucaaggucaugggacacaaacccgaaaacaucgucauagaaauggcgcgugaaaaccagacaacgcagaagggccaaaagaacucgcgcgaaagaaugaaaagaaucgaagaagggaucaaggaacugggcucacaaauccugaaagaacacccagucgagaacacacaacuccaaaacgaaaaauuauaccuauacuaccuccagaacggccgagacauguacguggaccaagagcuugauauaaaccgccuguccgauuacgacgucgaccacaucgucccccaauccuucaucaaagacgacuccaucgacaacaaaaucuugacgcguuccgacaagaaccgaggcaagagcgauaacguacccagcgaagaggucguuaaaaagaugaaaaacuacuggcgccagcuacuaaacgcuaaacucauuacccagagaaaauucgacaaccuaaccaaggcugaaagaggcggccucuccgaacucgauaaggccggcuucauuaaacgacagcuaguagagacgagacaaaucaccaagcacguagcucaaauacuagacagccggaugaacacgaaauacgacgaaaaugacaaguugauucgggaaguaaaaguaauaacgcucaaauccaaguuaguguccgacuuccgcaaggacuuccaguuuuauaagguccgcgaaaucaacaauuaccaccacgcacaugaugcuuaucuaaacgcaguggucggcaccgcccuaauuaaaaaguacaccaaacucgagagcgaguuuguuuauggcgacuacaaaguauaugacguccgcaaaaugaucgccaaauccgaacaagaaauaggcaaagccacggcaaaacgcuucuucuacucaaacauaaugaacuucuucaaaaccgaaaucacccuagcgaacggagaaauccgcaaacgcccacucaucgaaacaaacgaagaaacaggugagaucguaugggacaagggccgggacuucgcaaccguacgaaaaguccuuagcaugccccaggucaacauugucaagaaaacagagguccagaccggcgcacucacgaacgaauccauauaugcacgcggcagcuuugacaaacugaucucgcggaaacaucgguucgaauccucaaaauacggaggauucggaucacccaccgucacauacagcguccuaguaguagcaaaaucaaaaguacaagacggcaaagucaagaagaucaaaacuggcaaggaauuaaucggcaugacacuccuagauaaguugguguucgagaaaaacccgcucaaauucaucgaggacaaaggguacgguaacguccagauagauaaaugcaucaaguugccaaaauacagccucuucgaguucgaaaacggaaccagacguaugcuugccuccgucauggcuaacaacaacagccgcggcgaccuccagaaggcaaacgaaauguuccucccagcgaaacucgugacccuucucuaccacgcccacaaaaucgaaucuucaaaagaacuggaacacgaggcuuacauccuggaucacuacaacgaccuauaccagcuccugucauacauugaacgcuucgccucccuauacguagauguagagaaaaacauuuccaaagucaaggaacuauucagcaacaucgaaucauacagcauaagcgagaucuguucgucaguaauuaaccuacucacguuaaccgccucaggcgccccggcugacuucaaauucuuaggaaccacgaucccaagaaaacgauacggcucgccccagagcauccugaguucaacauuaauccaccagagcauaacaggccucuacgagaccagaaucgaccugucccaacucggcggugacuga

SEQ ID NO: 6631 - RNA, 4116 nt, Artificial Sequence
  Cas9 variant
auggacaagaaauacaguaucgggcucgacauuggcacaaacuccgucgggugggccgugaucacagaugacuacaaagucccguccaaaaaguuuaaaguucuuggaaacaccgaccgacacagcaucaaaaagaaccucauuggggcccuacucuucgacucaggcgaaacagcggaggcaacacgucucaagcgaacagcgaggcgccgauauaccagacgcaaaaacaggauccgcuaucuccaagaaaucuucucguccgagaugagcaaaguagacgacagcuuuuuccaccgccucgaagagagcuuccucgucgaagaagacaagaaacacgaacgccacccaaucuucggcaacauuguagacgaaguagcauaccacgagaaauacccaaccaucuaucaccuacggaagaaacuagccgauaguacggacaaagcggaccucaggcucaucuaccuagcccuagcgcacaugaucaaauuucgaggccacuuucugaucgagggagaccugaaccccgacaacagcgacguagacaaacuauucauccagcuaguccaaacauacaaccagcucuuugaagaaaaucccaucaacgccagccggguggacgcaaaggcgaucuugagcgcccgccucucaaaaagccggcgacuagaaaaccugauagcccaacucccaggagaaaaacgaaacggacuguucggcaaccuaaucgcgcuaucacucggucuaacgcccaacuucaagagcaacuucgaccuagccgaagacgcaaaacugcaacucuccaaagauacauacgacgacgaccucgacaaccuccuugcacaaaucggcgaccaauacgcagaccuauuccucgccgcaaagaaccuguccgacgcgauccuacuaagcgacauccucagggucaacagugaaaucacgaaagcaccccucuccgccucaaugauaaaaagauaugaugagcaccaccaagaccuaacauuacugaaggcccucgugcgccaacaauugccagagaaauauaaagaaauauucuucgaccaaucgaagaacggcuaugccggcuacaucgacggaggagcgucacaagaagaguucuacaaauucauaaaaccaauucuagaaaagauggacggaaccgaagaacugcucgcaaaauugaauagagaagaccuccuccgcaaacaacggaccuucgauaacggcuccaucccccaccaaauccaucugggugaacuccacgcgauacucagacgccaagaggacuucuaccccuuccuaaaagacaaccgcgagaaaaucgaaaagauacuuaccuuccgcaucccguacuacguaggaccccucgcucgaggcaacucgcgcuucgccuggaugaccaggaaaucggaagaaacaauaacgcccuggaacuucgaagaagugguagauaagggcgcuucggcccagagcuuuauagagcggaugaccaauuucgacaaaaacuuacccaacgagaaaguacugccuaagcacucccuccuauacgaauacuucacaguguacaacgaacuaaccaaagucaaguauguuacggaaggaaugcgaaagcccgccuuccucagcggagaacaaaagaaagcuaucgucgaccugcuauuuaaaaccaacagaaaggugaccgucaaacaacucaaagaagacuacuuuaagaagauugaaugcuuugauagugucgagauaagcggcgucgaggaccgguucaacgcgucacucggcaccuaucacgaccuauuaaaaaucauuaaagacaaagacuucuuagacaacgaagaaaacgaagacauccuugaggacauaguccuuacacucacccucuuugaagauaaagaaaugaucgaggagagacucaagaccuacgcgcaucuguucgacgauaaagucaugaaacaacucaaacggcggcacuacaccggguggggcagacuuucaaggaaacuuauaaacgguauacgggacaagcagagcggaaagacaauccucgacuuccuaaaaucggacggcuucgccaaccgaaacuucauccagcucauccacgacgacucccucacauucaaggaagcaauccaaaaggcucaaguaagcggccaaggccacucacuccacgaacaaauagccaacuuagccggauccccagccaucaaaaaggggauacugcaaagcguaaaagugguagaugaacucgucaaggucaugggacacaaacccgaaaacauaguaauagaaauggcgcgagaaaaccaaaccacgcaaaaaggccaaaagaacucccgggagcgcaugaagcgcauugaagagggaaucaaagagcuaggcucccaaauacucaaggaacacccgguggagaacacccagcuccaaaacgagaaacuguaccuauauuaucugcaaaacggucgcgacauguacguagaccaagaacuugacauaaacagacucagcgauuacgacguagaccacauaguaccccaauccuuuauaaaagacgacagcauugacaacaagguccucaccagauccgacaaaaaccggggcaaauccgacaacguccccagcgaggaaguugucaagaaaaugaagaacuacuggcgccaacuccuaaaugccaagcucauaacgcagaggaaguuugauaaccuuacgaaagcagagcgaggaggccuuucggaacucgacaaagccggguucauaaaacggcagcuagucgaaacacgccaaaucacgaaacacgucgcccaaauccucgacaguagaaugaacaccaaauacgacgaaaacgacaagcucauccgcgaaguuaaaguaauaacccucaaaagcaagcucgucuccgacuuccgcaaagacuuccaguuuuacaaagugagggaaauuaacaacuaccaccacgcccacgaugcguaccuaaacgccguaguuggcacagcccucaucaagaaauacccgaaacucgaauccgaguucguguacggggacuacaagguguacgacguacggaagaugaucgccaaaucggaacaagagaucggcaaagcaaccgccaagagauucuuuuacucaaacauaaugaacuucuuuaaaaccgaaauaacacuggccaacggagaaauccgcaagcgaccucuuaucgaaacgaacgaagaaacaggagaaaucgugugggacaaaggccgagacuuugcaaccguacgcaaaguccuuuccaugccccaaguaaacaucguaaagaaaaccgaaguccagacaggcgcacucacgaacgaaucaauauacgcccgaggauccuucgacaaacucauuagccggaaacauagauucgaauccucgaaauacggaggcuucggcagcccaaccgucacauacucaguacucguaguggcuaagucaaaaguacaagacggcaaagucaaaaagaucaagaccggaaaagaauugaucgguaucacacugcuagacaagcuaguauuugaaaagaacccgcuuaaauucaucgaagacaaaggauauggcaacguucaaaucgauaaaugcaucaaauuacccaaauacagccuuuucgaguucgaaaacgggacccgccggauguuggccuccgucauggcaaacaacaacucccgcggagaccuccagaaagccaacgagauguuccugcccgcuaagcuaguaacacuccucuaccacgcucacaagauagaguccagcaaggaacuggaacacgaagccuacauucuagaccacuacaaugaccucuaccaacuacucagcuauauagaacgauucgcaucacuauacguggacguagagaaaaauaucagcaaggucaaagaacuauucagcaacaucgagucauacagcauaagugaaauaugcuccagugucaucaaucuccuuacacucaccgcuuccggcgcgccugcagauuucaaauuccuaggaacaaccaucccgcgcaaacgcuacgggucgccccaguccauuuuauccuccacguugauacaccaaagcaucacgggcuuauacgaaacgaggauagaccugagccagcuaggcggagacuga

SEQ ID NO: 6632 - RNA, 4116 nt, Artificial Sequence
  Cas9 variant
auggaaaacaagaacuacuccaucggacucgacauaggaaccaacagugucggcugguccgucauaacagacgacuacaaaguaccgagcaagaaaaugaaaguccuagggaacacagauaaacauuuuaucaagaaaaaccugaucggggcccuccucuucgacgaaggcacgacggcggaggcacgaagacugaaacgaacggcacgccggcgcuacacaaggcggaaaaaccgacuucgcuaucuccaagagaucuuuucggaggaaaucgggaaagucgacucgucguucuuccaccgucucgacgacucauuccugauacccgaggacaaacgggguuccaaauacccaauuuucgcgaccuuggcagaggaaaagaaauaccauaaacaauucccgacaaucuaccaccuccgaaaacaauuagcggauucaaaagaaaagaccgaucugcgccuaaucuaccuagcacuugcacacaugaucaaauaccgcggccacuucuuguacgaagaggcuuucgauaucaaaaacaacgacauccagaagaucuucaacgaguucauaagcauauacaacaauaccuuugaaggcaacagcuuaagcggucaaaacguccaaguagaagccaucuucaccgacaaaauuagcaaaagcgccaaaagagaacgaguacucaaacuauuccccgacgaaaagagcacuggccucuuuucagaguuccucaagcucauaguaggcaaucaggcagacuucaagaaacacuucgaccuggaagagaaagcgccccugcaauucagccgagacacuuaugacgaagaccuggagaaccuguugggccaaaucggagacgacuucgccgaccuauucuuagucgccaagaaacucuacgacgccauauuacuuuccggcauccugaccguaacuaacccgagcacgaaagccccgcucuccgcuagcaugaucgaacgguacgagaaucaccagaaagaccuugcgucgcuaaaacaauucaucaaaaacaaccuccccgaaaaguaugacgaagucuuuucggaccagucugaggacggguaugcaggauacaucgacggaaaaacgacccaagaaacauucuacaaauacaucaaaaaccuacucagcaaguucgaaggagccgacuacuucuuagacaaaauugaacgcgaggacuuccuccgcaagcaacggacguucgacaacggcucaauaccccaccagauacaccuacaagaaaugaacgccauacuccgacgccagggugaacacuaccccuucuugaaggaaaacaaagaaaagauagagaagauccuaacguuccgcauuccuuacuacguagggccccucgcacgaggaaaccgagacuuugcguggcuaacgcgaaacuccgaccaggcgauccgcccguggaacuucgaggagaucgucgauaaagcauccucggcagaggauuuuaucaacaaaaugacaaauuacgaccuauaccuccccgaggagaaaguacuacccaaacauucccuacuuuacgaaaccuucgcaguauacaacgaacugacgaaggucaaauucauagccgagggccucagagacuaucaauuccuagacuccggccagaagaaacagaucgugacccaacuauucaaagagaagcgcaaggucacagagaaggacaucauccaauuccuccacaacgucgacggcuaugacggcaucgaacuaaagggaaucgaaaagcaauucaaugcaucccuuucgacuuaccacgaccuccuaaagaucaucaaagacaaggccuucauggaugacgccaaaaacgaagcaauccuagagaacaucguacacacccucaccauuuucgaagaccgugaaaugaucaaacaacgcuuagcccaguacgacagcuuauucgacgaaaaagugaucaaagcccucacucgccgacacuacacgggcugggguaaacucagcgccaaacucaucaacgggauauccgacaaacaaaccggcaacacaauccuggacuaccuaauagaugacggagagaucaaccgcaauuuuaugcagcuaauaaacgacgacggauuaucguucaaagaaauaauccagaaagcccagguggucggcaaaacaaacgacgugaagcaagucguccaggagcugcccggaucccccgccaucaaaaagggcauccugcaguccaucaaaauugucgaugaacugguuaaagugaugggccacgccccggaaagcaucgugaucgaaauggcacgcgagaaccaaaccacggcgcguggcaaaaagaauagucaacagagauacaaacguauagaagacucacugaagaucuuagcgagcggccucaacuccaaaauccuaaaagaacaccccaccgacaacauacaacuucaaaacgaccgccucuuccuguacuaccuccagaacggaaaagauauguauacgggugaagcccucgacaucaaccaacucaguucaugcgacaucgaccacaucauaccacaagccuucaucaaagacgauucacucgacaauagaguccucaccaguuccaaggacaaccgcggaaagucagacaacguccccagccuggaagucguugacaagaugaaggucuucuggcagcaacugcuagacagcaaacuaauuaguuaccgcaaauucaacaaccuaacgaaagcagagcgcggcggcuuaaacgaauuagacaagguaggcuuuaucaagagacagcucgucgagacuagacaaaucaccaaacacguagcccaaauucuugacgccagauucaacaaagagguuaccgagaaagacaagaaaaaccgaacgguaaagauaauaacguugaaaagcaaucuagucagcaacuuucggaaagaguucgagcucuacaaaguaagagaaaucaacgacuaccaucacgcacacgacgcguacuuaaacgcagucguagcaaaagccauccucaagaaauaccccaaacuggagccugaguucgucuacggugauuaucagaaguacgaccugaaaagguacaucucacgcucuaaagacccaaaggaaaucgaaaaagcaaccgagaaauacuuuuucuacucgaaucuacucaacuucuuuaaggaagaaguacacuacgcagacggaaccaucguuaagcgcgaaaacauagaauauuccaaggacacaggcgaaaucgcauggaacaaggagaaggacuucgcuacaauaaagaaaguacucucgcuaccccaggucaacauuguaaagaaacgcgaggugcagacaggcggauucagcaaagaaucaauccugcccaaaggaaacucagacaaacuaaucccccggaaaacaaaagauauacugugggacacaacaaaauacggagguuucgacucccccgugaucgcauacagcauccuacucauagcagauauagaaaagggaaaggccaagaagcuaaaaaccguaaaaaccuuaguaggcauaaccauaauggaaaaagacgcguucgaaaagaaccccaucgcauuccuagagaauaaaggcuaccacaacgucugcaaagagaacauccucugccuaccgaaauacucacuguucgagcucgaaaacggacggcgccgacuccucgcguccgccaaggaacugcaaaaaugcaacgaaauaguccugccuguauaccucacgacauugcuuuaccacucaaagaacguccauaagcucgacgagccaggucaucuagaauacauucaaaagcaccgcaacgaauuuaaagaucugcugaaccuagugagcgaguucagccaaaaauacguccucgcagacgcuaaucuagagaaaaucaaaaaccuguacgcggauaacgaacaagcagacaucgaaauccuggccaauuccuucaucaacuugcucaccuucacagcccugggcgcacccgcugcguucaaauucuucggaaaagacguugaccgcaaacgauauaccacaguauccgaaauccucaacgcgacccucauucaucagagcaucacgggccucuacgagacccgcaucgaucuuagcaaguugggcgaagacuga

SEQ ID NO: 6633 - RNA, 4116 nt, Artificial Sequence
  Cas9 variant
augaagguaaacaacuaccacaucggacucgacauuggcacaagcuccauaggauggguggccauuggcgaagacggcaaaccccuccgcauaaaaggaaaaacagcgaucggagcccgacuauuccaagaagggaacccagcagccgauagacguauguucagaacaacucgccgucgccuaucccgccgaaaauggcgccuaaaacugcucgaggaaauauuugaccccuacaucacccccguagacucaacguucuucgcccgucucaagcagucgaaccuaagccccaaagauuccaggaaggaguucaagggaagcaugcuauucccggaccuaacagacaugcaguaccacaaagacuaccccacuauauaccauuugaggcacgcacucaugacacaagaugaaaaguucgacauucgcaugguuuaccucgcaauccaccacaucguaaaguacaggggaaacuuccuaaauucaacccccgucgacuccuucaaggccuccaagguuaacuucguagaccaauucaagaaacugaacgaauuguacaccgccauaaacccugaagagagcuuccagauaaaucucgcuaacucagaagacauagggcaccaauuccuggaccccuccauccggaaauucgacaaaaagaaacagaucccaaaaauagucccaguaucuguagaugauaaagccacagacaaaauaaaugggaagaucgccuccgagauuauaaacgcuauacugggauacaaauccaaacucgacguggucguucaaugcacaccgguagauagcaagagcugggcgcuaaaauuugacgaggaagauauugacgccaagcuacagaaaauauuacccgagauggacgaaaaccagcaguccaucaucgccauucuccaaaaccucuacucacaggucacccugaaccaaaucguccccaacggcaugucccuauccgaauccaugauagagaaauacaaugaccaccacgaccaccuaaaacucuacaaaaagaucaucgaccaacucgcggaccccaaaaagaaagccgcacucaagaaagccuacagucaauacguaggcgaugacggcaaagugaucgaacaagccgauuucugguccuccguuaagaaaaaccucgacgacucggaccucucgaaacaaaucauggaccuuaucgacgcggaaaaauucaugccaaaacagcggaccucccaaaacggagugaucccacaccaacugcaccagcgcgaacuagacgaaauaaucgagcaccagagcaaauacuacccauggcuagcggaaaucaaccccaacaaacaugaccuacaucuugccaaauacaaaauugaagaacucgucgccuuccgaguaccauacuacgucggcccgaugaucacaccggacgaccaagcaaaaucggcagaaaccguauuuucauggauggaaaggaaaggcaaagaagccggacaaaucaccccauggaacuucgacgaaaaagucgaccgaaaugccucagcgaaccgguucaucaaacgaaugacaacaaaggacaccuaccuaaucggggaggacguccucccugaugaaucucuccucuaugaaaaauucaagguucuaaacgaacucaacauggugcgggucaacggcaaacuccucaagguagcagauaaacaagcaaucuuccaggaucuguucgaaaacuacaagcauauuuccguuaaaaagcuccaaaacuauaucaaaaguaagaccggccuucccuccgaucccgaaauaucuggccuaucagacccagaguacuucaauaacagccuaggcaccuacaacgacuuuaagaaauuguucggcaacaaagucgacgaaccugaccugcaagacgacuucgagaaaauagucgaauggucgacagucuucgaggacaaacgcauacuacgagagaaacuaaaugagauuaccugguuaucggaccaacaaaaagacguucuggaaagcagccguuaccaaggaugggggcgacuaaguaagaaacuccugacagguaucguuaaugaccaaggcgaacgaauaauagacgaacucuggaacaccaacaaaaacuucaugcaaauccaaucagacaacgacuucgccaagcgcauccacgaagccaacgcagaucagaugaaggccguagacgucgaagacguccucgccgacgcguacaccaguccgcaaaacaagaaggcaaucagacaagucguuaaggucgucgacgacauacagaaagccaugggcggaguagcucccaaauacauaucaaucgaguucacgcgguccgaagaccgaaacccacgccguacgaucucccgccaacgacagcuggaaaauacacuaaaggacaccgccaagagccucgcgaagaguauaaacccagagcuacuaagcgagcuugacaaugcggccaaaucgaagaagggccuuaucgaucgacucuaccuguauuuuacacaacuggguaaagacaucuacaccggcaagcccaucaacauagacgaaaucuccaccuaugacaucgaccauauccuaccccaagccuucguaaaagaugacucccuuaauaaccgcguccucguaagcaaggcaauaaauaacggcaaaucugacaacguacccguacaacuguucggggcgaaaaugggacacuucuggaaacaacucgccgaggccggccucauuagcaagaggaaacugaaaaaucuacaaaccgacccagacacaaucucaaaauacgccaugcacggcuucauacgccggcaacuuguggagaccucacaggucaucaaacugguggcgaacauccuaggcgacaaguaccgcaaugaugacacgaagauaaucgaaaucacagcccggaugaaucaucaaaugagggacgaguucggcuucaucaagaaucgggaaauaaacgacuaccaccacgccuuugacgccuaccuaacggcauuccuuggacgcuaccuauaccaccguuacaucaaauuacgaccauacuuugucuacggcgacuuuaagaaguucaaagaagacaaggucacuaugcgcaacuucaacuuccugcaugaucuaaccgacgacacacaagagaaaauagcggacgcggaaacaggagaaguuauaugggaccgagagaacaguauccagcaguugaaagacguauaucacuacaaguucaugcuaaucucacaugaagucuacacgcuccgcggugccauguucaaccagacagucuaccccgcauccgacgcaggcaaacgcaaacucauccccaucaaggccgaccgccccaucaacgucuacggcggcuacuccggcuccgccgaugccuacauggcaaucguccgaauacacaacaagaaaggcgacaaauaccgcguagugggcgucccaaugagagcccgagacagacucgacgcggccaagaaaguaagcgacgccgacuaugaccgcgcgcugaaagacguucuuacaccucaacuuaccaaaaccaagaaauccagaaaaacaggcgaaauaacacaagucguggaagacuucgaaaucguccuuggaaaaguuauguauagacagcuaaugauugacggggacaaaaaguucaugcugggcucaagcacauaucaauacaacgccaagcagcugguccuuuccgaccaaucggucaaaacacucgcaucaaaaggacgccuagacccccuccaggagagcauggacuauaacaacguguacacagaaauucucgacaaggucaaucaguacuuuucccuuuacgauaugaacaaauuccgccacaaacugaaccuuggcuucucgaaguucaucuccuuucccaaccauaacguguucgacggcaacaccaaagcauccucaggaaaaagagagauccucgaggaagugcucaacggccuccacgccaauccuacuuucggaaaccucaaagacaucgggaucacaaccccauucgggcaacuucaacaaccaaacggcauccuccucucggacgaagccaaaauacgauaucaaucgcccacuggacuguucgaacgcaccgugagccucaaagaccuguga

SEQ ID NO: 6634 - RNA, 4116 nt, Artificial Sequence
  Cas9 variant
augaaggugaauaacuaucacaucggcuuagauaucggcaccuccuccauagggugggucgcgauaggcaaagauggaaaaccccuccgcgucaaaggcaaaaccgccauaggcgcacgccuguuccaagaagguaacccggcagccgauaggcguauguuccgcaccacgcggagacgacuaagccggcgaaaguggcgccuuaaacuccuagaagaaauauucgaccccuacauuacccccguagauuccaccuucuucgcacggcucaaacaguccaaccugagcccgaaggacucccggaaggaguucaaaggaagcaugcuauucccagaccuaacagauaugcaauaccacaagaacuaccccaccaucuaccaccuaagacacgcacuaaugacccaagacaagaaauucgacauccggauggucuaucucgcuauccaucauaucgugaaguaccgaggcaacuuccugaacucaacaccgguugacucuuucaaggcaagcaaagucgacuucguagaccaguucaagaaacucaacgaacuauacgccgcgauaaacccagaggaguccuucaaaauaaacuuggcaaacucggaagacauaggccaccaguuccucgaccccuccauucgcaaauucgacaaaaagaaacaaauaccgaaaauaguaccuguaaugaugaacgacaagguaacggaccgacucaacggaaaaaucgcaucugagauaauccacgcaauccuaggcuauaaagcaaaacucgacgucguccugcaaugcacccccguggacuccaaaccaugggcucucaaguucgacgacgaagauauugacgccaaacuugagaaaauacuaccagaaauggacgaaaaccaacagucaaucguugccauccuacaaaaucucuacucacaagucacccucaaccaaaucguuccaaacggcauguccuuauccgaauccaugaucgagaaguacaaugaccaccacgaccacuuaaagcuauauaagaaacuaauagaccagcuggcagacccaaagaagaaagcagucuuaaagaaagccuacagccaauaugugggcgacgacggcaaagugaucgagcaagccgaguucuggagcucugugaagaaaaaccuagacgauagcgaacuaaguaaacaaaucauggaccuaaucgacgccgaaaaauuuaugccaaaacaacguacuucgcaaaacggaguaaucccccaccaacuccaccagcgcgaacucgacgaaauaauagaacaccaauccaaauacuaccccuggcuaguagaaauuaaccccaacaaacacgaccuccaucucgcaaaauauaagaucgaacagcuagucgcauuccgcguaccauacuacgugggacccaugauaaccccaaaggaccaagccgaaagugccgaaaccgucuucucauggauggaaaggaagggaacagagaccggacaaaucacucccuggaacuucgaugagaagguagaccgcaaggccuccgccaaccgauucaucaaacgaaugacuaccaaagauacuuaccucauaggugaagacguguugcccgaugaaagccuacucuaugagaaauucaaggugcuuaacgaacuaaacauggucagagucaacggcaaauugcugaagguagcggacaagcaagcaaucuuccaagaccucuucgagaacuacaaacacgugucagucaagaaacuccagaacuacaucaaagcuaaaacaggccuaccgagcgacccggaaaucucaggacuaucggacccagaacacuuuaauaacucccucggcaccuacaacgacuucaagaaacuauucggcucaaaagucgacgaacccgaccuccaagacgacuucgagaaaauagucgagugguccacaguuuucgaagauaagaaaauccuccgggagaaacucaaugagaucacuuggcuaagcgaccagcaaaaagacgugcucgaauccucccgauaccaaggcuggggcaggcucuccaagaagcuccucacuggaauaguaaacgaccaaggcgaacgcauaauugauaaacuauggaacaccaacaaaaacuucaugcaaauacaauccgacgacgacuucgcaaagcgcauccacgaggccaacgcggaccaaaugcaggcgguggauguagaagacguacucgcagacgccuacaccagcccacagaacaagaaagcaauccgccaggucgucaaagucgucgacgacauccaaaaggcaauggguggagucgcgccuaaguacauaucaaucgaguucaccagaagcgaagacagaaacccccggcggaccaucagcagacaacgacaacuggaaaacacccucaaagacaccgcgaaaucccuggcgaaguccauaaacccagaacuacucuccgagcucgacaaugcagccaaauccaagaaaggccucaccgaucgccucuaccucuacuucacccagcugggcaaagacauuuacaccggcgaaccaauaaacaucgacgagcuaaacaaauacgauauagaccauauauugccccaggcguucaucaaagacaacaguuuggacaaucgcgugcucguccuaacggccgugaacaacggaaaaucggauaacguuccguuaagaauguucggggcuaaaauggggcacuucuggaaacaacuagcagaggccgggcuaauauccaaacgcaaacucaaaaaccugcaaacggacccugacaccaucagcaaguacgccaugcacggguuuauacgcagacaauuggucgaaacaucacaagucaucaagcucgucgcgaacauacuaggggacaaauaccgcaacgacgacaccaaaaucaucgaaaucaccgcucggaugaaccaccagaugcgagacgaguucggguucauuaagaaccgugaaauuaacgauuaccaccaugcguucgacgccuaccucacagccuuccucggucgguaccuguaucacagauacaucaaacuaagaccuuacuucgucuacggcgacuucaagaaauucagggaagacaaagucacaaugcguaacuuuaacuuucuacacgaccuaaccgacgacacacaagagaaaaucgccgacgccgaaaccggagaggucaucugggaccgcgaaaauuccauacagcagcuaaaagacgucuaccacuacaaguuuaugcucaucucccacgaaguauacacacuccgaggagccauguucaaccagacaguauaucccgccuccgacgccgguaagcguaaacugauacccguaaaagccgacaggcccgucaacguauacgggggcuauuccggguccgcugacgcauacauggcuauaguccggauccacaacaagaagggcgacaaauaccgggucgucggcgucccaaugcgggcucucgaccgccuggacgcagcaaagaauguaagcgaugccgauuuugaccgagcacuaaaagacguccuagcgccccaacucacaaaaacuaaaaagucccgcaaaacaggggagauaacacaaguaauagaagacuucgaaauaguccucggcaagguuauguaccgccaacugaugaucgacggagacaagaaauuuaugcucgguucauccacauaccaauacaacgccaaacaguuagucuuaucggaccaaucggucaaaacacuggccagcaaaggccgacucgacccccuacaggaaagcauggacuacaacaacguguacacggagauacuugacaaagugaaccaauacuuuucccuauacgacaugaacaaauuccggcauaaacugaaucuuggguucuccaaauucaucagcuucccaaaccacaacguacuagacgggaacaccaaaguaucaucaggcaaacgagaaauauuacaagaaauacuaaacggccuucacgccaaccccacguucgguaaccuaaaggacgucggaaucacaacgccuuucgggcaauugcaacaacccaauggcauccugcucagcgacgagaccaaaauccgcuaccaaagucccaccggacucuucgaacgcaccgucagucuuaaggaccuguga

SEQ ID NO: 6635 - RNA, 4116 nt, Artificial Sequence
  Cas9 variant
auggacaagaaauacucgaucggcuuggacauugggaccaacuccgucgggugggccgugauaacagacgacuacaaagugccauccaaaaaguucaagguccugggaaacaccgaccgccacucaauaaagaaaaacuuaauuggcgcccugcucuuugacucaggcgaaaccgccgaagcuacacgacucaaacggacagcaaggcgcagguacacccgucgaaagaacagaauaugcuaccuccaagaaauauucagcaaugaaauggcgaaaguggacgacucauucuuccaucgcuuagaggagagcuucuugguagaagaagacaaaaagcacgaaaggcacccaauauucggcaauauagucgacgaagucgcguaccacgaaaaauacccaacaauauaccaccuccggaagaaacucgccgacucgacagacaaagcggaucuccgccugaucuaucuggcacucgcccauaugauaaaauucaggggccacuuccuuauagaaggcgacuugaaccccgacaacucggacguagacaaacucuucauccaacucguucaaacauacaaccaacuguucgaggaaaacccgauaaacgccagcaggguggacgccaaagcaauccucucggcuagguuaucaaaaucacgccgccucgagaaccugauugcccaacuccccggcgaaaagaaaaacgggcuguucgguaaccugauagcccugagcuugggccuuaccccgaacuucaaaucgaacuucgaccuagccgaagacgcgaaacuccaguuaucaaaagacaccuacgacgacgaccuagacaaccuacucgcgcagauaggugaucaguacgcggaccucuuccucgccgcgaaaaaccuauccgacgcaacccuacucagcgacauccucagagucaacagcgagaucacaaaagccccgcuaagcgccucuaugaucaaacgguacgacgaacaccaccaagaccugacccuccuuaaggcacucgugagacagcagcuccccgaaaaauacaaagaaaucuucuucgaucaaagcaaaaacggcuacgcaggguacaucgacggcggagcaucccaagaggaguucuacaaauucaucaagcccauacuagagaaaauggacggcaccgaagaacuucuagccaaacucaacagagaagaccuacuccgcaagcagaggaccuuugacaacgggucaauaccacaccaaauucaccucggagaacuccacgcaauccuacgccgccaagaagacuucuacccuuuucucaaagauaaccgagaaaagaucgagaaaauacucacauuccgcauccccuauuaugugggaccccuggcccggggcaacagccgcuucgcauggaugacacgcaaaucggaggaaaccauaacaccauggaacuucgaggaggucgucgacaaaggugcauccgcccagagcuucauagaacgaaugacaaacuucgacaaaaaccuacccaaugaaaaaguacuaccaaaacacagccuacucuacgaauacuucaccgucuacaacgagcucaccaaaguaaaauacgugacugaaggaaugcggaaacccgccuuccucuccggcgaacaaaagaaggcaaucguagaccuccucuuuaagaccaaccggaaggucaccguaaaacaacugaaggaggacuacuucaagaaaaucgaaugcuuugacucggucgagauaucaggcgucgaagaccgguucaaugcaagccuuggaaccuaccacgaccuccugaaaaucauaaaggacaaagacuucuuggacaacgaggaaaaugaagacauccucgaggacauaguccucacacucacacuguucgaggacaaagaaaugaucgaggagcgacucaagaccuacgcucaucucuucgacgauaaaguuaugaagcagcucaaacgcaggcacuacacggguuggggccggcucucccgaaaacuuaucaauggcauaagagacaagcaguccggaaagacaauccucgacuuccucaagagcgacggguucgccaaccgcaacuucauccaacuaauacacgacgacucauuaacauucaaagaagcgauccaaaaagcacaaguauccggucaagggcauagccuucacgaacagaucgcaaaccuugccggcucucccgcaauaaagaaaggcauacuccaguccguaaaagucgucgacgaacucgucaaagucauggggcacaaacccgagaacaucguaauagaaauggcacgagaaaaccagaccacccaaaaaggacagaaaaacaguagagaacgcaugaagcguaucgaagaaggaauaaaagagcucggaagccaaauccuaaaggaacacccaguggaaaacacacaacuacaaaacgaaaaacucuaccucuacuaccugcaaaauggccgagacauguacgucgaccaagaacucgacauaaaccgccucucagacuacgacguagaucacauaguuccacagagcuucauaaaggaugauucgauagauaacaagguguuaacacggucagacaaaaaccgcggaaagucagacgauguuccauccgaagaaguagugaaaaagaugaagaacuacuggcggcaacugcuaaacgccaaacucauaacccaacggaaauucgacaaucucaccaaagcggaacgaggcgggcuaagugaacuagacaaagcgggcuucaucaaacgccagcuagucgaaacacgccaaauaaccaaacacgucgcccaaauccucgauucuaggaugaacaccaaguacgaugagaacgacaagcucauaagagaaguuaagguaauaacccuuaaguccaaguuggucucagacuuccgcaaagacuuccaauucuacaaaguucgugaaauaaacaacuaccaccacgcccacgacgcauaccuuaaugccgucgucggaaccgccuuaauaaagaaauacccgaaacucgaguccgaguucgucuacggagauuacaaaguauacgacguccgcaaaaugauugcaaaaagcgaacaagaaaucggcaaagccacagcaaagagauucuuuuacuccaauauaaugaacuuuuucaaaacugaaauaacacucgccaacggcgaaauccgaaagcguccccuaaucgagaccaacgaagaaacaggagaaauagucugggacaaagggcgcgacuuugccaccgugcggaagguacuaucgaugccacaagucaacauagucaagaaaaccgagguccaaacaggcgcccugacuaacgaaucaaucuacgcccgcgguagcuucgauaaauuaauuagccgcaaacacagauucgaaucaaguaaauacggcggauucggcucccccacaguaaccuacuccguccucguaguggcaaaauccaaaguccaggacggaaaagucaaaaagaucaaaacaggaaaggaacucaucggaauuacacuccucgacaaauuggucuucgagaaaaacccccucaaauucauagaagacaaaggcuauggaaacguccagaucgacaaaugcauaaagcuccccaaguacagccucuucgaguucgaaaacggcacccgucgcaugcucgccagcgucauggccaacaacaacagccgcggugaucuccaaaaagcgaacgaaauguuccucccggcaaagcucguaacacuccucuaccacgcacacaaaaucgaaagcagcaaagaacuugaacacgaagcguacaucuuagaccacuacaacgacuuauaccagcuccucagcuacauagaacgcuucgccucccuuuacguugauguagagaaaaacaucucaaaagugaaagaguuguucuccaacaucgaauccuacucgauauccgagaucuguagcucgguaaucaacuuauugacccucacagcaaguggcgcgccagcugacuucaaauuccuugggaccacaaucccacgcaaacgcuacggcucaccacaaucaauacucagcucgacgcuuauacaccaaagcauuacagggcuauacgagacccgcauagaccuuagccagcuugggagcgacuga

SEQ ID NO: 6636 - RNA, 4119 nt, Artificial Sequence
  Cas9 variant
augaacaacgaauacuucgugggcuucgacauaggcacaaacagcgucggagccgccguaacggacgaaaaguaucauguacuuaaauucaaagggaacgccauguggaccuccgccguauucgaaucggcccaacaaucggccgaccggcgacuaaaccgcaccgcccgcagacgccuugaccggucgcagcaaagacgcgaccuccugcaggaacugauagcacccgccauaacacccguggacccaagauucuucgacaggaucagggagagugcacucugggccgaagacaagacaaccggcucacgguucacguauuucagcgacgagggcuacacagacaaacaguaccauaaagaguaccccaccauacaccaccugaucugcucccuaaugaacgacccagccccacacgacccccgccuuguauacaucgcuugcagcuacaugcuaacucaucgcggacauuuccugaacgaagcagauaaagagaaaauugacgacguccuggauauccggcgggucuucaacgaacuuugcuccugguuuaccagcuacggaaucgaagugccauucagcugcuucccggaagaauuuggaaauguacucacggccaaccgcgggguccaagacagaacgagagccuucuaugaucuacuauucgccggcaaaaagcccaaaccguccgaagacgaccaaguggacaucgacgugcugauaaagcucaucagcggcgggaaaauagaacucaguaaacucuuccuaaacgaagaauacuccgagcuugagaacaacaaaauacaauuaucagacgccggauucgacgaaaaagaacccgagcuccgaagcgaacuaggcgacgacuucgggcuagucgcagcagccaaaaacaucuacgacuggagcuuacugaccggagugcuuggagagugcaaauccaucucagaagcaaaagugaagacguacgagaaacauucagaggaucucgccgcucuaaggcgaguugucagaaaauaccacccggauaaauacaaagaaauauuuaaaaaguacguagugggcaauuacaccagcuacuccggcaacgucaagagcgcuggaaagaucuccgaaacaaaacucaaacgcuguaaccaagccgaguucugcgacuaccuaaaauccaaacugaaggaugucaagccggcccccggcgacgaugaaugugaacgaguacuuaaagaaauaagcaaacauacguucugcccgcgacaggucaccacugacaacaggguaauaccguaccagcucuacuacacggaacucaaaaagguccuagagaacgccaaacgcuacauaccacaauuaaaugugaccgacgaguacggaucagcggccgacaaaauacuaucacugaugacauuccgaauccccuacuacguaggcccgcuagucaaaaagaacgacucuagcaaugccuggauagucaggcggggagaaggcagaauccuacccuggaauuucgacgaacuggucgacaaggacaagugcgaggacgaguucauccgaaggaugacguguaaaugcaccuacaucgcgggcaagaacguccuccccaaaaacagccuacuauacugcaaauucaugguccucaacgaaaucaacaacaucaagauaaacggcgagcgcauauccguaggagacaaacagaaaaucuacacggaacucuuugaaaagaaacgcaaaguaacaguccgagacaucagaaaccuacuaaccagcgaggguagacugaaagcuggcgacacuuucggaggaaucgacaucacaguaaagagcucauuaaaaccccaacacgaccucaaacggcucauggcagccggcgucaucacagaagcugaugccgaggagauaaucgagcgaauaaccugcacaacagacgucagccgacugcgaacauggcugggcaaauucggacugucagccgcggacgccaaauacguaagcggguuaaaauacuccgacuucggacgccucucgcgcgaguuccuaacugaagucaacgacguggaccccgcaacaggagaagugaucaacccaaacaucauaaccaugaugugggagaacaacauaaaccuaauggaacugcucucccagaaauacagcuacaggucucaaauagaaucgaugaaccgcgaauacuacgccgccaacccccucacacuggacgagcgaauguccgaaauguacaucccguccgccguaaggagaccaguaaagaggacaauagaaaugaugaaagaauacaugcacauaaugcgcaagccaccgaaacgcauauucauugaaauggcccgcgaacuaaccgaccucgacaacaaagggaaacggacaagcucacgcaggaacacccuacuagaguucuucaagaaaugcccccaagacacaaccgaacugagagcacaacuugaaaagaaauccgacgacgaacuaaggagcgaaaaacuguaccuguacuucgcacagcuggggaaaugcauguacuccggagaaagcaucgacauagaacgucuaggaucgaaacuguaugacguugaccacaucuuuccacaagcacgggucaaggacgacucaauugaaaacaagguccugguccuaucugauuuaaacggggcaaaaucagaucgauauccuaucaacgccgacauacgcaacaagaugcacucauucugggauaaacuccacagcaucggucuaaucggagagaaaaaguacgaacgccuaacaagauccaccggcuucaccgacgaugagcucgccggauuuauaucacgccaacucguagaaacgagacaauccacuaaagccguggccgcacuccuggccgaggaguuccccgaaagcgagaucgucuacguuaaggccggacuggcuucccaauuccgccacgaguucggccuguugaaaugccgggagauaaacgaccuacaccacgcaaaggacgcauaucucaacaucgugaugggaaacauauaccacgugaaauucacgaaagauccaaugaacuucguuaaagaguaccgccgaaaagagcaggucuucgaccuaaaaauccaauccaugcucacccacgacgcgauccgcaacggugagaccgcuuggauaggcgauggaaccugguuagagacaguaaagaaacaaauggagaaaaacaacauccgcuacguccgauacucguuccgccgcaagggcgcucuguuuaacuugaugcccgaaaggaaaaacccaagccuccugccacgcaaaaacggcaaaaacaugguccucccggccgaaaaauauggaggauacaacaacacagccgccagcuucuucucacucguuaaauaucacucugcgaaaggaagcgggguaguaaucauacccgucgaguuaauccacgcacaccgcuacgagcacgauagcaguuucgccgaagaguaugcacuccgcguccucgcagacaucguuagucucaagaagggcgacgucuugcaauccgucgaguucccguuaggcagucgcauucucaagguaaacacacuccuagacauagacggcuuucgcgcuaacauaacaggcaaagacagcgggggcaaauaccucggaaucagcucagcaaguucuuuaauuaucagccagguagacaccacauacaucaaaagagucauaagcaucaacgaacgcaucucagccugcgaaaagaacaaacaauccuacacaauacgcccagaguucgacguaauaacaagcgaaagaaacauugaaaucuauaacaugcugugcgagaaaaucucgagccgacccuucugcauaaaauucgcgaauaccucagacacguucguaagcggacgcgaaaaauucaucgcacuaucccucaacgaacaaguuaaaacgcucaccaacaugcuaagcgucuucaaaaccgggagagcaucagggugcgaccuaaccaacaucggcggcuccaagaacaccgcaaucgucaaacuuaacgcaguacuuucaaacuuaaaagacuuuaagagcguaagaaucauagaccaaagccccaccggccucuacgaaaaaguguccccaaaccuacuaucccucuga

SEQ ID NO: 6637 - RNA, 4119 nt, Artificial Sequence
  Cas9 variant
augaccaaaaagaacuacagcaucggccuagauauaggaacaaacagcguaggaugggccgucaucaccgacgacuacaagauaccggcaaagaaaaugaaagugcucgggaacaccgacaaagaguacauaaagaaaaaccuacucggagcuuuguuguucgacuccggcgaaacagcggaagccacccgacuuaaacggaccgcacgccgucgauauacacgccguaaaaacagacuacgcuaccuccaggagauuuucgcugaagaaaucgcgaaagccgacaacucauucuuccagcgccuagacgagucauuccugacggacgacgacaaagacuucgauucgcaccccaucuucggaaacaaagcagaagaggacgcauaccaccaaaaauucucgacaauuuaccaucugcgcaaauaccucgcagacagcccugaaaagagcgaccugcggcucguauaccucgcgcuggcacacaugaucaaauaccgcggccacuuucucaucgaaggugaacugaaggccgagaauacggauguccaaaaacucuucacggauuucguagagguauacgaccgaacauucgacgacucacaccugagcgagguaacggucgacgccucgucgauccuaacagagaaaaucagcaaaucacgccgccucgaaaaccuaauagaaucauaucccaaggagaagaaaaacacccuauucggcaaccucaucgcgcucagccucggccugcaaccuaauuucaagaccaacuucaagcucuccgaagaugcgaaacuccaguucagcaaagacacauacgaagaagacuuagaggaaguccucgaaaagaucggcgacgacuacgccgaccuauucacgagcgccaaaaaccucuacgacgcaauauuacuauccggcauccucaccgucgaugacucgucgaccaaagccccacuaagcgccucuaugaucaagcgcuacgcugaacaccacgaagaccuagaaaaacugaaagccuucaucaagaccaacaaacccaaccuguaccacgacaucuuuaaagacgaaacccaaaacggcuacgccgguuacaucgaaaacggcguaaagcaggacgaguucuacaaguaccucaaaaccauacucuccaaaacagacggaucagaauauuuccuugacaagaucgaacgcgaagacuuccugcgcaaacaacgcacguucgacaacgggucaauuccgcaccaaauccaccuccaggagaugcacgcaauccucagacgccaaggagacuacuacccauuucugaaagagaaccaagacaggaucgagaaaauauuaaccuucagaaucccguacuaugugggaccucuagcccgcaaaaacuccagauucgccugggcggaauaucacagcgacgagaaaauaaccccuuggaauuucaauaaaguaauagacaaagaaaaauccgccgaaaaauucauaacucgcaugacacuaaacgaucucuaccucccagaagaaaagguccugccaaaacacagccacgucuaugaaacguuugcagucuacaacgaauugacuaaaaucaaguacguaaacgaacaagggaaagaggcuuucuuugacucaaacaugaaacaagaaauauuugaucauguauucaaagaaaaccgaaaaguaaccaaagagaagcugcucaauuaucuagauaaagaguuucccgaguacagaauacaggaucugaucggccuagauaaagaaaacaaaucuuuuaacgcaucacugggcaccuaccacgaccucaaaaagauacuagacaagucauuccuagacgacaaagucaacgaagaagugaucgaggacauaaucaagacgcuaacacuauucgaagauagagagaugauacagcagaggcuccauaaauauucagacaucuucucuacgcagcaauuaaagaaacucgaacgccggcacuacacgggauggggacgauuaucauacaaacuaaucaacggcauacgcaacaaagagaacaacaaaaccauacuagaauaccuaauagacgauggcuacgcgaaucgcaacuucaugcaacucaucaacgacgacacacugccauucaaacagaucauaaaagacgcccaaauaauugggaacaucgacgacaucgcggcggucguccacgaacucccaggauccccggccaucaaaaagggaauacugcaguccaucaaaaucguagacgaacuggugaaggucaugggacacaaccccgacaacaucguaauagaaauggcaagagaaaaccaaaccacuaaccguggacggagucaaucacagcagagauuaaagaaacuacaagacagccucaaggaacuaggcucaaacaucuuaaauaaaaagaaacccagcuacguggaggacaaaguagaaaacguccaccuccaagaugaccgccuuuuccuguacuacauccaaaacggaaaggacaucuauacaggcgaggaacuugacaucgacaggcuauccgacuacgacauugaccacaucauaccccaggcuuucaucaaggacgacuccaucgacaaccgcgugcuaacgagcuccgccaaaaaccgcggaaaauccgacgacguacccaaccucgauauaguucgcgcacgaaaagccgacuggguucgccucuacaagucgggacucauauccaagcgcaaauucgacaaccugacaaaaagcgagcggggcggacucacggaggccgacaaagcaggguucauaaaacgacagcuaguagaaacgcgacaaaucacgaaacauguggcccaaauacucgacgccagauucaacacugagcacgacgaagaugacaaggucaucagaaauguaaaagucaucacucucaaguccaaccuuaucagccaauucagaaaagacuucaaguucuacaagguccgcgaaaucaacgacuaccaucacgcgcacgacgccuacuugaacgccguagucggaaccgcucuccugcgcaaauauccgaaacuggccccagaguucgucuacggcgaauacaaaaaguacgacgugcgcaaacucauaaccucuuccucagacaaagccacggccaaguacuucuucuacucaaaucuaaugaacuuuuucaagcggguaguacgguacaguaauggaagagugaucguccgccccgucauugaauacucgaaagacaccggggagaucguauggaacaaagagaccgauuucaggacuauaugcaaaguacugagcuacccacaagucaauaucgucaagaaagucgagucgcagacgggaggauuuucgaaagaaucgauacuacccaaaggggacucagacaaacugauuccacgcaaaaccaagaaaguauacugggacaccaagaaauacgguggauuugacagcccaaucaucgccuacucggucuuuguaguagcggacguagagaaaggcaaagcgaagaaauuaaagaaaguaaaagaacucgugggcaucucgaucauggaacggcccucauucgagaaaaacccaaucgucuuucuggagaagaaaggauaccgcaacguccaagaagacacacugaucaaacuaccaaaauacuccuuguuugaguucgaagguggacgccgccgucuccucgcauccgccagugaacuacaaaaaggaaacgagguaguacucucagaccgccugguagaacugcuauaccacgcccaccggguaaacagcuucaacaguacagaacaucuaaaauacgucagcgaacauaagaaagaguucggcgaagugcugagcugcguagaaaacuucgcuaacucauaugucgacgucgagaaaaaccuagacaaaauaagagcuguaaucaacaaaauagacaccuucagcaucgaagaaauauccaccagcuucgucaaccuccucacacugaccgcgcuaggcgcccccgcagacuucaacuuucuaggcaagaaaauccccaggaaaagguacacauccacaaaagaaugccucaacgccacacucauccaccaaucaaucaccggacucuacgaaacccgcauagaccugucgaaacuaggugaagacaaauga

SEQ ID NO: 6638 - RNA, 4119 nt, Artificial Sequence
  Cas9 variant
augacgaagaaaaacuacucaaucggacuggacauagggaccaacagcguaggaugggcaguaauuaccgacgacuauaaaguacccgcaaagaaaaugaaaguucucggcaacacagacaaaaaguacaucaaaaagaaccuccuaggagcacuacuauucgacagcggugaaaccgccgaggccacccgccuuaaacgcaccgcgcgacgccgcuauacccgccggaaaaacaggcuacgauaucugcaggaaauauuugccaacgagauagccaagguagacgagucauucuuucaacggcuagacgagagcuuucuaacggacgaugacaaaacauucgacagccacccgauauucggcaacaaggccgaagaagacgccuaccaccaaaaauuccccacaaucuaccaucuccgaaagcaccucgccgacagcagcgaaaaagccgaccuccgccucgucuaccuagcgcuugcgcacaugauaaaauuccgaggacauuuccuuauagaaggagaacucaacgcagagaacaccgacguccagaaaaucuucgccgacuuugucggagucuacaaccguaccuucgacgacagccaccuguccgagauuacaguagacgucgcaagcauacuaacugaaaagauaucgaaauccagacgccuugaaaaccucaucaaauauuaccccacggaaaagaaaaauacccucuucggcaaccuuauugcucuggcacucggccuacaacccaacuuuaaaacuaacuucaaacuuagugaagaugccaaacuucaauucuccaaagacaccuacgaagaagaccuugaggaacuccucggaaaaaucggggacgacuacgccgacuuauucaccagcgccaaaaaucucuaugacgccauucuacucuccgggauacucaccguagacgacaacagcacaaaggcgccgcuauccgccucaaugaucaaacgcuacgucgaacaccaugaggaccucgagaaacuuaaagaauuuauaaaagcgaacaaaagcgagcucuaccacgacaucuuuaaagacaaaaacaagaacggcuacgcgggauauaucgaaaacggcgugaaacaggacgaguucuacaaguaucucaagaacauacucuccaagaucaaaaucgacggaucugacuauuuccuugacaaaauagaacgggaagacuuccuacgcaaacaacgaaccuuugauaacgguucuaucccacaccagauccaccuacaagaaaugcacgccauccugcgccgucaaggcgauuacuauccauuccuaaaagaaaagcaagaccgcauagagaaaauacucaccuuccggauucccuacuacgucgggccccuagugcgcaaggacagccgcuucgcaugggcagaauaccgaucggacgagaaaauaacccccuggaacuucgauaaaguuaucgauaaagaaaaauccgcggaaaaauucauuacgcguaugacucucaacgaccuauauuugccagaagagaaaguccuccccaaacacucacacguauacgaaaccuacgcggucuauaacgaacucacaaaaauaaaauacguaaacgaacagggcaaggagucauucuucgauagcaacaugaaacaagagauuuucgaccacguguucaaagagaaccgcaaggucaccaaggagaaacugcugaacuaccuaaacaaggaguuccccgaauaccgcaucaaagaccucauaggacucgacaaagaaaauaagagcuucaaugcaucccucggcaccuaccacgaccucaaaaagauacuagacaaggccuuccuggacgacaaggugaacgaagaagucaucgaagauauaaucaagacacuaacacucuucgaagacaaagacaugauccacgaacgacuacaaaaauacuccgacaucuucacggcgaaccagcucaaaaaguuggagcggcgccacuacacaggcuggggccgucucagcuacaaacuuaucaauggaauccgcaacaaggagaauaacaaaaccauccucgauuaccugaucgaugacggaucagccaacaggaauuuuaugcaacugauaaaugacgacacacugccauucaagcaaauaauccagaaaucccagguagucggagacguugacgacauagaggcggucgugcacgaccuccccggcucaccggcaauaaagaaagggauacuccaguccgucaaaaucgucgacgaacucgucaaagucaugggaggcaaccccgacaacauagucauugaaauggcgcgugaaaaccaaacgaccaauagaggacgcucccaaagccagcagagguugaagaaacuccaaaauucacucaaggagcuaggaucuaacauccucaacgaagaaaaaccaagcuauauagaggacaaaguggagaacagccaccuucaaaacgaucagcuguuccucuacuacauccaaaauggcaaagauauguacacgggagacgaacuggacaucgaccauuugagcgacuacgacauugaucauaucaucccacaagcguucaucaaagacgacuccaucgacaaccgcguccuuacauccagcgcaaagaauagagguaaaucagaugacguaccaagccucgacauagucagagcccgcaaagccgagugggugcgccucuacaaauccgggcugauuuccaaacguaaauucgacaacuugacgaaagcagaacgaggcggccuaaccgaggcugacaaagcgggauucaucaaacgccagcucguagaaacccgacaaauaacaaaacacgucgcacagaucuuagacgcaagauucaacaccgagcacgacgaaaaugacaaggugauacgagacgucaagguaauaacacucaaaagcaacuugguuucacaguuccggaaagacuuugaguucuacaagguucgcgaaaucaaugacuaccaccaugcccaugaugccuacuuaaacgcagugguagggacagcucugcuaaagaaguaccccaaguuagccuccgaguucguauacggcgaauauaagaaauaugacauccguaaauucauaacaaacuccucggacaaggccaccgcgaaguacuucuucuacucaaaccugaugaacuucuucaagacgaaggucaaguaugccgauggcaccguguucgaacgccccaucauagagacgaacgccgacggcgaaaucgccuggaauaaacagaucgauuucgaaaaaguccgaaaaguccuauccuacccccaagucaacauaguaaagaaaguggaaacacaaaccggcggauucagcaaagaaaguauccucccaaaaggcgacagcgacaaacuaaucccacggaaaacuaaaaagguauacugggacaccaagaaauacggaggguucgacucgccaacaguagcauacagcguauucguagucgcugacgucgaaaaagggaaggcaaagaaacuaaaaaccgucaaagaguuggucgguaucagcaucauggagcggagcuuuuucgaggaaaaccccgucgaguuccuugaaaacaaaggauaccacaacauacgagaagauaaacuaaucaaacuaccuaaauauucccucuucgaguucgaaggaggacgccggcgccugcucgcgagugcuagcgaacuccaaaaaggaaacgagaugguccuccccggauaccucgucgagcuacuauaccacgcccaccgcgccgacaacuucaauucaaccgaguacuuaaacuacguaucagaacacaaaaaggaguucgaaaaaguccucuccugugucgaagacuucgcuaaccucuacguagacgucgagaaaaaccucagcaaaauacgcgcgguugcugacagcauggacaacuucucgauagaagaaaucucaaacuccuucauaaaccugcucacgcuaacggcccugggagcuccagccgacuucaacuuccuaggagagaagaucccgaggaaaagauacacuucgacaaaagaaugccuaaacgccacacuaauccaccaaagcauaaccggccuguacgagacaagaauagaccuguccaaacuaggagaagaguga

SEQ ID NO: 6639 - RNA, 4119 nt, Artificial Sequence
  Cas9 variant
augaacagcgacaaaagggaagacuauuacgucgggcucgacauggggacagguagccucggaggcgccgucaccgacacgcaauaccaccuccuaaagguaaaaggcaaagacuucugguucgugcgggaauacgaaacagcaaaaagccagcuagacagacguacccaccgcaucgcgaaaaggagacugcaacgccacaaagcgcggauaggacuaauccggagcuacuucgccgaagauauccuaaagcaugacccccucuucuacauccggcaggacaacucaaaauacuaccacgaagacaaggacgucagacugaccaccaaggacucaaucuucgccgacccaggauacggagacaaagaauauuuagacgacaaggaauacccaaccauauuccaucuacgccaagcccuccucagagaccagauaaaagacgaagaacgcuacuccagauuccucuaccuggcaaucaucaacauguucgagcaucgagggcacuuucuccugaacacggaaaguagcgaccucaacgccgacaugauaaaggacgugggggaacugguaaugaacgcgauaugcggcgucagcgaguacggcucggugacuuacaaggaaauaaucgaaauacucgaagacaagaacauaagccgcaccgccaagaaagaccaaauagcuucaaaaauugacauuaaaaaguccgaaaaggcacagauggaacgcauaaagugccuaugcggaauggaagccgacgccagggucauguucgaaauugaagccgacgagaaaaucaagaucgcguuccaacaggcggcuuucgaagacgagaaggaagagauagaagcagugaucggugaagaccgauacuuaauaauagagaacaugaagcaacuuuacgacuacagccaacuacagucgguccuaaacggcuucgacuaccucagcgacgcccgcguucagauguacgaaaaacacaaggaggaccugcaccuccuaaagaaaguauaccgcaaaaaucucgacagagagauauacgaccgaauguucaggagcggagaggaaggguccuacugcgccuacaguaacuccacgaacucagucgacucacuggcagaggcaaagaaauaccggaggaauaugaagaaaaggucgcaaaaagaccucuacgaccggauuaaaaaggacuuaaaagaaguccacgacgccgaugcagacgcgauccgaaaagaaauggaacuagaacgcuuccugccgaaacaaauaaccggugccaacgggaucaucccuaaccagguccaccgcaaggagcuaaagaagauacuugagaacgcggagcaccaccuggacuuccucaaggaaaaggacgaguccggcuacacggugagcgaaagaauccucaugcuguucagcaguaauauucccuacuacguggggccagucggaagcgguuccaagacagggugggcaaaaauacaggaaagcggccaaguacucccuuggaacauggaacagaagauagacaucgagcaaacaagcgagcgguucauuacgaaccugauacgcgaguguacguaucuaagcggugaaaaagugcucccaaaacagagccugcuauacgaaucauauugcguauugaacgaaaucaauaaccuccgcauccacgggaaacgcauagucccagaacuaaagcaagacaucuauaaagaggucuuccaaggguuccggcucggcaaaaaggugaccaaaaagaauauaugcacauaccugaucaaucgcggacucaucacagaagaaagcgaagucaguggcauagacaaagagaucaacgcguaccuccccucguauggcaaaauguacggggucuucggcgagcgccucagagaagaagccgugcaagagauagccgagaaaauaauauacuacggcacuauauauggagacgcgaaauccauguuccgcaagaaacuaaaccaauacguaagcgacggguggaugaccgaauaccaagcaaaacgcauauccggauauaaauucaaagacugggccaggcucagccgaucaaugcugugccuauccggaugcgauaagucaacaggcgaaaagaucagccuaauccgagccaugugggaauacaaccuaaauuuuauggagcuaaucuaccgggaagauuucaccuuccaaaaagagcuagaagaacgcagaaaagcacucggcaaaacccuccaggaguuccaguucgaagaccuagaugaauauuacuacuccgcucccguaaagcgcaugaucuggcaagcgguccaagcucuaaaggagauaacccaaauaaugggccacaacccgaaaagaauauucaucgagaugacccggacagaagaggaaaagggggaacaaggcaggaagaacucccgcgagaaaagguugcucaagauguacgaaucuauaagggaugaacgcaacugggcagccgaaaucaaaaacgcgaaugccuccggaaaauuaaacagcaaaaagcuguaccuauacuaccuacaaauggggcgggacguauacacgggugaaccgauagauauagaagaccuuuucgacgacagccgauacgauauagaccacaucuacccgcgcucacucacaaaugacaacaacauagagaauaaccucguacucgucuccaaaacaaucaaccaaaacgaaaagaaaaaugacuacccgguccccgagaaaaucaggcgcaacaagaaaguacgcaaccucuggcauacucuacauaaaaugggcuucaugaacgacgaaaaauacaaccgacucacgucgacggaaaggcuguccgaagaucaacucgcagguuuuauagcucggcaacucguggaaacagcccagggcgccaaaggaauagcugagcucaugaaagccaugcucccuggaacugauaucguauacgcaaaggcucggaacguauccgacuuccggaaggaguacaagaugcucaaaagcagacucgucaacgacuaccaucacgcccaggacgccuaccuaaauauaguggugggcaaugucuacuucaugaaguucaccaggaacccgaugaacuucgucaagacggaagccaggagagacggacgcaacuacgacuacaaccuauacaagauguacuccaaggacauaauccgcaacggcgaaaaggcauggaucgcaacgucggaacagggucccgggaccaucaggcuagugaaggaaacaaugggacgaaacaccccaauaauuaccagacaggcuuucgaacaacguggagagcuuuucaacuuacaaccagucgggaaauacagcgcgaagaaagacaacuacgugccacugaaaauaaacgaugagaaaaugcaagacguaagcaaauacggcggauacaccagccuaaaccccagcuacuucauauucaucgaacacggccccgagaagaaacgcaagaaaugcuuugaagucauacacagcuacuacgcagcgcaaauaaaaacagaaaaagaccucaucgacuucuuacuccagaagggcuacaaaaacccgcgagucaucaacgcacgcaucaaaaagaacgcgcugauaaaauacaacggcuacuuccuauacauaaucgggauggacgcacgaaagaacaucgaguucucaaacgccaccgcuaugugccucaaaaacaaguacauccaguacgugugcaaacuagaaaagaugaauaaagcaauacuacugagugaaaagcagaaaacaaaucuacauugggaugagaaaaucacuugcgaaagcaaccuagaacuguaccgagaacucaccgaaaaacaccuccauagcaucuaccaacgucacccacgcagcauaggaaaaugccucgccgacggggagggcgccuucaaacugcuggacauugaggaacagguuaaaaucaucugcgacaucguacaguacaccaguuuucagagaggcguauuuucccugaaaguccucgggggccccaaagaaguuggccgaauacgaauaagcgggaacaugaccgaagcaaaagagugcaaauuagucaacuacaguaucaccggcauguauaagacagaaauggaccuguuaaagaaauga

SEQ ID NO: 6640 - RNA, 4122 nt, Artificial Sequence
  Cas9 variant
auggagaaaaccuacuccaucggccucgacaucggaacaaacuccgucggauggagcguaaucacggacgacuacaaaguacccgccaagaagaugaaaguacuaggcaauaccgacaagaaauacaucaagaaaaaccuccucggggcgcuccucuucgauagcggggaaacagccgaagucacccgacucaagcgcaccgccagaagaagauacaccagacgcaaaaaccgccugcgcuaccuccaagaaauauucgcaaaagaaauggccaaggucgaugaaucguucuuccagcgccuagaagagagcuuccucacggacgacgacaagaccuucgauagccacccaauauucggcaacaaggccgaagaggacgccuaccaccaggaguuccccacuaucuaccaccuccgcaagcaucucgcggacucaucagaaaaagcggaccuccgcuuagucuacuuggcccuagcacacaugaucaaauuucgugggcacuuccucauagaaggagagcugaacgcggagaacacagacauccaaaaacuguucaacgacuucguugaaacguacgacaaaaucgccgacgaaagccaccuguccgaaguagacgcguccuccauauuaacgaacaaaaucucaaaaagccgacgacuagaaaaucucauaaaacaguaucccaccgaaaagaaaaacacauuauuuggaaaccucgucgcccuaguacugggccuacaaccuaacuucaaaaccaacuuuaaacucucggaagacgcaaaguuacaguuuagcaaggacacauacgacgaagaccucgaagaacugcucggaaagauuggugacgacuacgccgaccuauucaccgcagccaaaaaccuauacgacgccauucuccucagcggaauacucaccguagacgacaacagcacaaaagcaccccucagcgcuucgaugaucaaacguuacgaggaacaccacgaagacuuagaaaagcuaaagaaguucauaaaaguaaacaauuucgacaaauaccacgaaaucuucaaagacaaauccaagaacggguacgccggauacaucgagaacggcgucaaacaggacauauucuacaagcaccucaaaagcauuaucuccgaaaagaauggcgggcaauacuuccucgacaaaaucgaacgagaggauuuccuccgcaagcaaagaacauuugacaauggguccauaccccaccaaauccaccuccaagaaaugcgagcuauacuccgccgccaaggcgaauacuaccccuuccucaaggaaaaccaagccaaaauagaaaagauccucacuuuccgcaucccauacuacgucgguccauuagcccgcaaagauucccgguucgcgugggcgaacuaccacuccgacgaacccaucacuccguggaacuucgacgaagucguugacaaagaaaaaucagccgaaaaguucaucacgcgcaugacgcucaaugaccuauacuuacccgaggagaaaguauuaccuaaacacucccacguguaugagacauucaccguauacaacgaauuaacuaaaaucaaguacgugaacgaacagggagagagcuuuuucuuugacgcuaacaugaagcaagagaucuuugaccacgucuuuaaagagaaccgcaagguaacgaaggcaaagcugcucuccuaccugaacaacgaguucgaagaguuucgcauaaaugaccuaaucggucucgacaaagacagcaagucguucaacgcaagccucgggaccuaccacgaucucaagaaaauccuagacaaauccuuccuagaugacaagacgaacgaacaaaucauugaagacaucguccuuacacuuacccucuucgaagaccgagauaugauacacgaacgccuacaaaaauacagcgacuucuucaccagccaacaauugaagaaacuagagcggcgacacuacaccgggugggggcgccuuucguacaaauugaucaauggaauccgaaacaaagagaacaacaaaacaauccuagacuuccuuaucgacgacggacaugccaaccgaaacuucaugcaacucaucaacgacgaaagccugagcuuuaaaacaauaauccaagaagcccaagugguaggcgacgucgacgacauagaggcggucguucacgaccuacccggcagccccgcuaucaagaaaggaauacuucagagcgucaaaaucguagacgagcucguuaaagucaugggagacaaucccgacaacauaguaaucgaaauggcccgugagaaccaaacuaccaaccgcgaacgcucucaaucgcaacaacgacucaagaaacuccaaaauucgcuaaaagagcugggaucgaauauucugaacgaagaaaagccguccuacauagaggacaaaguggagaacucccaccuacagaacgaccagcuuuuccuauacuauauacagaauggaaaagacauguacaccggggacgaacucgacauagaccaccugagcgacuacgacauagaccacauaaucccacaggccuucaucaaggacaacagcaucgauaacagaguccucaccucuagcgccaaaaaccgcgguaaaucggacgacguccccucgcuagacaucguccgugcgaggaaggcagaauggguccgacuauacaagaguggccuaaucagcaagcgcaaguucgacaaccucaccaaagccgaacggggaggccucacggaagcagacaaagcgggcuucaucaagcgccaacucguggagacgagacagaucacuaaacaugucgcacaaauccuugacgcacgauucaauaccaaaagagacgaaaacgacaaagucauaagggacgucaaagucauaacacugaagucaaaccuagucagucaauuucgcaaagaguucaaauucuauaagguccgcgaaaucaacgacuaccaccaugcccacgacgcuuaccucaacgccguagugggaaccgcccuccuuaagaaauacccgaaacuaaccccggaauuuguuuacggcgaauacaagaaauacgauguccggaaacugauagccaaaaguuccgaugacuacucagaaauggguaaagccaccgccaaauauuucuucuacucgaaccuaaugaacuucuucaaaacugaagucaaauacgcugacggccgcgucuucgaacgccccgacaucgaaacaaacgcagacggcgaagucguguggaacaaacaaaaagacuuugauauugugcggaagguccugucguacccccaagucaacauagucaagaaagucgaagaacagacuguaggacagaacgggggccuguucgacaacaacauacucgcgaaaccagaaaaagacgacaaaaagaaacuguucccaaucaaaaagucacucagcacuaccuccuacggaggguaugcgcgugcuacaauagccuacucuauccucaucgucucugaguucggaaagaacaaggaacuaaaacuccucggccucccccucuuagacaaggugaaauacgagaaaaacccaauagcguacuuaaacagcaucggcaucauaaacguuaaauccauuuucaaacuucccaaguacugucucuucgaauuucaagaaaagaauaccaacuaucgccgcuacauggucagcaaucaggaacuaaaacgggccaaucagcuuuucuugaccugcaaagaaaccgagcucguuuauaaauacauaaaauccgacaaugacaacacccaccucgucggcaacgagaaaacaauccuaagcaucuggaacaaacucgucaucuucauggaacgcacaaagcugauagacaagaaacuguucgccagccugaaacaacugaaagacgagguggaccucauaaacauccuagauaugacagcuaaaucucuugacuucacaaaaauuucagccggccagaagaagauuacgaucuccgacagccuaagccuccccaucaagcgauggcaauucagcucagacgagaaaaugcucaagcagcuaaagaccgcaacccucauccaccaaagcgucacgggccuauacgaaaccaggauagaccuguccaagcucggggaagaauga
